United States Patent 7,365,185 (GENOMIC PLANT SEQUENCES AND USES THEREOF) - sequence listing, part 57

SEQ ID NO: 69150 - DNA, 14919 bp, Oryza sativa
ctgcagcccattttcaatccggcacatcaatttttttcaccaatttagagtcggactttttttggtttctgagagggaatcggatataggagtcggacttttttattttaattttttcgctattttttttaacggacgaaggaagcatctcttattttttaagtagtagagatagagactggggaagaatatataggacacttgcaaacctagcttgtggatgtaaaatacaaaaatgaagcccaatacattttttcttttttctatttctcctaaacaattatcagtttttccttcaaatttgattttatcttacttttgatcaaaaaatttcttcactatctaccattagaaatcaagaactacatccatgattttttttattttttctgaaaatttgaatttgctcaaaatttctcaaaccctaaccaccggtaaccgatcccctccgcacgcggtaagcgcgataaccgcaattaccgcgcgataacgtgaaccctgggtatcacacgctctcaatgtgcttacttattcttagaagcacagtagcttccttgctaaagcaaataatacgagctataatttgtttaagtaattttgtattgtcaggacttgttgaaataatgcaaattatgggtggtctgacatgaaaatacgtaattgttcatctaccaaaattcatttatcgtcgtcgtccttccccttattatgcggttactagttgacatactgaatttacatcgtggggattagtactccaaaagttccatagtgatatacattgctcgtactgaatttgtcaaaaaaaaaatcaacagttttattattgcttcaaataattaatcaacccgacgttatggtcatggatttctacaccatttcaaggtaatagtttcttctgtagtaagagataaaaaaacttccaatttttaatgactagttctcgtgtacgtacgtgctagagtcctacagatgcatgaggtcatggggacgttcgagctttgaggtcgtagacgaaggtcgttccatttccttggtctacactagattccctgtgcctcctacgccctaactaaatgagaaacatgtgtagacccttttgcttgctggcgttatgcatgctactcccgtgctggaaattcttgctaattcgacgatcggtatacgcgtcctataaactgtgcttcgtccaagatgacgcgcagctaatatctgtagtcctccttgtggaccacctaaaaatatattctatccgtcccaaaatataagagatctaaaagaatgtgatatatctggacaagttctttatccagattcatattaatatgatacatcatatccattcaaagtcccttatgttttgggacggaggaagtatgtggcatcggatctcgtcttaattatcataccatctaatctgggaggtcatacatgcctttttcttttcgagagacatatgatttggtttttgctatatataaaatgattatgatggagatttaattgattatagtgctcatgggaagcttaatttcacagtaattaagtctgaagatcctgaaacaggaagccactcagatgccctttttatcatcaaaagggttttcggtttcaaaaatcatgcatagtagtagtttgttttgatatgaccaaacatattttcatttcagatataagtctaaaggtatactatcaaactaatactgttcttgcactgctccttttcaatcgatcgcactaattacaaagggcaagatcagatccatgcaagtgacacacaggtcacccataccccactccaaacacccagatttcctcctcgatcatgcaagtcatggcgacgccttgagcttcggcttcacagttcgaaaatcgaaccacaagcggaggaaacagatcgagacagaaggcggtacctgaaaccatattggaacgaacaattcttggttatctgtatatggaattcccgatgcctcgtatgcccttaatttgcacatccaacaccacaccaagatatcaggttgtagtaagcatatatgtagagcaactttgctttcatgagaagctatcggtttgtaatgcagttatgtttttttttccctgaaaattaagtaggaagatttgagatttcaaactggagtccacttaggatatcctggtgtaatgcgtgtaatgcgtccattatgactatgtgctatatatgtaggtggtattttctccgggttgataatggttgtcgttttagcgaagtgtcgacgggggacacccgtagaccggatatagagagtattggggtacgctggtacgaggatctacgtagtacgacatcaaggaaacaagagacaaagattatactggttcaggccccttaatagccctaatccagttgatatgggattatatggagataaccacaaattacaaatggaataatagaactcgacgataccgacaagatcgtagtcgagttgattcgactagatcacccgacgactttgctcctgtaggcaccggcttcgtagactgtggtcattgtgttggctatgagattcgatgccttaggccttcccggggggtcccttttatatcgcaggtcaggtggtctccaagtaggactcggagacatcggactctgcatgatacagtgacgacccagtcctatacgggtagggacctttccattggtggacttcgtgatggatttccttagcgtatacagtgaacgtctgtacacgcgcagatgtaccatattgccgtatagcgtacatccaagggtagagggtataccttatccgtaaccctgacagtagcccccgacttgagcttaaatgaacttatgtaatcggtcgcgacttctgatgtcggagttgctgtcgttctcgactggtcgatctcggtgtgaggactgtagagacaaggagtggtcgacaacaccatgcgaagttcaactgttatgagtgaatttaaattgaagtccaaaaaaccgcctcgcgcaacggacccagaaatttccggcggccatctctctcctttccttggaattcgcaccgtcggtagtgcgcctattcaaaggagttttgggaatccattttggagtccggctgttgcaagaacattctagcctccgaacgctcttcgtcttctccgcttccacgcaaaccctaattcgctcgcctcggtttcttctccggtgatctccaacggcgatgaaccttgacaagtccacttccaccagcgcgtctttgaagaagttgcaggaggagggcgctctccccggtcgcgggaccatggagagggaaccgggaggtactgaacctaaacccgtcctgggccgcatggttgcggttgaggattatattctctgtggctttcttcctccgccttctgagtttttccttctcgtcttgaacttctacggtctttctctgctccatctgaaccccatctccatagccttccttagcattttttatcatctatgtgaggcctacattggggtagagccgtttcttgacctcctccgtttttactacgagttgcgctggatggaacctaaaaaggtatccgggtgtgttggtttttgacttcaagatggcctgaagtcacgatatatccctttctagtgcccctcttctcgtagcaaatggcgggcgaggtggttctgaggagcaaccagacaagattccgtcttggaccgccaaacccgccttgaccctatccctccagtctttcattgacatcatcgatgacctccgagtacgagggttgttggagtatgaagtcgctgccgacttcattggtagacggatccagctgctccaggctcgagcccatccagcctttgactactctgggccggaggacacgacccgggtttctcctcagggtatttttcttgtattctgggtttctctcctttcatgcgcattcctcctgacttatcgaaatttggttctcgaactacaggtttgaacagcgcaaccgtggagcgccgtgttgcccaggtgatgatcagtggtcccacgacggtgagcaacgcccccatccctctttgcgagaaagaggcggctgagcgcgaagccgcaatcaacgtgagtgtaatcgatgaccctttaccctttaactctttagatcgcatcgtgacttcatgttgtgcaggctctccccatgactgacatcatcgggccgctcgcggaccaccagacggcggcttcgttgaaggagggcattgcccaggaggcgtccgacgcggccattgccgctactgctgccacgaccagcggcggcaaagttccgacgcccaccccatcgataagcctttttggttatcaattacatagtcggaaaatgtcgccctcatatcgtactcggtttacttaggcctcggatgcgtctcccccgcctccacgacggcagaggctggtgacactcggcgagaagtaagtggacgaaatttgaggcccttgacttgatcggattttggcgttttgttatgatgaccaacatggccgtctttcgtagggcggcgcgggcgaaggcggcgcaagatgggtctggggaaactccagcgtgtctcctgcagtggcctcgactgatgtcgttgtcgtgcccaggagccgcgaggtgacgcctagcggccctgccagcgatcttgcacccggtcgaggcccgcctgctgccgtcctcacatggggggagctccaagtcgagatggggcgcatcctcgaggctggtgctcgcggcataagttgcgagatcgcggaggcaagggcggcggcggcggcgtcggcgaacgagcgtgccgacaaactggcgcgtgacctggcggaggttcgcgaggacctccagaaaatgagggaactggtagccggcaacgaacggcaatggcaggggctcgagaactgcatgtcggaactcgagaacaacccgtcggagatccgaggtttgttgcgggtcacctacaccggcctacaccagctcgccagggaatgtagtgtcaagatcaccatcccggcgaaccctgatgagttctcattgacgtcttcgctcgcagaactggcggcggcgatggaggtgatcccctccaagcacgcggcagggatcggggaggaaacgtccaatgggatctacaccggggcgtgccatgtcctcgcgtgcgtaaggttggcgcaccctgaactcgatctccagaagatcttggatcagggggcggctagcgacgcgcgtaacgatgtgatggaggaggttggcgatctgggggagtccgttctcccactttttgaagagtagggctactacttgtctgtaccccttaaccaatcgcgctttgtaaaactttcgttggttccaactgcctttgtgtgtgcagttattgccttagttttccttagcgtcttgattttgagtactttgtgttgattatagagacgtcgatgtcgaggatatccagcagcgcgggcagcctgagttgcctgtaatcgctccggtactcgcactcgagccgtatgcgccacaggacgatgtggaccaggatatggcgatgactcctttaggttgttttttttgtctccatctcctttgctcttctatctggattagcttaacttgccgtgctctcggaagaggagaacagcttaacttagttatttgcttgccgagcagacctcgagagtgcgcttgctgaccacgaccgtcgcgtccaatactggaggacgaagttcggggtcgccgaacttgagaggactatgttggaagtgaagagggaccggggcatggagacactccgaggtcgcgaggtgtggttcaactcgtacctcaggagtttttgcacagctatggtcgttgtctgcagggaactccgaatacctcgtggggatcccaaggagtcagcggccgggtatatctcatggctgaacggggcctgtgctcagctcgaaggcatcggcaagcgtatcaacgaggccttgaagcaggagtgtcgtcgatcgagccggtatgccggagggcacgtgctggcatgtatacgagatcatcgtccgcagttacacctcgagttcctccacgaagggttttctcgttctcggaggactcctgcggagatagacaacctagcgaagtcgatggcgccgctagcggagaaaatcttctagtcgatggattggcgttggccttcctggtagtctttgtatatctgtgacaagcatcttaggaaaagtgtaatatattttggaattttttgcggtctgtaagaaatacttgtgaagtagaaagggagtctatctaactaagctttcttactctggatgtggtgcgtacgagtgtcttctcacttcgcgacttcgatcagtcacttgagttatacactctccctagcccccaaccttgtcatcggagaattcttctcggaagattaggctcttagacatttgacttgccttagttgaataagcactgatcctagcccccagccgtgaagttggaaaatccatttccgattacacggcttggttaatacgcatgacgagaactcttacactaccagatcttacatggtctttcgtctctaaaggatccgacaaggccttatcagctctgggcgtccccagccaaagttcccttaggttcctcgaaggccttgtcaagacggcgtaaagggacatgaggataggtttcaacgctaggtgtcatctgggtaagggatcgttgggaagggacactttgattgaaatctgtaccttgaaacaggctttactgaagttgtaagatgtcttacaagtatggatactattgacttatacatagaatttacgcaattggtcaatgttccaagaatttgctaactcgcgaccatcgccgtctgcaatcttgaatgcgcctggccgcaagacttgtgtgatcgtgtacggtccttcccatttgagtgagagttttttcgccctgcttggctttggactcgccgaaggacgtagtcgccgatcgaaagtatgcgtgctcggatgcgcttctcgtgataccggcggagggcctgttggtagctagctgccctgacggcaacccgttctcgatgctcctcgagtaggttcacgtcgtcgtttagctgttcctcctaatcctcgtcggagtacttatgcactcgtgtactctgatgtcgtaactcggtagggagcatggcttctgagtcgtacatgagaaagaagggtgtctctttgttggacgttgtcggtgtggtgcgcacggcccagagtactgaggggagttcttcgacccacttcttgtcatgtgatatcagcctgtcgtagacacgggtcttgatcccttgttgtactatgccatttgccctctcgacctgtccgttgctctaagggtgagaaaccgaggcagagcagaacttgactcccagtccgatgcagtaatcctggaaatcgacactgatgaactgggagccgttatccgttatgatgcggtgaggcagtccatatctgcaaaatatccctttaatgaatttgatggcattgtcggccttgatttctcccgtgggtgttgcctcgatccatttggtgaatttgccgatcgccacgaacaggaatttgtagccgccctgtcctcgtgggaatggaccgagtatgtcgagcccccagcacaagaacggccaagtcagagggatggtttgcagtgcttgcgctggtagctttgtgtgtttgctatgaaattgacaagcttcacactgttgtactatgtcgcaagcgtctttgagggcggttggccagaaaaatccttgtcaaatggcttttccgaccaatatacaaccggcaacatgtgacccacagatcccttcgtgtatgtcgaggaggaggtgttttccgtcgtcagacgagacgcatttgagaagtaccctgtttggcgccttcttgtatggatcgttgccgattatacaggagatttttgcttgacgggttattttctcgacttctgcatcgtccttgggcaactcgtcgctgcttatgaatttaatgagtggggtccgccagtcgtccgtggtctcgatgtcggcaacggcacgctctgcctctgtagcccctgagctgatgtcgggggcgactaggctatcttcgccgtttgcctcttttactgatggctttgtcaggatgtccagaaaggtgccgggttctagtggctctcgtctggatgcacgccgtgctagattgtccggctcgatgttgtccttgcgatatacgtgtcggacctcgatcccatcaaatctgtttttcagcttcctgacttctgcgagatacttggacagctcagggctagagcacttgtaatctttgtgcacctggtttgcgactagttcagaatccccttttacgatcagtcgtttgactccaagtgcagctgcagctcttatcccagcgagtagtccttcgcacacggctgtgttgttggttgccctgaagttaaggtgaattgcatacttgaactgatctcctgaaggtgatgtcaagatgaaccccgcacctgctccctggctgttgagtgcgccatcgaacgccattgtccatgtttcgttgtcggtctgactgtctaacctgttttcaggcgtagtccaatcggctacgaagtcagcgagaacatgggacttgatggctgttcgtggtacgaagtggacatcaaattggcttagctcgactacccatttcgcaatgcggccgacaacgtctttgtttctcatgacctcaccaagagggaaggaggagacaactgtgaccctatgggcttcgaagtagtggcgtagctttcttgacgtcatgattactacgtagagcagtttttggatctgtgggtatcttgtcttcgcgtcgtggagagcttcgctgacgtaatagactggtctttgcacgttttctcttttgacaacaatgacagtactcacagagtaaggcgtggcggcgatatagaggaataagtcttcattaggttggggagcaacaagtacagggggatttgacaggtagcgcttgagcgcgataaacgcctcttcggcttcctgtgtccatacaaatttgtcttttttttagcagagcgaagaaaggttgtgctcaatcttccatcctagcgacgaacctacttagtgccgccatgcatccggttagcttctatacctccttgagtcttgtgggcgacttcatgttctcgattgccttgatcttctcggggtttgcttctattcctctgccagagacgaggaacccgagcaatttgcccgatggtactccgaacgtgcacttctcaggattgagcatgagacgatatcgtctaaggttgtcgaaggtttcccgtagatcgtcaatcaatgagtcgtctgtcttggtcttgacaacaatgtcatcgacgtaggcctcaacattgttacccagctgatcgctaagtgccccttagaccgtacgctggaaggtatttcatgcggttatcagtccaaacggcattttaatgtagcagaatacaccgaacggcgtgatgaatgctgtcttctcctcatactcttttgccatgctgatttggtgatagccggagtaagcgtcaaggaagcttaacagctcacaaccagctgttgagtccactagttggtctattcgagggagagggaagtgatccttggggcacgccttgttgaggtcggtgaagccgacgcacatcctccacttcccgttggccttccgcaccatgactgggttggctagccactctggatggagtacctctttgatgaaactaactttgagaagcttatcgagctcttctcgtatggcatgtttccgatctggtgcaaatctccgcagtttttgttttactggcttggcgtcgggtcgcaccataagtttgtgctcaatcacctccttggggacccccggcatgtcggacggttgccaagcaaatatgtctgcattgtcacggaggaaggtgatgagcgcaagtttctatttctcgttcagtgatgccccgatcttgactgtcttgtcgaggttggcactagagagtggaacgattttgattgcgctgtcttgtcggcgtcttagttgttttgctcactttcttgggtggctcggctgtggcgggtgggctgggcgtatgctcgaccatgtcgaggctccgcttgtcgcagtggaccgccagctttgcgttcccttgaatagtgattgttcccttcggcccgggcatcttgagtacttgatacgcgtagtgagatgcggccatgaacttcgcgagtgcggttcttccgatgatggcattgtatgctgtgtcaaactcaacaacatcaaatgttatctgctctgtttggaagttgctcatttggccgaaagtcacaggaagcgtgatcttgcccaatggtttggacgaagactggggagtgattccgtggaaaggttgatcggttggtgtcaacttgcttcgtggaatcccctttgcgtccaaggtgctggcgaagagaaggttgatggaactgctgccatcgatgaggactcgcactaccttgatattccgaatagtgggttcgaccacgatcggatatcgtcctaggataacagctaccttggggtggtcctcatctgagaactcgatcttctgtttagaacacttcatcttcggtgcaaccccttgccatgtcgaacaaacctcgcgctccacttttttgtattctcactttgaagagtacgctatggaacctccgaagatgtgcgagacatgaagatcaaaatctgggtacgccgagtccgagtcctgagtggttgcctcagcggccttctcgactacacgtactcgtttgcccttctccaaagccagttgcttttccagcgactttttaaagatgaggcaatcctccagagaatgtctgcccaacttgtgtatggggcaccatattctcttcgtatcattgccttgtaggtctgggtgtttgggagggcgctcgtattcagacgcgaggacttctgcttgagctttccttttcccactcttgccgcttttcttctcgcttgtttcaggttcgtctttggctggcttcttctctcctcccgcctttggcttgtcgttcttgcgtctcagtgcgtcgtccgcatgagcgcatcgatcgacgacctcgaaaaaccttcgagttgttgtgattcgccttgttgccaactcctgggtagtatagcgatctctgacactggttttgaaagcgcgaatcacagaagcgtcggtgatatcggggatcgtatttctgcattcattaaagcgccgaacatagtccctcaaagattcgcccggattctgtgttaatgtgtgtaaatcgtcttcgattgcgtggcgcttgtaagttccttggaagttagcaacgaattgctgccacaaatctgccatgaagaaatcgagtagggtgggaggtgcatcagccacgaacgcgcagaacctttcaactccgttggcaaatagtttgctaacgtgttgtcgtctgccccggcagcgtatagtaccgtggactagacctggaggaattctttagggtcagtactcccattgtacttctctattgctccgggtcacaatctctcatgccatcggacaacacgtagagaattgttgaaagctctacacccggcgctgggggcggtgggttgtcggcgatcgtgtgtcctccgtggatgtctatcggatgacgaggatgaagatgaagactacgatgacgatgggtcacccggctccggtgtccgattccgagggcgatgttcaggttctcgggaattctatcgtcgtccaccattgttgtcctggcgccgatccccattatcatcaccgtcatgtcggcgtcctcgtccagtatcgtccggcgtccgctgttcgcgatcgttgcggtcgcggcggttatgacgattatggtggtgttggtcttcgttcgagcggcctcctcgctcttcgttctcacgacgtcgtgaagagacacgatgtcgggaacgattctcgttgtctcgcgcacgtcgtgcttctcggcggccattcagatggtcgcggagatcgccggtgccgcaaggtggaggagtagctcatctaggtgacgtccgttgctccggtggttcgccatcggcaccgccagctatcggatgttttggttgtgctctagtagtggcctcctcgaacgcgttactaagattggctaccgattcctgtagtcgttctgtccatcgtgcgagatcatcgttaagtacggggtcatagggagcttctctcagtattgcgttgacggtgccaaggtgttgggccggcgtgaccgcctgattctccacctctgcgttagcgtgcgcagacgtgctagtcccacctatggcaaacacgtcgcgtggtgtactggaagatgacgagccatagtcttcgagcaagtgtaggactgatggctcgtgggggtcgatgtcgattactccaacgaatcgatccgaggtcaacgtcgctccttgttctttgtctgtatccttaagagaggttcctgactactagaccttaggatgcgtcgttttcatggcacggagaaagaccttgcagcttgagacttcgtgattcttcgtcttgtgaataggacaatagacatcacgagttggagaagtacgctggattccacgctccttgcaagcatgaatttcagcttgtacgttgagaaaaacccagcaagcttgcaagttgtgcttcctggacttgtggatgggacaccaggactttgttacctcggaagttgtccttgtcagctcatggttcttgtcggaaggacaaggtttggccgcactaggaaccttctcggactcgtatgacgtcgatgttctgttctccgctatggcgggaggatccttcgacacagggtcgtttgaggttatagctacggcgttctcgtttccggtcattgatggaccagccgagattggtaccgtggtgtaaaccgggaaaacaatttcgctgacttgagtccacaccagcattgttgaagtagggactccttgaatggggccggtgttgacgccgttgtcgacaaagcttgatgtcatagtagtagaaccttgagcaccaagttcccgtacctggcgcgccactgtcgacaggggacacccgtagaccggatatagagggtattggggtacgctgctacaaggatctacgtagtacgacatcaaggaaacaggagacaaagattttactggttcaggccccttaataggtaatagccctaatccagtttatatgggattatatggagataaccacaaattacaaagggaataatagaactcgacgataccgacgagatcgtagtcgagttgattcaactagatcacctggcgacttcgctcctgtagactccggctccgtaggctgtggtcattgtgttggctatgagattcgatgccttaggccttctcggggggtcccttttatatcgcaggtcaggtagtccccaagtaggactcggagacatcggacccttcacgatacagtgacgacccagtcctatacgggtagggacatttccattggtggacttcgtgatggattttcgtagtgtatgcagagaacgtccgtacacgcgcagatgtaccatattgccatatagcgtacatccaagggtagagggtataccttatccgtaaccctgacaggaaggatgatatcaaactttaaaatctttaactataagtaagttataaaatatttctcttggaaatatagagacacaaatatagattagcattaaaaagtacttccacaaaataataataataataatagtaacaataataatataatagatgatagtgctcaaagttattatttaaataccgtatccttgtccaaaatgataagtgttattagaaccgaaggaagtagtagatgctactcccttctttctaaattgatcatcatataagtttatacaccaagttcgagaacaatttaaatcacatcaatcaagacaccatgcatacattctcctacaatgcatgcatcgattaaaatctcatgccaattacacctaagtatgcacatattctcccatactgcattaattgtattccgatgaaatccgtgtccatgcagttatataatgatcaatttgagaaattttgaattctattacatgatgatcaatttaggaaggagggagtaatacgttggttagatgaattgacttgcatcaagcagcactagaacggtaaccaccatctcaattgggcacgacgtccatcatagcctagaaatcacaaatataacttcccgcctctcccaggctggaccagtcttttctacacactttgtcttcactcgtgtgcacccaggaagaatttcccgatcggtcacctattctgaaattgcttcaggccaagcacgcttaacattgtagttttttggagatcggttctggagaagaagttgtaacttgttgatatctaacagtggagggacttagaaaaattttcaatcggatctgagaaaccttactcatattatagtcaaacatacatctcaatcaggcataagtatagagcccatcacagatgactcatccgtgacggacattaagtcatctcaatcgagcattagtatagtgcccgtcatagatgagtcatccgtgatgggcgctatactaatgcccccattgagatgacttaatctctatcgggcattaactaaagcccgtcacagatgagtcatcggtgacgggccctatactaatgcccgattgagatgacttaatctctaccaggtattaaatactcatcagtgacagaccctatactaatgctcgattgagatgacttaatctctatcgggcattaaataatgcccgtcactgatgattatttttctattttccatatgaaatgtttatattgggctgcagga

SEQ ID NO: 69151 - DNA, 60172 bp, Oryza sativa
aaatgctagaatgacttacactgtgaaacagagggagtagtactgtagtcctaatacactaaaagataccatccaagtaaaagttggagttatggtttaaaagataccataagaacagatacgcatgaccacatgcaagttagatgatcaattatcatgacagatcagaccttcatgcttcattgaagtccattcagaacatatcaggatgttaaagacttgtataaaagaaaggttacactagaccaccagtacaatactccctccattccaaattgatctacatatttcataggtacaccaagaccaagaaaaactaataactctctcatactatatttactctagcaacaaactcaatgcatgcaccatccccactatttcctagccaataggaaatcaagatattgcatgtgggttataaatacttgtatgcatggatgcatgcatcaatgtccatttactccaatgcacaaataacgaatagacttaatgaatgaacacaaatatgtagatcatttaggaataacctcaaaaaaactatatgtagatcaatttggaatggagggagtagttgttaaaaggccaactccctaaatcgttggtcggcattcaaaggaactcggttaatccctaaggcatgcaaataataatatgaagtatcacaactagaaaaaataatttaaacacaataagagattgaacacattcctgctatcatgattagaacataacaggactgaaaactgacaaggacaacaccctggaagtatcatgcagccactgtattttataatctgtagatgtatacaacaaggtcgttgcagggtaaattgaatgccatttttttcatgaataagatctgcctctttcatcttttggcacaacatgtttacttgtatggtgataagagtacaaggactttactttggtccaacggctagtagaggttatgtctttactttctcgaagcattgatttgaactcagctatcacagcattgcgcactgattgaactttctcttcaatcgatttcaccctgtggaaaattggaaatgcgtcaagtatagtacatgaactaatatgatttaaaaattgatattcaaaaatgttaatagaagggtgtgcatacttctcgttgaaaagagcatccctttcttttcggtccaaggcttcaaaccttggatcagtgccccattttcttttgaattccttgtaatccttattggagttgatgtcctgcattttatgtattaagatggtatgaccctaaaaaaaaagcaagtatacaggacagaaaactggatccatttggcaattatcgcacatcaaagtaagttcatgtgaaaaactcaaacaacttttcagaaagtatcaataacgaacctcggatgcttcttctagtaactgtttatacgcctccactgcagctctctgagcagctcttttctctttccgctcctcgtcagcacgtgtccgaacatactgctcaaatgtagaccgtctcctcgagtgacttggaatagcctgtgacggacaatctagtataaacatcatattactaaactaaggaaaaagtctacttaacacctagggcatgtttggaaaaagggttaggaaaatgttatcccaccctccaaaggacaggatataatctctaccatcaattcatctcacctcagtttatcccaacccttcattcatttctatttcccaatcccaccctccaccctaaagcataaaactacatattatgcatttgtgcctcctgaacaatgcaaaatgctgaactgtttaaataactgctagtgtggttttgaaggtagtttggccacatgacctgtgtggcatggagtggttttgaccatagtcgctgaggcaccgcttagatgttaaggaaaattcagggatcaaggcatccctccaccttgtgggcacaaccaggggagagagagagagagcagaggagaaggcaacatagacagtagtgcatccatcctaatgtggatttgttctaccatcctccccaccgcctcaccgccagtgaccttgctgtcttagcatcgcccaatccagcccatcatcctcatcctattgccaagtttagtgttccattgcttagcaccgatttactcctctcccttcccttctgctctgcctttgatatagtgccatgacaccattgctgctcgttgttgtggcagctaggttagaagacacaggggagccaggctaggaggctgcgggagtgggaaaggataacatgtggactggtttggtgctttacatgggctgttaggtttgagccttagtgtgtaatgtgttgtttatagcccatattttttatcttttcttcttttcagctgtgtataaggtatggccttgtcttacgtgttgccttgccttcaccttaccacttaggctgtaaggcggtgactttgcctcaccttatcaccttagcagccatggttttgacaaataagagatgatatctgccttcctcgcaaactcagcaactaaaaatatttcaattagttctcatgccactctcggaacccccatgaatgttttgcatggcaaaataatcttaactgtataacacatggaccttgattaaaaaaaaaattagccttaagtgatggctatgtgtcagccatgtcactcgccaggtggcaaaactaccttcaaaaccacggcatcttaggggttatttagatcattttgagtttagggagtaaaatgcttcgttttatactgaagggggccaagtagaccctgtcctataatttataggattagcagtttagcactgccactgtataaaggtacgacacagcagtaggccaataaaagtaaagtatatttactaaacactataaaaaatgaagtgttactgtgtaagcatttagttcttctaagtaggacacatcaaatacatagtccagtttttttttcctaatcggctggaattttgaagtctcataaatcaaatgaatgtgcgttatgttttttcccaaatttcctgaacaaaagttaacaggcatctatgtacaacttactaagatcaagataatacatcctatacgagtaacaaaggtaaataatcaaccaccagaaactgcacatgacatcatgcattacaggtgaaaaatgtttccgacacccaaggtaaccatagcataattttacaacaggtcaacagcataagtgatagtatgccaagtcataggcaacgctaagaaaaaaaattaacaagtctacaaaactgtacaaaatgccaagaaaaacaaaccttaaaacgtggatcaaacactatttttgggagttccttttcccactttgaaaatggcaatacacctctttcctttaacatctcctgtgaaattaaaaaactcatttaggtcatgcaatccattcgtcaaaaaatcagctagttctattcatgatttcatatagaactgaggcacagctatcctaattatccaactacacaaaatagaaaaccaaaagctgtctaagaaaattataaagcaaaccgtaaattgcagaccactacaaaacagtaatgaccaaacagaactaatgtaaagtgataacatggaaaatttcaatgacaaacaaaaggctcagtcagaagtgaaaataccaccttaaactgacgagtacactcctcttcacttgggccatgttcctcatcatctgaatttgaagaggaatctgacatattaccatcaccactgttatcttttgatttctcgccgctaattgagacttgatgtcccataggtgcagcatcagttgttttagacccattcagctcggatgcactagatggagtagcaagaggtgaaggcacactggaagcgccagcatcctgcaatttcttctttattaaatccaaagcagaagacgatgcaggggcaactgtttgtcgaagtggcaacgaatcacggccacctgtctgtacagcaggagtatcaatatcaatacttatttcctctttattccctatcgtgccagcatcttgcagcgaagttgaacttcctttcaatggaccagactcggcattcttgatgagctcagccacctctggtggaagctgccagctgctaacctgttcagttttagaaatgagttatatacttatatataagttcttgtgaagtcgtggcattgaaatacctacatagacattcaatattgagattatgtcataatataggccttacctttagcttattatcatagtaatatttctttccatcacttgtcgttactatgctccagtcagtgccagccagtttgtccctgtcgaagtgaggtgtttaatttttcatgtggcacgaaatttatgagcaagaacagaataacagatcaagacatttatatgggtaaagagggaaagagcaaaagccaaaaataatagcagcattcataaatattgcaacttctactttttgaaaaacatcacagacctgtttgagaaagctcaattctagattttttttttctttagctaattaaggaaacatgcaaatttattcatcaacttggtgccatatgagaacattaatgaatgaactactagaaggctttgagcaacaaaatatcattcatatatgctcgaaatgaaaaaatgatctcacatagtatcattctgcataattagacttattttgaacacaatgagaacatatgtggtcaagtaacttagaaagcggctaacctacaggaaattcccgaccattccgcctatcgttttgttttgtacagactatgaaaaggaaactaccagtataccattttcatccataattctggaaaaatacggtatagttctgacaacccatcagaataaaatataccttagcctaaacccttgtgcatcatcatggcatattttaaattacttacacccttctttgaatgttcaacaacaattgcaagtgatgcgaatttataatgtaaacatactgtgatttgcttgccaatagttatattccaatagttccaatgttgttttgatttccatctctatgttttcaattccgttttcaagaaaaatatggttctggaaacgatttttccaaccattctcgtccctagttgcatgagcatgatgacatttgtggcctataaagtatttgttaaacaagcaccatagatatacaactaatcagccgctacacttatcaaggcctagttcggtagagcaactagttgtggcaacttcctcgttttctgttagtcccaaactgctaaacggtgtgttttgtgcaaaaaaattcaatatagaagtttttcacaaaaatcaaataaatccatttttcaaatttacaatggttaacacttaattaataatgtgcattagatctgccccgttttcttagcagtcatcagctccagccaaactgttgggacaaactaagcctaaataatgagtaccaagcatgttaggtagtcttgcagtcaacaccattttcagtttcagaaataccaaattaaagcaagatttatagtagtttcaaaaatgcaagataatgttagatctttttctttttttaaaaaaaagtaaagctttagggatttcttgtcttactatccatgtcaaacatgaattttgctaactttttggctattgtgcaggttaccagaaatcatgtaacaatgtcaccaaaatcggttgtcccaaataagttgtagcactcctaattgtgtggaaaacagaaaccaatttcaaaaggtgacttaaccagttacaaccctcacaagagaatatataatttctgttataaaatctgttaaagatagcaaagaatataggaagttctcacactaacgtaccaagaaactggaactggctgggctgcgaccttctcaggctgcaggaaaacgaatgaaataaattagttaaattgtgatgctaaattgctatgccgtagactagaattaagtcatattacttgatacagctattcctctgtgcaactacctcccctttataaccaggtggtttttgataagttgattctccagtcaaggcattgtaataatatacaacaccagcctctgtcttgtgtgcagaccatgaatctgaatcctgaatggcagtagttcttttgtcctcgagctgatcgctgttttggcttccctgttctgcagcatacaaaagatcacaagaattaactggaccactaatactgatcatcaaattaagtaaaactgtcccagttgatgaaagttaagctaacgcacgagtgggctgctcagatccaggatttgctgatgatagctccttggaatccctgtcagttgttgagacaccgggtggttgtatgcttggcaagtatgcagtcacagaagaactcccaaccatcggcctaccaagaggccctagaagaccagatgggtatgattggaaggggggttgctgaaaaccagtaggctgtgggggatatccccatagaggctgaggttgaaccccatgtgctgaaggataggaggggtacaactgttgctgaccaggctgttgaaaagcagttggagactgcgatgtttggggaaaaggagaagcagatggagtcataggtctcccaaggaggcttggtggagcagacaagattgtggaaggttgtccaggtacagaagcaccaatggccccaaaaacctccgggcgagttggaagtgatggatttgttggcatctgaacagtgattgaaggacttccagcagtacttgttgatggtgggcctgtcgacaactgcatggtctggggactagcctctgggacacttcgagtatcagacctggaagtgctaacatctgagctcccctgtaataattcaaaattattagtaaattgatcattataacccacgcatataaaagaaagttggtcgaagcatatacactgtttgaaggtaactgagatgcctggggctgtgcctgttgtgggcttgcaacaaaagtattgatggatggtctgggtggacctggaaatggcaagcgaatagatccaggaggatttggtggcatagctcctgctcctggaaatgctgaacttgggcgagctaaattcataggagctggaggttgcaaggatgatggtggaacaaaccgtgaaacttggacagcatggtttgtgccctggaagaaaagaaagcatcaacagtcagtcagtgagtcagagaagaggattcagatcattaagtaaaatggacaaataaaaatgttcaatattaatgctagcaataaagacatgaggaattacggtgtcaagttgaaactgctgaccagtaggcaagccagcattagcatgcgagactacattatatgaaaaagacggcctgttcccaaaatattgccctgggacaggaggctgaagagctgcagcagccactgaaggagccatcatggcctggaaggaaaagagaagacgaaagtttcacatggggggattccactctgacaagtaaagccatcatatggtacattaatccaacttaactttgttgagttgtttgctatgattgaataaaacaggaacaacaatagtcctctatttatatgtgttttgttattttatatgaattgtactccctccgtttcataatgtaagactttctagcattgtccacattcatgtagatgttaatgaatctagacacatatatgtttggatttattaatatctatatgaatgtggacaatgctagaatgacttacattatgaaatggaggaagtaccagattatgctgagacattaaagagccatgtaacttctgctgcataaacagctttcaggtgaccaattatgatgaactgattactaacagttttgtgaccaattttggttatatatcgatatgaaaggttcaacagttttgtgtgcaagaacttatcagcttaataacatttcacatgagaagagaaagactaatctcacaacattttgtatcagagcaaaacgtaagcaggcatgtttatcatcagatcaagataaaagcagagtaaaatgagaacaaaaattataaacacaactcgtactgctgctgcgtatatctaaacaagaaatttcttcagataaagtatgagctagccatcggctactgaagctaaacaggagttaacaaaatctgatatgaatcttcaccgccactaggaactataaatgctgcaatgtgttgatcagcaaattaaacggcagctgatatcaacttttgaagcccacaagagttcatagggaatctataaagcagaaattctcattttctgcagttgtatacaaataatagcactaattaacgcaacagtaagtcaccgctcataatctgagctgaacaccacaaattggtcccaacaacgctatataacattgcttctcattcccaaggaaaaaaataaaacgacatttcgtgcagttaaggtgaaaacaaaaaggtatggagtataatataattgcgatgtgaagcatagagggtgcacgataccctaccggaggggaagctagctgctgctgggccgcaccactgcccacctgcggccggggtgacggcctcggaagaacgttgtacgagaacgccggcgccggggggctcgcgtaagcgggcgacccggcgaactgcggccgcgggggccctggagttgcaggagacgccggattcgccggcatagacggcgccgcaggaccggagccggaggtaggagcgggagcggccggggcgtctccctccaccgcactatccaccaccgccggtgtcgttgccgccgcgacgacgccggaatcgaacggtccttccgattccgacgccggggcagcggacggcacttccgccgcctccgggttggtcgcgtcggaggcggccgtcgccggcgtcgccatgggagaggaggagtcggggggcaaggcctagggtttttgcggcctaggcgagcggagccggatgttgcgagaggggagcagtaaccggagcgagcggccgaattgagaattgggggatgcacgagcgttgacacgtgggccgtgggctggatctgggccgtgggctgtaatgggcgtcaactcgtagtttggccttggttttactcatgaaaaatttatgattaatcatatcttactatataaagttgatgtctaccaatctttaaaagctcaacatgtaagtgtgccacatcattacccactgataattattatctagagtattttaaatcacatgcaagcatgtcacatcatcatccactagcaattactccctccgcctcataatataagggattttagaggtatgtgagactatattatgggatggagggagtattatatatttcctccgtttcataatgtaagtcattctatcattttcatatttatattgatgttaataaatctagacatgtatctatttagattcataacatcaatataaatgtgggaaatgatataataacttacattgtgaaacagagggagtagagtattttaaatatcacgcaaatatgatataccatttatatatttttagaactcaatagacaattaatgtcaaatcattatctccacgtcattttcacattatttaagcatgtacatataccatttctataatatacaacatgcatccattcatatatcccgcgcataactcaaggtataaactagttaattattagggcatgtacaaagatgcttattaacggattctctccgttgccatgcagagtaattttggttgccatgcagagtaattttggtaacatagagaagagaaaggggaggaaagagaaacatgattgctacgcacgataatagctcagagtcaactattagcatttattaaagaaatttttgttgtatcaggtggataaaaggaaagaagagtaataaaaaaatatttatgtgcattaatgcgaaggttaagagattttgttgtctcaactattgcaggaaaatagtctctaagtgagtatgtattaactaagagctcatatcagagtatacctttgtacatgcccagttccacaaagaaacgattgtgtacagcaacagtcttaaaacaattgtatacagtaacagtgaaaaaatactgcatactgtggattcagtagtagaaatatcaaaactgtatgcaatgttgtcttttctaatccacaaagaaagcagtacagttcagtagtagaaatatcaaaactgttagtgtaatgctgtcttgtctgatccaaaaaaaaaaagagtgcagtacaacgtcatattgcagtgtcagcatgtatgtgcatggaacacttgcaattcgggaaccctcaaaactctagtctattctctaaaaatagaagaggaatgccctaattaattctctggccagaccaaatgctcgataggctcttcactcacttgccaagctccttcagatagttcatcaaatagttgactgtattcccagttcgagaacccaaggaaaaaccacaggttctcagcagattgctcccctgatttgattcgtctggtgacctgggctgtggcggctacgtttccataatacacaccgggtataacctgcaagtacccatcgaaggctactctggaaaggctcacaaggtaatagccctgcaccacaacaggtccgccgtagaaaagcggggcgtgcttgatcggctccatggagccgtccagattcttgaaggtgtcccagcttaagcgcttgttgatgatcaagccatgaaagccctcacgagagtcagcggatacgatgagcacctgggagttgtcaaatggaacggcagacccgagcttcgaagttgcagtgagcacggaacctgtgaggacacgtgcctcgttcctctctgaatgacttggtgaatgggaaccaacatcgttgctgattttgtcgctgttatcaaactgaattgcctgtggtgcatcaccttgcacgaccgttttcttcttccacagaaatcctgcgagccaaaaagagcgcaggcattagaatattccttcatcacagtgatagtggacagtgaaaacactttcttattaatctttggtgcaacatttgggaatgcccaggtcagctgcgaacggttggtttatatatgaaatgtgaacaatataaaggaattgagaaattagaataacaatgtcagaaaatatcaaagccattagtcacatggtggttcaatcaagcagaccactgttcacgtcgcattccctggggttttcagcacttctaacaaggtagtctaccatcaagcagctacccagccaagacactaatatacatcgtatgctagccaacaaaaagacagtggagtggacacttttgagagtggcaacaacagcgcatcctgtagtaacaaacactactatagtaagacaacatatatcatcgtactaggttcatttattttttaaaatttatgagttatgagatttttgcactaacctttatattccaacaggtggggtgaattgctagcatgagactccaagaattcaaataaattagaaactgaaattcctctttcatatgatattgcacttttgttctctgccggaaaaaacaacaatgtgggataacgctcctcctgtgaacacatgaaggttacattagtattgtcaatataagcacttcaatacaaaaatggtaaggtgaagcaaggcccttcagtaccaaaaaaatagaatagattcataagtatatttaattagatggaccatctatttatttttaattcaagcttcagtactgctgaacagaactatggtcattataacatctccaacagtctaatgacaaggtcattcttaagactcaaatgatgagactttaatagtttaatcagtccaaataaaccaaaacatacttcttgaatgactgttgccgataccggtacatttattacgaacaatgaaatgagactatttcggggtaaacaacagcaataagtatggagaacttctatctttttttttattagtcaggagacagagcaaacttcaataaatggcaaatatttgattaccttgccaactgatttcagtaaatgatggcattcatttgatgtgcagtctattagataaatagctggaaaacccttcatggtagattcttcttctttctctgcaaccaaaaagatgattcatcagtgccacaggtaattcacgtttgaagtgccgtaccatataaacggtgagctccaacaggctatagggttatcttactatggtgtgacacatgtatgattatatataggaaatgcattgcatagtgctgcctaaaagtttgctagcatatgttgcattacattctggtatgatataatttgattgacgggatgatcctaaaattcgaactaaacaaagctaaatagcaggaaattttaaatatttctgagactaagtttaatctaagttctcagcatgatattggtgaatatgttattaccttcaatctgcaagtcttgagcctgtaaaaattgagaatttgaactcaaaaagttcttgaatgatcgatatacctcacggacaacaagctctgttcgctggcaaaatccgcaccaagagttgctgaaaagcaccaatacatccttcttccaagcagatgaaatattttcagtgtttgaaaacggcagttcactttttgaaacacaaccttcaaatccaaagaccaacatacaaaaattacttgttgtcaactgggggatggaatctgcctcgtggaaatcacggttaataaaaggtggtctcagaagctccttcgaacttatgacagataaggctgaacgataatatggagatagacttcgattcataaaatggtcgagaaaatttgctaaagaagggtaggtaaattcaatctcatctggaaagacataatgcttttgctgaattgggtcaattattacaagggatggcattctcgatccaccagttaaagtttgcagaagcctataaccaccatcagagaagaagagtgaacccgcaaaatgttcatcaggtatacttggagtttcctgctctgtataatatgtgttatcgcccacaaggctactggaagagcttaatgctgcatgcacaggatatttgctatcactttcttctgatccttcatctagaataaataggttatcctcataaatggcatcctcaattcttcgagattcttgacccaggactgaaaacacagcatcttgctgatttgctgatcctgacttctgttggttaaaattcacatttgtcccatcgggttccaaaatgtctaaagcttctctaactgtttcctcatctttgtgtttgtgtaatatatgaccaacttcattgctggaatgcacatcagtggagacctcttcctgaagatcagcacttgtatctgaagcctcagttttatgttcttgttcctccatttttgtatcactacagtcaagatcttctttattgatcttacagaaatttttaggagcattgctactgtgcacatcaacagaaatatcttcctgcagatcaaggcttacatctgaggcctttgttttgtgttcttcctccacttctgtatcactggattcaagatgtttttcattgttatcacagtaatttgcaggacctttctcaagtttaatgggtgcttgtctatcattgatatattcagcttctgttgccctgttttcatgaacagaatcttcagtgtaatcatcattaccaccgtctgaactggcacatgacccttcatttctttcaagttgactatctcgaattgacagagattccaccacttggacttcagaatcatcagacagcttctttatggcaacatcttttgcaacaaaacttatctttgttttctttgacctatgtgctggtcttgttttgtgtatcagttttgttagaatatcatataatggattatcggtactaccttggctatcacttctgtacgaaatactttctccatcattgaccaccattactgacattttctccccaatttccattaatttggaggcccaatcattcagcctagttcgttcagtatgggcagatctacctgtgctaactagggaaggaacagctttagagctcattctggatttaccactagttagaccaccagtactgaaatgagatggataatttttctgcacatattcccttagtagtttgagggatagtttgctttcatctctgacttttgaagaatctgacaatctatcaataaatagaatagccgatgatctacttgcaggaaaggtagcgataccacttgcatcaatatccatctacacatatagcatgcaactcgaaaggtcactggataggtcattacagaaagaaagaagaaactcatagaatgcatccaggacatgtcatttctatataatacaacattatgtcatcaagataattgcatacttctaatatatgaacagaagtattctctttatgtgcagcccaagaaaatttttcaagaagagcaacacatttgcaaagagagaaacatggttcaaaggatttgaattggtaagcttggaatagaatataaatgcaagcagctatgagctatcttcttagtccattttcaaccaatatcgaatagagttgtaagaaaagtaataaggatatgcacattgttatatctgtcactcagttacatgacagttgtcagttgacaactttttatggaaagaagttatgaaattgtttttcacctacctcgttaatgttaagattatgataagattgcagtaggcttcttaggtcatcaccttcttttgcaacaattgaacaattggtgcaccccagataatgaacactgaggaaccatgtctccgaattgccttcattgataaactctgatgaaggtaatgatgatctttcagttataaggccaaatctaactttctctggaggaagaaaataatctcttgatagagcagtaagctttgcatagaaactttcaaactgttgaagcttttccgctgtacacaactttctattttcatcagttgtaatcccattttgatctgacatgcttccgtttgctaaggtaaatccacctttccaaggagagccagcaagctgaaccccacctccaaaaatcagttcttcatcctctataacctgttttcatctcaaataagtatattttcagggatgtttctcctggtatttgctgaatcttcgtagttcagatagatatttcatatttcttctcaaagaaattagcagtgtaattaatcagagataaatgtgatcctctttgctacacttacaagctctagtggcccatccgattctcctgttagtgccttcccagaaatgtcaactgtatgataagtgatacaaatgagcatagcatgcacatgctggaatggagtggaaccattatcatttattcaaaagttaaatgataaaggtcatggagcaagtcatgcttgaaatggattgagagttaaagattaaagtagatcaatttgaacgaattcataaaaggagaaaacaaaccaaatactccttggagccccacatgaggatacttttaccatcttataccatatttgcaccccctgactcctggcttttgtggtcttataagttgcatgtgcatttggtatattaaattatttagtaataattaacttaagtcagaatagaataaccaaactaggccatttatttcttttagaaagggaaaaaatcgtgcccactcatgttcagggaaagaactacttgacctactgcggctatcaaacacaatcttaacaaagcccctaaaaaatatagcagcgagagaatacgtaatagttaaatgaatcataaagagtggatcagaattgacgaaccattttctgtgtgatttttggatgaagtgccctcggttctgttgctcccaccatgagccaatttggaaaaccacccacagaattcagatagaactacagctttgtcagttgattcaacaaaagcctccacatcttccttcgtatgcaaaaccacaaatggggcctctgcatgcttgagtgacataatatagtggactgaagacaatatctcacgtgcacgaagcttcccttcatatttgaatggcaacgagcgttggtagtatatgaactttattccttctgtggcaccaagtacatccgttagcaacttctcagaatttctgtacacagccatcaacttgagatgcccgagctcctgctcatcggcagcaaccaaaagttctatctcggccatcagtgatcttgactcgccataccctacagattatcataaacaaaaacagtagaagtaaggactttgcgcgcaaaaagatcccatacaagcctttttcctttgctggatactatgaactcgctgtaatacaaatgttcgcccgggtctttgggggtaaaatgttgcattttcatagaattaaattcgcaattatgagagcgtttagcttaaattcgcatttatgagagcatttaacttattaaactacgcagagctgactcaaaactcaaaagggaataaagcatatattaacagaagtgtaggatcttacaacggttgagcatttcagactacaaaattgtcgcggtttccgtaatcaatcaactcagcagaagtacagaacaaaatgtgttcctagtcccttatcgtttatataattcgacacatggagattcacatttccgctaagagagaaaaactcagctctccaaattaaccgcatagtgcgaccacgcgactcatcggagaaccagagctctcgactaggaacggatagggggtgctcacatggcatggtgacgacgagcaggatgtgggggtgaagccggatctgggaggagaagttggccctggtcaggacctgccattccgcgcgcccggaggcggcggcaccggagctcgccgccgccgctgtcgcagatgcccccagctgcgacgccgcgaggagggagaggaggagcggcaacgccgcgccgaggagggggaggcgcatggcgggcggccgtccgtcctcgcgcgcggcgggggagttgtgtagtagcgcgagcgccacccccgccgtaggagcccacgactttcgtctcgtgtcgtgggtcgcgggctcgcgaagaggggctcgacccgaccgctggagttcgcggggcgatactctgctgtgtgcccctgccgtcgaaggtccccccccgagttacgaaatcatcccaaaacgagatataaggccaaaacttcaactttttcatcacatcaaaacttttctacatacataaactttaaacttttccgtcacattgttccaatttcaaccaaatttttaattttaacgtgaactaaatacaaccaattaaaactggtcacaatagatccttaagtagttttgaccccggttttatcctacgtagtggctgagttagcgtgggacccacgtgggtcccacatgtcaaagtgaaagtgtcgtttttgtgagtttgttagattggcggcgatgctgcggaggatggtgttcgatccggacggcgccgccagcggggaggtggggagggttcgaggcggcggtggcgcgacgctgttcgccgtgccaaggttgtgtttgttgggctggctgcgaagcgcggggtggcggatggcggggaaccggcgttgaggagcccaacgtcgctgttggaccccaaggcactcctgctccggtcgccgcggtcgccgaagacgtggtatgacgtttctacccctcatatgccatgaattctacttgtacttgtgaggggtagaaacgtcatatcgcatgcgtggctgggtcaatagcgatcgaggtggacggaaaaacgatcggaaattgacagaagtgttaaaaataggaacggggtgaactttgagtgctattaaagtgaaccggtatcttttggtgctataaaatcgaaaacgtaaacttttgatgctatataaccaattttcctaaatatttatgagtggggggacacttcttacaattagttttttttcttcatgtgccattccaatctccaaccgaagaaatccaagaataagcccatgcttaaatcgaaagtcttaagaggcaatcgatcgctctaagagatcggtccccctccccacgttgatcacccccttctccatgtggtttcctttttggcacagtattactttcctattttagtaaatttatacaccttaaatttacgcatctaaagtttagagacccatagtttacaagtcaaaagtttatatatccgattcaaaattgaatttgaattcaaatattttttatatatagtatttctatacatctaaagtttataagtcaaaagtttacatacccgattcaaatttgaatttgaattcatatattttttatatatagtatttctatacatctaaagtttatacacctaaagtttatagacccaaagtttataagtcaaaagtttacatacctgattcaaatttgaatttgaattcaaatatgagtttatagacccaaagtttataagtcaaaagtttacatacccgtttcaaattttaatttaaattcaaatattttttatatatagtatttctatacataaatttttctaactttattttttattatttttttaaaaaaatttatggtgtagtaggaatagaagaaggagaggaggaaaaggggaaagagagcgtaagggggatggggatcgatcgcctattagccacaccctgctaaaatgcaccaataagtgtgtaggttagttttttttaacagtatgttagtatttgaactatgataaaaatagagttatgcaaattaaattttggttgtttggattgaagctaattttatcaaatgagaatgttggcaactttaatagaaccacttagatgattgatttactaccactttttatccccattggttatctattaaccgattggttaagttgaatcataccacgtttggaagtgttaacacttgcggttttggccctaccaaagttttatagggtggaaaattgatatggattttttactttttatcttcttagaaaacttattctaaaactagacaaaaaaaacttattatagaaatgatctttttcatggcgccaatatcattgacgcgtggtccaacatgacggcgtcatcccctagccccgatgaaagctaagtcaactaatttgaaggggaggacatatttgcattttttgaaaaaggtcatatttgtaataaaaaatatttacaaataagtcctcggcgacaatgtcattggcacacaaatagatcctcagcgcaaggatattaacgtcgttcctcttcatgttagtgacttagctttcacccaggggcgagggaaataacgccaacgccattggtgttgtcacgttgcactgctcaacgttgatgcccatttattaagcatttgtcaagttgattcgtaccatccatgaaaggtcgtgtgtttcgcgaacgatgaaaggttgtgttgtttagcaagaatcatcttgcttatgttgcttgtgaatgtccattgcgattgaaatacgacgaaagatgagttggttggttttacttcatttgtttcacactgtgcgctgaatatatgtggaacagagtgagtaaacatggatacatcacgatgataaaattgataatgataacatcaaagagatggataaaggttgtctcatgattgttcaatctcgaagagagctttaagccatgtgatcgacattcgtcaggtcaagtgatggagtgctcgagaggattcagggaagcaaaagctttcatccacgtgttcgagggttcttcatgtgtcagttgatgtgtaagtcaacaaacagtacatcacaccacattgcatagagcgagaaggtcccacatatcatctcactccataacatttcttacacgtgggccctacttgcacacgtaccccctccttgcagacagtcagacaccacaagccatcgtccggtgtgctgcacccacgccgttggcgccgaaccttttctcgtggccccccgcgtttccgacgacccaagcaaggtattccaaaaaagagagaaaaaaaaaacaacaaaaatcgcacgccgcagaaacccccacagccacgaacgcacgggcccaaagccccaaagcacaggtgtccggtggtggggcccacctgtcatggtctcccccgtcacagatcccctcctgctctccccgcccgcgacttcgcgactcttatcatctcttcccctcttttcgttccaatccacaggaggagaggcgaggagaggagagcgaaggagcagaggcgaagcacgagtccaatccaaacccgaaaaattcgcgtggcggccaagccatcgacgcgagcgaaacgcacgagcgcgtcgcctccgcctccgccgcgcctcgccatggcggcggccgtctccacggcgccgcgcgcgccgctccccgccggagccgtgtcgtcctcctgctgctggtagtcgtcctcctccgcgtcgatgtcgcgaaggtgggatccgagcccgaaccctagcagcgacagcggcagcaggttgttcctcgcggcgcggcgcggggagcggctgcgcgtgcgccggcttgcgggcgccgcgcccgcaccggcaccacgccgccgcgtttcgtccgtggtgcggttcgacggcggtgaaagcggcgtgcggagccccgacgacgcggacgccggcagcggcgatcggcggaggggctgggacgcgctgttccacgacgcgttccagggcgccgtgcggcggtggagcgagtacgtcggcagccactggcccttggcgcctgccgggaaggatgctgggctcgggaagagggttgagagtcgtcgcgaagagcaggttaggggcgaggtggaggaggaagaggggaagtggagctgggagaggtggaagcagcacttcgcgctaatcgaagagagcgagcgcctcgtcgatgagctgcaggtatatctctcgcacggagattaattcaatcaattcatgtcatttacaaatcacgtgctcttaaccataagtttcaaatttgttgattccagcagaaaatttacgtttttatgtaacatcgagctccagacgtgtacttgtagaaatgcatctgtttaattcctggaccaatatccggctccgtcggttggcttattctaggaataagccaaacggcatatttacaaatggaaaataatttgtgaataaaacttttatatacgtactcttagcgacctaaaagcaaagtctgaaaaataaacttcgatgaaaaaaacctcaaaatcaacttcaaatttaaagttgaaaattcaaattttggccgataagcataagcataagcataagcaaaaagatggggctgagcatgtgtgactgtggactggtcgtggattttgttcatctggaaactaccgtgaattaaacttagttataggagggtgtgctggtggacttcacgatggtatcgatatttctatttgctgtccatgttatctacaagtaacctgaggaaccttagcatagtgtaaacaatatgtccctagaggcttgcattatggaagctaaagccttcttttgttaaggctatatggtttgatgtgctcagaaaatgtgctttgtactgtgagttagactttgtatgtaggcaaagtagacaagttcccgttctccttatgctgaacatagccttacaagtttcctctggagctactattaagttgcataattcaacattgaccattactgaagctaatccattccaatatcaggaagagagccagttacaaacttatctcctcagttcagtggtgcttatacattttaaatgtctgacaatttagttttaaattgtcaaacatgacagtttggtgatatctagaattgtttgaaaccaagtactccctccgtcccaaaatatagcgacttaggactggatgggacatatcctagtacaacgaatctggacattgctatattttgggatggagggagtctgttagatgcataatatctggatataacggtataacctcctcaaacatagcagatggaacttagttgtgtatgaggcagattcaccatatcaattgtgtgcttttgttcatacatgtttttctccccaatgtttttgtgttacaccatcacatatttcctgattgttgtatattgcatttcagctacaactacggactgctgtttatagagaggacttcaggagtgctcacaaactgaagttggctattgcggctacatcaaaaaacgatactgtgggcagagcaatttctgacttaaatgtaaggagtatctcttttttaattgcataaacagcaaatggcacttttgatctttgctaaaatggtgcacagttgatcctatacaagcttataagaggactaatggctagcactattgttgatttgatggaaaataataaataataactaacaagtttggtactagctgaaataaccaatttatggaagaacaacgtagtcttgcaccccaaatttccccaagctaacatatttgtacccactgtattattcagcaaaagatgtctaacttctactgataacagaaggatgtaaataaattgcttttgtaggtagagcaatgaatccaaattattttccatggccaaaatagtgggaacatatttgataattacaagataattgaaactcttttctaatctttttggcatgcagagtgcaatagaagaggagcgctacatggatgcaacttatattagagatcatgctggcgcaggattggttagtatcgcaaagtttttacttatgtttcttttgtatcgctatattatatgcatgcaattatgaaatacctattatgtacctgttgccattcgagttaataattctggaccaggtattagagagaaaacagaccagtaaatcagaataggtacaatggattcaagttaatttagctcaactgctcaagcattagcctgagaggttcctattcatttaaaattattatatgtaaccatttcgagtcatttctagcattctagcaatggcttgctgtatgtacactaaatctactagcaaaatgcccaagctttgctacaggacagaagaaaaaaatcataatatgtcatagctaaatatttttttattcaaatatcttagtatcacttgtttgaaccaaatgttggactattccactatattagaaaatatcagggggaaatttgtaaaaactgcaaaaacaatggcagattcactgccaccatcactagaggcttttaaaaagagtatagatgtttccctgttattacagcataagaataacaatttgattcctctcgtgttttaagcaagcaagcatgataattaaattatatttcaagcaaaatttgaccattttagttacttatcctgacggtggcattaaggctcatactatacatataataataattttaaatgaatggtttagaggttgtgcaagtccacactgtattttctactttgatgtcttgtggcctatgttgtttgtctggtgaatgccacagttagaacttgtttgagaccgagcatggcacctatgctcgatcaggagaatctatcctcaggctcctcaagacctgaaccacttctgtttttagaatgcgtggtgtgatgaggaaggaataataataaacataaaatataagtgtgctgttatgaaggttcagctgtatgcatgtagtatttaagtgttctgtaagtgttctatttttttgcccttatgttctgtagtgcatgcttatccatttctatgttttctttttcttctttccatctgcacaaaagaatgccatcaactgatcctttaaagcacctgcagttgggatggtggtctgggatttctggaaatttgtctgatccatatggtcttataattcgtataagtgctgaacatggtcgatatgtggcgaaaagttacgataccaggtaatagttgtcattttttatcattattatctgcattcttaattacatgtccgatacgaggataactgcctcatgggcaatttagttttttcacctgttctattacagaggcattttcagtcaagatttttgtgcatccgtgttcacgttgtgttcatgaaacagttgggattcttgtttcattccattatgattatcccattgttgatgggaagaaaatccaatagggtatgaagggttagctaatagctactaacgaatgcttgcattgatcaagctgatgccatcatggaaatggttgcatattagcattgataaaatatttgctctacttgctagttgagcctttaattttctcttgttcaggcagctgaattcagatggccctggtttccccatatttgaaatttactttgctgaggccaatggagggtacaatctgcaggtgcgctaaattaaattccaatgaaaaaaatatgcctggaatcataggaatagttctttttgttaccaattgaataagttgaacacgcatttattgttttttcatgcactccctgtaaactcacaatgacatcctttatttctttaatgtggaaattacattataaatatggtaaaggctgagtcttctctctaaaaaaatggtaatggcatctggaagtgtcatattgacctgcatttttctacattttgaataaggaattcactcacctttaggaaatatagtaatagatgaatgcacatcatcaaaggaaaaaaaagagaaaagattgcatgtccacctaggctatcccaaatttgcttttttaaagaaacatcagggcactcccctattccatttttcattacagtggaacaatgatattttaatatttcacatggaaaattatgatttccttttatagttacaaccattgtggttacaaatcctgtatttgcatttttttatatatttgagccaacagttccttttataccaacattattgagctttagtttttttcctcttgatcacaaattagcagattatggcacaaatccttttctttttgtgaagtaccaaaatacagtgtacattgaagttgaacatcacaaatattataacctacaaatgggtttgacatgcatggttatatgacttctctatttggtgtaattttgatagaaataactgacatctttttttaatctaataacctgtgcaaagttatcagaactgctaagcaaactacttgcatattgttgttcttctcatcttttgacaaaatggtattcttgtttacaggcagtgcatctgaaaccagatgacagtgattctcagcagttgtcaaatacgttgagagagaaactaggcatggatagtataaacatatctagcagttcatttggagctaaacatgaggatcacaatgaaggtgtaaacatggatgatcaaaatagtgatgatagtgatatttctgctggtccagctggtttcaaaaacttgccaagcgattcaactccagttcccagggttaaaatactaaaagtggtgcccatggaaaatgttaatcaggactatataatcaaaatttttgatcagatgtcggatgaagatgatgaaaatgataatcctgaggatgaaattgaatcatcagaggacattggtgatggagataacgttgaagaagcagaagcagcttctgcagaagataatgttgatgaatctggcgatgaaagtgatattgaagccttaatatcaattgattttatcacagaggacgacaaggattttatgtctccatcatccacaaaagcctttgaacgaatgccagctagattagaaagaagagaccgtttttcattttcgttctatactgaacaatatagtaaaaggcaagatgtggaaaaagttcaggggatttccaaagaaaaagttggactccgaactgctcagcaggatgatgatgatctccaatttgaccgtgtaaagttagtaggcagcaacagaaaattatcggtaagtattatgctgccgtactgttttatgtttgcttttgatatcctgcatttgtcttaatttgaataaaagattgattgattgtcgatttatggcctatgaactctctgattttgttcctgaattgccagttttttttttgtgaattactgtttgttaaattcacaaaacctttttgtctctgccaattattcttcttcagggtgtttatagtatctttttttcagctgactgttaaatgtcaaattatctaatcttcacattttttttctgcttttatttgcttatcaatgcaagcatatcccctgttcaacaagatttgaataaattttgtagactaaggaaaggcatattgtctaattcagcttgaagtaaataaattttgtagactaaagaaaagcatggatttttcaaattgactgagtttgtctttttcatggtgccattttaatttatcttatgcaggtactacaacttggcatcaagcaacacaataataaggttcagcaaaaattgtacggagttactcacttcagccgtattcagatacctgtctcctcagatcctcttactggtacgttgaaaatgatatttttcacttaggattttagtggtataattgttctcatttagccacaaacttttccttattgctggtattagctgattaggcatctctccttggcaggtttatacatgacggcatcaggttttgactcagaaattcttagcttacaacgaaaatttggtcaatggcgagaggatgattcatctgaagagcacagggacctacagttctatgagtatgttgaggctgtaaagttgaccggtgacaaccttgtgccagcgggtcaggtattatgccttcaactcttgtagccatacaaaactaacaagtactgtaagtaatatgtattcccttgtttttgttcttcccacttgttgaagaaataaaatacatattgacttttcacaaaatagttttctgctaagaagtgcaatcattatactatttcttgacaatcttgtgaattcccttatggcatttttcactctcaagcacttgcacatatcctaaagcaccaacaaggggtaagtaggtcctatccatccttgtttggtgctgtgcaacatgctatttgcagaaccatggaagcacatctccttttgtgtttgttgtgtcttgaggtggctatttcaagtttacaaatcgtgactagttggtgcagcctaaatattgatatcctgtttttctggtgagcactacaatttaggtttatcttatacagtctccatgtcaggttgtcttccgtgcaaaggttggcaaacattatcagcttccacataagggaatcatccctagagaacttggagtggtacttttttctctctcgtagttttagttattttttcttttcaatagtgaacttgactgctatattgtatataggttgctaggtacaaaggggaaaggagaattgcagatccaggtttccaaaaccctcgttgggttgatggcgagcttttgatactagatggaaaggttgaaaactattcatataatgcacatttccttgtatattcacgagatacttttttttaacaggttttgtttgtgaatttgcagttcatcagagatggtcctgtgatagctttcttttactggacatcaaactttcatctttttgaattctttaggcggttgaagcttcctgattagtttcagagaatcagttgaaggtaaatgaattttgtctttgtgtggcccagctgttattgtgctgaagtaatcttcatatgttctattctcgcaccatattgcacttgctatgtttaattatgcatgcagaattggtgccaaaactagttacaaatagtatgacactagtaacaaatagaagaacactactcttttttgggatgctattgaagcattttttactcctgatgtggccaccatgattctgttagcctacatatagtgagaacaaagtgtgtgctctatgctaggtttggatgagcagtgagcatgaatagaccgacccatgaaagttgcgagttgagaagcatgtcccgcgttgtattttctgcatgtctttcctgacttttgaaattagccagttactatagtcgttgccgggaatctgattaggttcgatcttgagacgctctggcaaactgatgttgatataccaaagaatattggaattaagcatttaggatgggtgcactgcatgtcatactacatgtagaggggagagggcccagcaggcacatgttagttggacggtttgaaccataactttctgtcccattttacttattatagttagctgtatgttcgtatgagcaccgaggacttgctctgtttccttgactggttagtatgatcatgcatggagtattttaatgccattcaaatacgtgaatacatgattcttctgcggtgaacataactaacttatctcgtttattgttgagcagctagcaactgctattattccaaccctactttacgcctgcttcatcatgtttttttgtgtgatgtctgcaattttgttcgtaagatactaaaatgctttgcaatcagtctgatctttagcaagaactaaaaagtggatttgttgcttttttatagcaggccattccacaatcttgcatgtcgatgtacataacagaatgtacataatcgtcttcgttaaaaaatacagttgggaagaattgcgcaacatcacattccttttctttggagagaatccagtggaatgaggacttgagcggcggcatctccaatctcactggaagatgccacttttaaggaaagaactcgcacaaaggaagatatgaagagtgaactcgttgttccatttcctttcagctcaccaacccggtttggagttggaggccaggtccaagatagtttagtaagaaagaaaagtaggttgaaagctccaaaatgaaaagctagaattattccagggtttcaactgttgctttttcgagccatatcacacaggaacaattgtacgtgaaatataagtaggaacagttttggccagtgtgatcaaataattcaaccggtggtaataacgggcacttcgtgttttgtaaatccaaccagtagcaggggggataactgctgtgtgtatatatataactcagcatgaattttgttgaactttggccttgtttagtttccaaaaaaaaaacttttcaccaatcacatcaaatgtttggacacatacatggagtattaaatgtggagaaaaaaaaattacagtttgcgtgtaaattgtgagacggattttttaagtctaattgcatcatgatttgacaatgtggtgttacagtaaacatttagtaatgacggattaattatacttaataaatttgtctcgcagttttctgttgaaatctgtaatttattttgttattagactatatttaatcaaatgcgtgtccgtatattcaaatatttaatgtgacaaccaaatctaaaatttctccccaactaaaccaggcctttgtgtaccagggcccttttccgggcaagtattcccattctttccactcacagctacaaagttcattgttgctggcaagttcggagctagcaaaggattttctttcttctgagaccaaacgctcctgaaaccgtaaaactaacgagcaaaacaactacaaaacggaaggaaacccgaccagagccgcaagttgtggctcgcgccgaccgaccgaccatgccgccgacggcgacgctcccgccgatcgcggcggccggggcctccgccgcgagaggctgccacttgctcaggatcgacgggtactccggcaccctgaacgtgcaggcgagccagctgccagcccatcccatctcctcccgcccgttccgcgtcggcggccggccgcgcctggcgcatccgcgccgcgccgagaggccggtctcccagcaacaccgacttcatctccttccacctctcgctcgacaacggcgacgagtccgccaccaccgccgagccggtggtggcgcaggccaccttctgcctcctcgaccgccggccgtcggcagccggtgccgtcctacaccatcaccaccaccaccaacgacttctcggtgaacaggtgacgggggtacgactacgagagggggaagctggagagctcggagtcagagctcatcaacgacgactgcctccttcggatgccatgtcagcgttacggaggcacaggtggagaactgctttttagtcccggtttgtaaccccctgtagtctcggtttttaaacttggactaaagatcgctatatttaggtcctctttgtttaggcttataagccaacttataagccaaaaagtctaagcctaaacaaacaagcagccttttcgtttggttttttaaagccataagccgctcttacactattaagtcaaaagataggttggagaggcttttttggcttatatgagatatatgtatgactccaccactaaacttaggacattaaattcactagcttataaatcatataaaccaataagctgacttaaaagtctaagccaataagcctaaacctaaacaaagaagaccttagtcccgggtgaaaaaatcgggactaaagatcgatctttagccccgccaactaagagtaaaaagagggatatttaagtcctggttggtgttatcaaccggaactaaagagagggtagctttcttttttattttctcccgaatcgagtggtatgcatatcgtcaaatcaaaccccaaatccacgtcacaactccacagcacgattcacatattcatcacaaattcattcacaatatccattcacatattcattcacaacatcacaaatatgttcacaatattgattcgcgggttcattgacaacatcgagtcacatactcatttataacatcacagattcattaacatcgatccatagattcattcacagagcaaaacatctaaaccacaaataaaaaaaaatcaaaaaaacaaaaaaaatcgactcaccaagcggcctcccatcccgccgccggccggccacccatcccgccgcttcccctccggccggatctgggggaggggagggcgaggccgccggcgaccggcctccgtcccaccggcccacgcccatttaatgggagctgccagcccatctcctcccgcccgttccgcgtcggcggcctgccgcgcctggcgcatctgctacgcgccgagaggcccggtctcccagcaacaccgacttcatctccttccacctctcgctcgacgacggcgacgagtccgccaccaccgccgagccggtggtggtgcaggccacaccttctgcctcaaccgccgccggcagccgaagcccgaagccgtcctacaccatcaccacccccaacgacttctcggtgaacaagtcatggggggacgagaggttcatcgagagggagaagatggagagctcggagtcggagctcatcaacgatgactgcctagtgcctcaccttcggatgccacgtcagcgtcatggaggaggaagctgggtggccgtattccatggaggagctcctggaaccaagaaccatggccgtattccatggaggagctcctggaaccaagaaccatggccgtattcctgcccaaccaagaaccgcatcatacggataaggtcataagggacacatatcctctaccgtacagataaggggataaatagtggtggagctaacgacaccatagtgttcatgcaactaataatgttttttgtgatttaactagttttgttaggtgtcaacggttatcggtagtggagacgacatcgacaaagcctgagctgtcactaacctacccaggagctaaattcgcaattgagggaacgcatattctgtaccatatgcacattgccataacaactaacgtatagactcatttattctgaagcatatatgttactggctcgtatgacacctactgtactaccgtacaatagagaactaatgaaatagatagctaatgagattgttatgttgctgtatagtatcattttttttttctaaaaaggttcacataagaacaaaatatgaaccgtcgactacatgtatcgagcaaacatgagaagcaattcatgcttctatttaattaggactagagaaaaataaaaagacatagaacaattctagcgtttcaaagataggcatacttaattattttcttccaacggagaaacatactggttccattgaatcggtggtattcaattttagaagaaattgaatgctaagcaatgataatattactaattttcaaataaaatattactactaccttgtactcctcatttcagctggatttgcgtagattcttgacaaatcgaaataaataaaatctattgccaaacatctatctattatagtattaagacagctcgaaaaggagacaccacgttcgctgtagaggttagaaatttccacattaatcggagaaaaagaaaaaatacgaccgttatattgtggtccctttagattttagcggctgagatataataagagtccatagaaaaaattaagaaattatagtctgtttacgtaaggtgaattagagacggacatattggttataatggcagaccgagtcagatacgaatcgacgtgtgtatggatttaacaacaacatgataattctaattgcaaagtgacacaacttgactgtggaaatcaaatcagaataacaccattgaatatgattagatgtgtatgattctatcaccccgtttcttaattaaaatttaaaataaaaataaaataaaacaagaaattagaaaaacatattattaaatcagctttgaaaggtggcatacgttcgccgtggaggttagaaattcccacattaatcggagaaaaaaatgagagtccaagtaggaatataattttaaaataactaaaattcggaattaaaaataagaaattttagaagaagagtccatataagaaccaatacaagattaattaaaatttgaaataaaaaaataaagtaaattccaaaattgttagaaaaataaaaaatatagttcgaataggaatacaattttgaaatagagtccatataaaaacctaatacgagattaattaaaatttagaatgaaaaataaaataaaatccaaaattggataaactaaaaaaagagagttcaagtaggaatacaatttcgaaacgactgaaattgaaaataaaaaataaattaaaagaacacaatacgatatattagttaaaattcgaaataaaaaataaaataaaatctgaaattagaaaaagaaaaaaaagatttcaactagaaatataatttataaataattttataaataactaaattggtgataaaaaataaaaactattgaaagaaaagaccatctcaaacacatgaggagattaattaagtaaaaggcctataaaggagtagagtggcggcggttgatggaacatctaaaaactattaataaaacaccagatagaatcctaatgacgattaaaaggaaggatgacgggcaggtcgtgaagcaaccggtcaaggcggttggtaggacttctagaaattaaaaaaaataaaccctaataataatcaatttgatttttaaaatcttaatgacaacaaaaaggagagacagcgggcgggtcgtacaagagtataatgctagcgccgccgattgttggtgggacttttaggaagtaaaaaataaattccaaagatgtgtatgttcgatttttagaatcccaataataataaagagtagggggtggacgggtcgtagaggagtatagtgacaacatttgacgggatttctaaaaactatcaaaaacgaaatccaacgagacaataaattataaaaactataaggttcaattttaaaaggttcgcacttctaaaaagtaaaaaacaaataaactccaatgataatcatgtttgattttaaaatctcaatgacaataaagaaggaaggcagtgggcaagccgtagaggagtatgctaacaaaaccactgacgttttgtcggaacttctagaaagtaaaaaatgaaccctaacaataattatgttcgattttgaaaatatcaatgacaataaagagaagaggcaatggagatgccatagaggagtataatgacagtgtttgttgggacttctagaaattataaaaacgaaacccatgaggacaataaactctaaaaagtataagatctaatttttaaaggtttccaaagagaatgaataaaaaccatgtagatcgagccagcaaataaagaaggatatgacataagtaaatgatagcaattgatgtgatttttaaaaattataaaattagaaacaaggggatgataaggtttggtctttaaagtctcaaaacaacgagataactatttaataaattaataaattttaagtaaaatcatattaaaaataccaacagctagtttgaagaagagggagagagatggaggtggacgcgagcgagagtctcccttgcgccacgtttctcgcgtccgttcttctccgagccgcgtcaaacaaaaccaaacaccaccgtgcgagctctctctctctctcccctcccccctcctcctctttctctctcctccccttctcctctctctctccttccgctgattccgtcaccgcctctctcccgccgcccacgcgggcaccggaacccgccgccggggacggcgaatccggggcggccccgccccgaatcggcgccgcccgctcccagatctcccaccccttccccgggggcgcctccgcatgtcatgagccgcccccatttgcccaaagacgaccacgccttcgccaatgggttcttgttcgacggcgtggcccgccgccccggcgagatcgaggaggcggccgccttcgccgccgccgccgacgtggccatcaccatagccgccgagcagtccgggtccccctcgtcgtccacggcgccgccgatgtcgtcgtgcgggcagtacatgctccaccgggtgggcaagctcgacaccctcgccgggatcgctatcaagtacggcgtcgaggtaatgcgacgggagtacactgaattttttttagggcctttttttttcactgctccatattggaatactccattagagaagatataaaataacagtccttaacttctagctgttttaggtagtagtatgccgtttagctctatattgattgggaaatgattttggaatggtttgcgcattgtttttgtggtggtgttgtaggtagcggacatcaagaggctgaatggcctatcaactgacctccagatgtttgcgcacaagacgctgcggattccgctccccgggaggcatcctccgtcgacttaccagcagaacggttcatatgagggtgatgacaggtagttaaaaatcatgacatcactttgctcccatcgccagcaaaatgctggacttagcattgtccgttgtggagttgtcctcacttatcagcattggcgcgtcacagcacagtgctatatcttttatagatttacatggagtttggtagttatgaatttgtctgtagccaatttctctctatgatgtgcagagggcagttaattaattaggtggttatatgacttgggattttggctttgggctccaaatacatggctaatagtatgttctctgtttgttcttttgcgattgttcaccttccgctattatttcctgtataacatccattgagtgaccatagttatagctcagaacataagataagctagggcaggaatgaatgaagagcattaaaatgtagagaatatggtaaagagaacacatttcagccaaacctgcaactaggtcctaatcatcttgtgctcagggggagagccttatttaggccacactgggccatatggccctcccaagtcgataaaataacatttgtaccatactataggctaattacctgctatggttgctcttggataagcagacatttctctagctcttatatgcattatcagttataacaatatgatattatttcagggaatgtactcctccacgtcgccttcatgatgatatattggattcagttttgagaacaccaaagcacaaggcttcaccagccatgagccttctgcaggggtactatggtctcacaccacctccaaagaaggatacgacacatgaaggcacagaaatggcagtatatagaaaaggaaaatctgttttcttggatgatgacccatggtttggagagccgccagattccgacccattcccttttcaacataggaaaactagaagtcttgcaataggttcttctcttctgaatggcgagactgaggagaatggcgacagcgaaaagttgataaggcgacgccagaaagctgatggtgagttgttacctagggaagaaaatggtagtagtgctgtcctagcaagggctgggaaaggcctggcgttgaggcctaagtcgggcagtcgacaagatttgaacaagagccagcagaatctcattgcattggcggagccttctttcggtgatgggttgcatgctgtaaggaaatcgtcgagcactccggagttccaagagccagagagcaacagcagcagcaccagttcctccatatggtcgacaagcaagtggaccttaaaaccagacgctttcactctccctcttcccctccctctttttgacaacattccaaagccaatcgctgcttggagaaacaaggcggctcgagattagtagcttatagtctcttggttttgcacaactcctgttctaaagcaaggccctgtaagcaccccccggaggagcttcggttgacaacagctcttctgagagttggaagcagagcagaggaccttgtggaccttggttacttcttcctgggtggctggagcacaactcaggaagatcaaacacagagatggttcagagattagcttctgttttatggttcccttgttatattggagatgttgcaacgagtagcagcatcagtttcttcagttaagttatagatgacacagagccttggatactgagggtattcttttgtacacaaatgcagataaatgtagggatcgaaaggcggctatatatgttgtatgtgtgagaacttcgctgatatagaaaagtatcgtcattatttaccttccaaatgagatttgtttttgttctttacttttttggccttggtggctcaattataatctcttttcccactgtgttgcttgccagttgccattgcaattacatgtactccacctacaatctgtgttcttttcagagaacaacctgacagttatttttgtcagttcatcgtagtgaaatgcaaacaatctctaaaaaatttcaaacaagtttttcttctctagaaaagacaaaaaaaaaagaatataaatgctatagagagattcattcatcaaatgggcatgaatgcatgatattgcatgcgaaaagtttcagtataccaggccagccaaagcagggagaagaagatctgcaacggccctctgacatgacgggcccacatgtcggcctctcgcctcacatctctgcaacggccgccgctgccctccaccgcgccaaccaactctcctccgcctcctctcaccgccgcctcacgcacttcgccttctcccactcacctccgccacgccgccgatttatacccacctcgtcatgcgcctccccaccaccgaaccctcccaacgccgccgccgccgccatggccgacgacgaggctgccgtcctcccgcccccgcctccgctgccgccgccttgccgcccccacaggcagctccgcccgagggggtctcgaccgactgctgataccacccctcgcactagccagttggtcagtgcagcttagctgatgttggctgctctcctcgttggcgccgcctgcgtgcgtgcgtgcgtgcaggtaccaggtggaggtgttcgaggcggcgctgcgggggaacaccatcgcggtgctcgacacggggtccgggaagaccatggtcgccgtcatgctcgcgcgcgagcacgcacgccgggtgcgcgccggggaggcgccgcggcggatcgtggtgttcctcgcgcccaccgtgcacctcgtccatcaggttgctttttctttttttttttcatcaacatgtgaacaaatggagtgtggacgatgtgttctgatcgggagctggttgctctgcatttgtgctgtagcaattcgaggtgattcgtgagtacactgacctcgacgtgatgatgtgctctggagcatcgcgggttggcgaatggggcgccgatcattggaaggaggaagttgggagaaatgaggtaagcgcccgggtttactgaacctgctcctgcgctatgcttgaggcagcgatttgcttgattgcgatgtactgtgaattggcacatttggcgtgcccaccaactgaagccagatgcaggctgaggttgctaccagcctacccattaataaatttgagagtcatcaacttgatgttttctgaaggggcgtgcatatgaaatactagctgatttagcactctggttcaagatgaattttctttcatgtgttgtcatttcctagattgagatgctggtctgaatctgagggatattgcagtcctacgccactttgttcaaagtagctgaagttctgtaactttggggttcaatttcttagatccttgctatgttagtacctatcggacttaattacagctactgaattgggcttacgcatgccattgctaacttggatcggaaatacgtgtttacgctgacatttgagcgatgcatgccttttgtgtttcagatcgttgttatgacgccacagatactgttggatgctctgcggcatgcttttctgacaatgagtgcagtgagcttgctaatatttgatgaatgtcatcgtgcttgtggaagccatccatatgcacgaataatgaaggtaatagaaatttggggatctgtcttttgctttgacaacattggtagataagctttggcttgcagtttttgttattacagaaagttgcttaggataacagtatttgttttaataatctgacatggcaaatttgcttttgttttatgtctctcttgagttccaaaggaattttattttgggtctcagtggaggccagatgtatttggaatgacagcctcccccgttgctactaaaggcaagaattctacacacgacaatcatgtgcttttttgtaacgaaaatagtcacgtgcttttaaccctgtgtatatttcattgatcaatagtttcagaaaatgtgttttagctttgttattaaaataagcatgtcgtgtgactgttattatcttcctttttgaagaatgccccaactgccatgtactgtcaaaaactcatgtgatgtatttgagtgcttttgccttcttcataacaagacaatacatttctggaagtatgattctttctcttgcttcataattctacatggaatacctctctgcctgccaactgtagattgcatcctatttcaaattttgatgattgggcatcacagtttgcgtgtttgacttagttgtccactaaaaggcgagttccttagagggtcgcttaccctggttgggtaaggttaggtcgtgtgagccttttgttttgtaagtagttttttcgtaggtgtttttggggagaaaggcattctagtctcttccccgtttttattccttcttaatgaaatgatacacatactcatgtatatttttttaaagaaaaggttgtcccaatttaatctattcaatgcttctactcatattactggagagcacattcaatcagttcattaaattgaaacagtttcctgttgtagaataatttcattgaaattatgaatttctaatattgttcggatttgctggctcataatctattacaaccctccattttttcaggtgcttccacactacacaattgtgaagcacacatttctcaactagaactaaccttggatgccaaggttatctcaagctgacaagctttggatttattgaattttaagaaaacaactttccagtaacaaatagcctgtcatatgttacatgctattgcagatatacatcgtagaagatcgaaatgagcttgagagcttttcccctcctacaacaattgtgaacaaatactatgatgcttacatggttgattttgataatctgaaatcaaagcttcagatattttctgatgaggtgatttaactgaaatacatttgagcttattattaaaatacatatataatttggagtaccaaaacctacagctccctgtaactttctttttgcatgtatatttgtttaaattttgtactgttgggcagtttgattctttgttggttggtcttcaagaatcgccatctaataaatttaaagacaccgataatatcctagagacttcaagaaagagcttgtccagataccatgggaaaatattgtacagcctaaacgatcttggtccaattatcacctctgaggtattgcattatccaatcagtattatataatcagttctatgtaaagaaaacttttctgaagagtcacataactttgacatttcatatcggccttgtttgtttactagttatacctacataaattccagtcttattgaaatgatttttaacctttttgcaaatatataaaatattgcgcatgccgaactgataaatcaaaagaatatttggtgaattcttttcataggaaccattcactttaactagtaaagattggcacaagttcaagtacctaagaacataagctgctttgcatgaccttgcctgtgacagctatagtatctttgccattatttttccgtaacatcacgtgtgctgcaactgtttgtcttctgttatgaaagagtgctttgttcttttctggaagtggaaacggtgtattggtactaaaaaacctgttatccataaggacttcaagtatagtgtaaaatgcttatactaacttaaattgttttcttaacaggtagtcaaaatacatattgaaagcgttaagccattatgtgattctgaagactgcattttttctaaagctagcttgtgcttacatatgtcttattttaaagaagctttaagtctaatagaggaaattcttccacaaggtatagtgcaccctttagttgttatcttgaattaactgcataagcaaaaatgatgcagtgagtatctttcttttatctgtatggattaggtaatgacacaatttgcaaatccaactaggattgcattatgttctttctgtttagcttatgccctccagtaaaagattccctgaatcttattagtttagttgtctgttttttgtacgttattctcagaataagaagagaaacacatgcttctacacaccctcctaatttgcatgctctatagaagtgaactatgaagttgatgtagttcgctgggtgctgctagctaatttgtggagttggctgctagctgagagggctatcacctttgacgttaatctttgccccttatgataagatctggtcagcgggcttctgccggtttggcaaaaaagaagtgagctttgaagcagtttccagtaggtagttagaagcactcaaccaaaaagacagaggagattgactctaacctctatagccacttagattgcagttggtagtctctgtgccacagctattgtttctctgtatgtgttcctttttctactttcgtgcattgatagttgccttctctaattctgctgatgcaattgcatgacaggatatggtgaactaatgaaatcagaatctggttctgaggaattaactaaaaggggatacatttcttcaaaagtgaatacgctaatcaacatcttcaaatcgtttgggtaataccctagtattctactcaagatgtttagtttcacctacttttggtcttttgttggccaaaaataatacagccatgtgttttctctacaggtcatcaaatgaagtgctttgcctaattttcgtagacagaattataacagctaaagccgtcgaaaggtttatgagaggaattgttaacttctcttgtttttcaatttcttacttgactggagggagtacatcaaaagatgctctgagtccagcagttcagagatttactttggatttgttccgagctggaaaggtatgagatgctattgtaaatttgattcaaacagtctttcaaatgttacattaacttcacatcaatttctaggtgaacttgctttttacaacagatgtgactgaagagggcgtcgatgtacctaactgttcttgtgtgatacgcttcgacctacccagaactgtttgtagctatgtccaatctcgtggtcgtgctagaaggaacaactcggaatttattcttatgattgagaggtgaatcatcacacttgaaattaagttaccctgtgacagagatagtcaattttttctaacctaaattcattttccacattttatgtgtataagttagatccaagctacgcaattatgtatttgtgaacagtctgagctcctaggcccaaaattgcttaatcctacctatctcagtagaaaaaaagtatgcccgtgtttaataattggcataaatttttatgccatttttttcgcttgttgatctttcatatatggattttcaggggaaacttgcagcagcaagaacacatatttcgtatgatacagactggttactatgttaaaaactgtgcactctatagacaccccaatgctttatcctatgacttgtctatccaagggatgtacacctaccaagttcagtcaactggagcaactataaccgcagattgctgtgtcaacctaattcgtaaatactgtgagaagcttcctaaagataggtacacttaacactctagtatttataactctcgttgttttatgagttgcttgtgcttcagtgagtatctcttcttcctttcctgctgattaacattgcaacttatgcatgaatcattgatggtatccttaagatttattgatatactgcttgacaccagatgcatggatagctggttagattcaaatcacacatagacaaaaaaacatccctgctacttccctaggcatgatttgctgtcctagttccatttcattaaagtggtacttcatggtaacatccttctgcaggtatttcatgccaaagccttcctttgaggtgaccattgaagatggattattcaaatgcacattgacgctacctcgaaatgcagcatttcaaagtatagttggccctttaagcagttcaagtaatttatccaagcagcttgtatccctagaggcctgcaagaaattgcatcaactgggagaacttaatgatcatcttgtacctttgactgaagaacctatggatacagatttcactacagcagatgaaaaatgcatatctggaccaggtatgagtgtaatgttgcagttttgcttatattatatttcttggatacacccatcacttcatatatttttctacgctgtagcactggtatattttataaactatacaatagtacaatactatggttcttcagaacagatctgggttgccatacaacactgaaaattgtaaaactagaactacctcggctgtctctttacgtttcctttgcaatgtagctatttatagagatactctacacatatggtgttttatttttggacatgtttgttggagcaaatacctcctgatgcttgaactctgttgatcttgcaattacgtagttactctcccttcattttgttactttatcatttgtttgagaggttcccgcatactgtagtatggcaattgaaagttttaaacagcaaccctaatcttcccatatattgaaattttccaacagatatgagtgtttctcctattgtacatgatcactaattttccattctctttcctatttttgcaggaacaactaaaaggaaggagcttcatggtactacatgtgttcttgctttatcaggaacttggattcatgacagtgaaaatattacactgaatacttacagaattgattttctttgtgaccaagagggtgaaaactatgctgggtttgttctcttaatggaaccagaacttgatgatgatgtggcaccctcaaaaatggatctgttcctgatccctaataaaatggtctacaccactgtaactcctcgcggaaaagttcaactaaacaaaaagcaggtagttcaagaattagtggcttattgacattctcgttgctaaaattccatatagtttttatatctgtgactcatctttcttgtttcttcagttaggtaaagggaaattgttccaagaattctttttcaatggaatctttggtagattatttcatggttctcgaaaaagtggagcacaaagggattttattttcaaaaagggtcatgaaatacagtggaacacggaaagcatgtacttgcttttacctttgagggattcttcatatatccaggatgacctaagcatacactgggaagcaattgaatcttgtgctggtgcagttgagcagttgtggagttcgtatcaaggagatgaaaatgtcattcctgtaaattgtattccacaaaaaagaagagggggccaagaagaaattattcatctggccaataagtctcttcattgttccagcatcaaagattcagtcgtgctatcactgcatacaggaaggatatacactgttcttgatttgatcttagacacaactgcagaggactcgtttgatgagatgtgtaaggggaaagcctcaccttttacttcatttgtggactattaccatcaaaagtacttcctcttttttatatatatatttatttctagtactgctctgctcttgtatgtgtcctgatgaactttctttcttcacttcattgtaggtatggtattattattcaacatccagaacaaccactattgctgttaaagcaaagccacaatgcacacaatcttctcttttcaaaattgaagtatctaggtactggatacacaccctactctagtaacctttacctctgttaatggaaagttttagctgagtgtgggctcactgcacctgatatccatgccttgcaaatttcattgggataagagcacaaattgtgtcttttatctttagttttggttaaatactagacctcaacttttcatttattgacatacactagtgattgttactccaacatgctgttctatgctcaccctcttttggccaggaactacatggccagcagttggaataacttaagtgaaaaaatctatccgaaaaaaggcttgaatgctaacattatattcttgatgttgacttaatttaacatgtttggccacctgtattattttggatagatgaatcagttcaatgagatagcaaagaaactgtttgagaaaaaaaaagatggcaaagaaacaaatttaatactacttttttgtgttttcttaatacaaccatatggtactactaaaaaattatcaaataaattatagtacatgacacaaaacatggaatcctctcctttatttttccatttccttttgtgtgcgcttcaggttatgctggtatcccaacaggaactttgtaataaactatatttgctttctacatgagcagggtaatttccttaataaatcgatgtagtgtcattgtgtcaaaaccagcaataggagtccttaattactttattttctgcacacaatttgattaatgcatactaattattgatagtggaactattgcattcatccattcatgcagttgagccacatttcttttccagcatataccttttcttttgcatcatcaatccacctcatagagcagtagagtccttcttttgttaccctttgtccgaaagtacactaaatttgtaggcctcttactatttcgagaactgcaaatcaatatgactgtccacccttattattactgtatcccaagcaacaggactgaatcaatggctctagtggttttttttttagataatgggcagcgcccggcctctgcatcataaggtgaatgcacacggccaatatagcgtggctggcacaaaagggcttagcatcttatggccttgacacctgtaccatcgtaacagtggtcgtttgctgttgatttttttgtagatttcagtgtgttagttcccttttgggggtgtgtgtttttggtggtctcttggtgttgtagtccattgggacctttttcttttccttctcaatataatgatgagcagttctcctgtgcattcaagagaaaaaaatgcaagatacagctgcgagcctgcgccacactcagcatatcttcacttctagtataatgatatgcaagatagcaggtacagtactttgggtcttatttgacatgaaattccatatgacctatggcagatggctccactggcaaacctctgctcatggaaaaagaacaaattcatgctcgggttccacctgaactacttatccatctcgatgtaacaactgatattctgaagtcattttatttactcccttctgtaatacatcggcttcagtcacttatgctagccagccagcttcgcagagaaattggttacaatcaacacataccagtcactttggtttgttctctttcaacatttttatttgctaaggatgactatgcatttatcaataatttggtatatttttcatgttagattttggaagctataacaactttaagatgctgtgagacattttctctggagcgtttagagctgttaggagactccgtgctaaagtatgtggtaggatgtgaccttttcctaaggtatcctatgaaacatgaaggtcagctctctgatatgagatccaaggctgtctgcaatgctacacttcataaacatggaatatggcggtcgttgcaggtagatgatttacacccctaaatgcatttacatggtttcaacttcctgaagtttgcaatatttctgttgttgtacaaataaattttttaagttacttaatttggtatgggcaattcacctacttgagcatgagagactacggattgtatatgcacattgtgtagcaagtatttgcttctatttttagctttgatttttgcataaatgcactggtggtcatatgtttgccatgattgctcctttcacattgttcctttcataactttctttgaatgcctatgctttacttactgttctatcaatctttagtttcatagtcacatcataggcttgggcaatatatatattcaagaatattttctaattcttgtgcttttttttgtgagctttgcttatgtttacagatttttttttatcatactttcagggttatgtacgtgataatgcttttgacccacggcgttgggttgctcctggacagatatcgttgcgcccttttccttgtaactgtggaatcgagactgcatttgttccttctcatagaaggtatatccgagatgacccatctttttttgtgggaaaaccatgtgacagaggtcataggtggatgtgctcaaaaacaatatctgattgtgttgaagcactggttggagcatattatgttggtggtggcattgctgctgcactttgggttatgaggtggtttggaatcgatatcaaatgtgatatgaagctattgcaggaagtgaagttcaatgcatctcatttatgctccttatcaaaaataaatgacattgaggaactggaagcaaaactgaagtacaacttctcagtcaagggccttcttttggaagccataactcatccatctctgcaggaattaggtgttgattactgttaccaggttagtgcaacagagtaattatgttttgtgttagaatcaaaagttttgtgcccccctcttttttttttcttatctgctttctattcagcgtcttgaatttcttggtgattctgtgctggatctacttcttacacgtcatctctatgctactcatactgatgttgatcctggagaattaacggatttacgctccgctttggttagtaatgagaattttgcacaagcagttgtaagaaacaacattcacagtcatctacaacatggatccggaatacttttggagcaaattactgaatatgtcaggtcaaatttggagtgtcaagggaaagagagtgaattccttcaacatactacatgtaaagtacctaaggttagatgcagtattctttgttcatagtcttgatagcctagtttcaagttatgtgttttctctctctctttaatgtctaattctcaatacttagctttgcggagtgtatcaccagacaatattatgattacatgttatcaacctaattttgttctgtgttttacaggttcttggtgacattatggaaagcatcgctggtgcagtatttatagacaccgattttaatgttgacatggtttgggagattttcgagccattgctttctccactgattacacctgataagcttgcattgccaccttaccgtgagttgctggagctatgcagtcacattggttgcttcttaaattcaaaatgcaccagtaaaggagaagaagtaattatagagatgtcactgcaactacgagatgagctgctggtagcacaagggcatgacagaaacaaaaagagggcaaaggcaaaagcagcatctcgtattttggcagatcttaaggtaagaatttgtaagaagaaacaaaaagtgtacacacatatggggttggctagtgcctcgtagtgtaattgattggccggttgaatggcagcccaagtacaccttgagccttgaggtgttcatattgctagtttgaaaatagatgcttatttatcctacaaactgatgttcgattttgaagcagcaacagggtctttcaattaaacaatgtttgtccaaggctaaacagctggatatcgtgacttcagatcttcagtttgacttgacaagtgtaagattctagacagcactccaccaaacgccttatcaaagtattgaacttattctgaataatatatttgatgttgtgtagtcaggaacacaactcagttattctgatttgaatgactatcatatcctagaaggtctttcctcagtaaagaaagaaggtttgcgcattatttattgtcttttggttcaattgttgcttgctggcttgcacctgtcaaacaggaagtactaaaatttaggtaaattctactgaaaccatatgccattcgaaatgttttcagttgtgcttccactcaaaatggagaaaggtggacctcgaagtgcgcttttcaagctatgcaagattttgcagtggccaatgccagaattcgaatttgtggaacaaaggttcaggtatgtacaggaataccaagaaattctttcaagaaatgcaaaacttgaataaactcaaacgatcttcatgatgtcttgattgatgcacgtggttgctgcaacaggactcctattgttatggatggggcgacaacaacaaacttcaatagctttgtttcgacaatcaccttgcacatacctgacgcaacaaccattacatttcaaggtgagcgacgtactgacaaaaagagtgctcaggattcagcatccttgatgatgcttcacaagcttcaagaactcaagatctgtatatgcaagacttagcaaagcatcattgagacatgggccaatatgccagttaacgattgcgactagctaatgcgagctacttccctcccaaagtgagatgcgacgaaaatatttctgaaaagctcgatgctccagactgtcactgatcctatgttattttggggaagaagatccctatggtatactaccttgcattacctggatacattgttgtcgagtttccaatattccacgatgtatcgccccaagattcagggacatacctggctacttttctcttatccaacttcaaggtttccgaggtgctctctctatatatgttttattgtgcttcagtgtttggagagattaaagatacgtcttagagaaagcacttggtagtctaaatagtacacttaatggatatgaagataaaatgttctgcaaaagttgacactatatatattttttaattcaaatatggggggcaaaattcatccttgggcaaaatactactccctccgtttcaagttataagatgttttgactttggtcaaagtcaaactgcttttagtataggtgcgcattcggtctgaccgaaaattttggtcttcggtctttcggtatttgaaaagtgaagaccgaatttcaacgtaaaaatatcaggaccgacaaattcggtctcggtcctgaccgaaattcaacaacattttcatatatgcaaagaaataatggaaattttcaatacaaaaatcacccaaaaaaatcgtaagcacttatgagtaaagattcttattaggttgcatacctagaagaagtagggatgtgaaaattagagtttaatcctattgaactagtggattgtaggttgcatttagacaaaattcggtctttcactacctaggaccgaattgatgactgaatttttcggtctcggtttcgatctttttggttcggtttttttctgtccatcctagcttttagtttgaccaagtttgtagaaaaaaatattttcaaatcaagacaaacttattatgaaaatatattgaattatttatttaatgaaactaatttagtagtataaatattactatatttgtctataaacttagtcaaacttaaaacagtttgacttcgattgtcttataacttgaaacgaagggagtctggatttttcacattttggtccttttgaaaaacttattttgcaaatagacccctgaaaaaacttatcccagaaatggtcctttttggggcgccagagtggctggcgccatcgtccaacggcgccaacctctttggcgccgtccccctgccgacgtggcggggcgatgctgaggtgactagggggagcgcgccagagtggctggcgccccccccccccgaaattttttatttttcttttatttttttgatattttttttcacgcttagggaacataagaaccaaccatagaaaaaataaactcaaatggacgtaatatgtgacctgtagaattttttctctcctctcctctctctccgaactagtgcagagagatatgtgcaacttttttatttttattttatttttttgatatttttttcacacttaggaactcacaagaaccaaccatataaaaaataaactcaaacagacgaaatatgtggcctgtggaatttttcaaagctctaccgaaaaacttctcttctcgaaaacacaatcttgcaagtggaatttggaggttgtaatatcgctgaacccggcaaagcggggagaatcgggtgtaactttttctgtagatatccgtggatatattatttgcctgattccgagtccgtatgagaaagttacgcctatttcaataaatggcatattttgtctgtttcggtagagttttggaaaattctacgagtcacatattttgtccgtttgagtttattttttatatggttggttcctatgttctcctaagtgtgaaaaaatatcaaaaaaatgaaataaaaataaaaaattgcatctctctatactgtttaacttatggctatcatttcatgtggttatattttgaattagattaagtaatttcatatagtctaatttactaaaggatctctcctatgtttaacatgctgatcaaagggttttactaaaggagttatggtctaattttactgaaggtgcaaagtagactaattaagcggtatgttagctattttcagacttagctaagtggtagttcgagtttaaattttttttgtggttggctgtatcgtgatcctaagtgtgaaaaaacatccgaaaaaataaaaaaaatgacaccgttgcaactccatacagagaaacatgaatggaggtgaggggtggggaggggggcgacgccagccatgctggcgccctcctccctggggcggtgccagccactctggcgcgctccccctagccacctcagcatcgccctgccacgtcggcagggggacggcgccagagaggctggcgccgtccagttgcacgacgacgctagccactctgacgtcccaaaaaggatcatttctgggataagtttttttaggggtctgtatgcgaaataagtttttcaaaagaaccaaaatgtgaaaaagccagcgaagggagtagtcctgtacggtaggcttcaggctttagtagtctagtttggttttgtttgttcctcgccggagttcaccgtagtttcataaatgaaaatttttgccagagttatatgctgaaaatgacaggttttgaagccaccgtcatcttagcatattttccccccgattttattgatcacgatacacgcgtgtgtatgtaagtacatagccaacatacggagatatgcgagtctgggacaaactcacaaacctgtgaatctcataacatttctatcgtgagcgtactcgcatctacaagtacaactgccagtacatttgaactagtgtgatatgaataaatagcgtgatgaatgcactaatgactcttaccgctacgtcaaaggtgtttttccagtagaaattaaccctaaaagatctctgtactcctatcacaaatgcaagcaattcaaaccataattaaccaaaaccgaactcaatcatttttcttctcttctttccctagtatacccaatttctcttgtcacatatagcaatttaaccaagaaagaaaaaaaaacaaaacaaagaagccatacaaaaagggacaaaaaaaaagaaaaatcatttacaacatcaacggccggtgatgatgattatttacaaaaaccgggaggagagcctcttgccgcctctgtccagcaaaccttccatcaccaccttcttcttgtgctcctccgtgcacacctccaccaccgccggcctctcctccgccgccggctcgccgaacctcccactcccgccgctgcctttgcccttggcagcggcggcggcggcggcctgcgcccggacgaaccgcgcggcgtacaggcacgagcagaggaaggccaccgcggtgacgcggccgaagaacacgatcactcccagcgtggtcgccatcgtccacagcccgcccccgccgccgcagccgccgcccggctcgcgccggaacgagccgtgccttctcgacggagctctcttcacgccggccagctcgccgggcgccggcctcgggcacggttgccaggcaggcggcgccgtctctttggccggtgctgcagcgtcgccgccgccgccgccgccgccgccgccggtgaccgtctgctgcggcagcgacttgcttccgcttttcctctgcttcttgccgccgtcggcggcgaagctgcccacctgcggatcacggcgacgagccatcgatgacgacaaggattgcacgcgaattattcgacgaaatgtaatgcactaggagaaagttagccacaggagttgagctacctgctggctgctgctgcctgagataagctcagctagtgaatcagcgggtgtgatgcgctgatggtgtcacaataatttaaaaatctgcttttgaaaaacgagaatttaaaatttgtttttgaatggtgaaaaggcttcaattccagccagatttccaacgagatacaatattaaatttggcccatcatggtaggggtgtaggaccgccaaactccagaactcatcatggatttgctactacttgacctgcatcgatcattgttctttttcaccttattcgctagtatactattgaaactgattatttgcttcccacgttgaaaaaatatatttttaaaaaataatgtagtaaaaatattttacattaagctatctattaagtttatttattaaaatatttaaattatcattatattttagtagataatccatagcaataaaccactcaataatctaaataaaattgaacttaatatgaaaatattttctctactaatattcagtgtttcagtgaatgacaaagatcttaacagcaagagacagcatggcatgaacgacaatgatacaaacggttaaacagaagctgacattgacacaatcacaaggtacactattgctgcatgaatgccatgtgtaaacagaaaagttaaaatccccgagttttttttttcaaaataatctcgtaagactatgaaaaacaattcaacttttattcctttttttcaacacacgtgacgtgaccagctatatattatagtcaaatttgagttattttttctccgaatgtcacagcccaaaacctcgcaacaacaacagcgactagtttccttcggcttcttccacgcgccggctgcgtttggtgggtcaagcacgcaggctgtggccgtggtgggccccactgcatccccatcgtcgttagtctcccgccagtttaactaactaactattacccggttactactactactaaccacgcaattacccactaatgaactgcgacattaacgtgtcgacgaagctatgcaggtaagaaaaattcacgctaatgatcagaaaattttacgctaatgatcgatcaccacatacacaagctgctcgagatcgtggccatggcgaatggtttttttggagaaaaccatggcgaatgtaatgttttggtttgacgacgtgggtgtgcgcgtaccttggggagtagtaagctgccggctgccgccgccgagacggacgcggcggcggcgagcgctttcttggccggcgacggcggcgacgccgccgacgacgatgacgaggagaggaggagtagcatccgcttcttcatccccttcgcttccttcgtcgccgtcgccgtcgtcttcttcttcttattgccgctgttcttccgccatggccaggagaagaaccacgatagcctgatgagccttaacctgaacctgaaccttcgccggcgccgccgcggcttcgtcctggagccccacacgccgcagaacggtggcaggcacgagcagcagccgcctgcgccgccctcctcctgcccgccgccgccgccgccgccgtactcgttgtctccccgacgtcgcccaccatgacgatcctcgtcagcgcgcatcgcggcgtcccgaccgcgccgcgccgcgcaccacgcggtgtggtgatcgcgatcaccgccgccgccgcccggcgcgccgcggcggcatcatccgacgccgcggcagcatgccaccaaactaactgtgtaacgtacactcgcgatcccggcgatcctccggccggcggcagatcgatcgatcgatcgaggaaggaatggatttctctgggaggcgctcgcgcgcggcgtcgcttgatttgggcgtcgcgcgtcacgaccggcgactcgtggaggcgaccgtctcggcacgtcgaggagcagaggtatacaagctagtactagcagttttcaatacgataatttaaggcgagaaagcgaaggttttttctgggtttttggaggaggagaagactaaacaaatttaaatcttccttttttttaaaggctaaacaaattagaatcgcgggagactctgaccaactttgaagccaccgcgtgctactggcgccagtgaggagggggatatgcgatatgcgcgctagcttgcaacaaacttgttaagaattgcgaaacaaatttcttttggattattaagaagaatcttggcatggatccaatggtccaaaatctgtatgatttcatctacaaatttcattcgaatgctatatagcaatcccgttatttatttattaatgtaatgaattaattgtttgagaaataaactttacaaatagtttagaactgattttttttaaaaaagtatttctataagcgtgaaaaatatagacaaaatgctgaaaatgggcctgaagttattcttctggagatcttatcaaggacaaaattacttggaagttggaatgcatacattatattttgtaggatttttgcagtaataagtttgtctttcgtacaaatatttttgatgtcctacgtttataaggccttgacaaaaaaattgtttatttaggaccaggataggattttttttttcaaaaaagagagaaaatatatcagacatcgatcgtgtcatacaagattcttctttgtcaacattctgattaaaaacttgggaggacatccgtctgcaaatgcttgccatgttgaaaacaggggctgaccggcttacacatgagctagctttcgtagtactataacgtacctatggacatatggaatacaataaacaccaccaatggatcaatatattacggaatatcacaagtttatctattcttgaataacacttttacttgtcggaatttcgtatgtatttaaaatacaactggcattaacaattcaaggatattcctcgtattacattgtttatattattgaaatgacaatattgcactcaaggaatatatgatgattctttttagaaatatgtataaggcttatgtgttttgtattaagattggaaagtttatacatcacttgaactcagaaacaacaacaaaaaaaaaagagaacaaagataacaaagcggaaaagaggaagggatgaaggtggctttggtaaggctgtattcggaactctaagttttcaacactctccttttattttctgcgcgcatgcttttcaaactattaaatggtgcgtttttttaaaaaaaagtttctatacgtaagttgcttaaaaaaatcatattgatccatttttttaaaaaaataactaatacttaattaatcatgtgctaatggaccgctccgttttccgtgcgcactgttagagttgggaactcaagcatccggacacagccaagtctatattctcgcgtcatccaattcaagtgacttttagccacggtggttgcgctatatcggcgctctggctgagtgatagagtatagtctcttccaccgcgtcgcgagctgtctctccaaatgttacattctttccaaatgtcccaagttgctaggatgatcaccgtgtcaaacccttcatgtgcgccttatcgatgtttttacgatgcataacatccatttgtgatgtgccaaccatgtttccatagccgagaaaaggaacacaggcatagcaaagcctacctgataccaaaataccctcaaaagttcacagaaattataaccaagattcaatattttggtttgaaatttcagattttccagcctcctcgatcagaaataactttaactgcatagggcagttggcagggacacaactgtcaatcttccccgcccacgctccaaaccaggtaatttcctgttatccattctagtgttatttttttaaaaaatactttgggcgaaattttgtcttttctaaaaaaattaccaagaaatttcaatttcaaattttccttatgaaatttcagatctccctgggcgccccaacccaagttttttttaaagtaaatttaacaaaactactatactttgactaaattatcgcaaaactacatatttagggtcatatattagcaacaaatttattccaaaactacatgtttaagattaagtatcccaaaactacatatttactaataaaattatcataaaattacatattttggggtttaaattctttcactaatgtttgagttgtaaatctccaagttttatgattaaactgatgttaaacatgtagttttatgataattttattactaaacctatagttttgcgatattttactttaagtatgtggttttgtaataaaattagtgttaaatctatagttttatgatacatcatgttaaatctgtaattttatgataatttgaacaaagtacttgtagttttgtgaaatttactcccttattttaccctaacttaaagagtaaaagtcaagagttacaagttataatgatgcgactttgggtcaatatcaacagttcaattcgtgataattagagcactacagtagaaaacaatatttggtatcctgtaccaattaaatatgtggtatcctataccaattaggatttagttacgtgtgacatataagagctgtgttcgtatgtttaatctgcttgtcggctggacagaactgcacggttttgaagggcggacatattgggttttggagggcgagcatatggtctccttcaaaaaaagattatggaagaagaaaatccgaagctatagctggtcaactcaccttaggccgtgtttagttcgatgccaaaattttttgacgtatacggacacacatttaaagtattaaacatacactaataacaaaacaaattacatatttggactgtaaattgtggacgaattttttgagcctaattattctgtcattagcaaatatgagctattatagcacttatggctaatcatggcgtaattagactcaaaagattcatcaagcaatttatatgcaaactatgtaattggtttttttcttccatatttaaagctgtatgtatttaaacatttgatgtgacggaaaagttggaagtttggagaaaaaaaagttggaatctaaacacaaccttaatttgctctacagtgttagaaacttctaccctcatggaccttcatatgaaagacttctcttcccttggggacaaagcaattccatctccaatacttatcctgcagcttccccttgactcaatggatgatctcatactattccttttctcttcttcattttttaacatctcagcacacgattggctctgcatttgactgtaatatacttccttaacagagaattaatcatgatttggtactaatcctcccatgtgtacagaccatatatatataatctgataattaatcatcatgtgcatccatgctcgctcgtggttttactttgtcagttggccgaagccgaagaagcagcccatccaatccagataattaattaacagcgacacaacgagaagaactatcagtgtacggcacagcgagctatctagcgctgacgaaacagtgaactgattagtagtaattaggtgcagtttaaatacgcccatgcatgtgatgtggttgttcatccgctgcttgtcttcatcttcgtgattctgatagtgatgatagcttaatgcttattttaatttggaaatatatatatgtggcactactgctcagtgagagtgaacgattttgatgttatgtacagctgggtcgacgcaagcaaaatgtgcatgaattaggttttttttttaaaaaaaaatgcgaggaattaggcaggcattttgacagaagaatttgaactgttcgtgatatcaattaagtggttggtgaaaaggacttgggttaaattaacctgtgatgatttgatggtaactaccatacaatcgcatagaaatttcgttgtttggactgcacggtaaagaagaacaaacgcagttgaaaaaaataataatcaaagatgagctcactaattcacttgtttttttctctctccgttttgttcatatttctgaacattttgattctcatttgtaaatataatcacaaccagtaacgaagaatgaaataattagctgctaataacgtgtagttcgtagctatctgcgatcacgctggagaagccccttgagcacaaccagcttcttgtaatccttcgagttcacgtcgccgacgacctcctcgcctccgccgtcagccgccggcggcggcttcgcccggcgccgattgagctggagcccgtacaccgcggcgagccacgcgcacacgcagacgacggcccagagccggccgccgagcagccccgccattgacaccgccgccaccacgcacacccccatcgccggcccgaactcgccgtggccgcagctgctcgcgcgttcgcgcgagctcgccacgacgacgacgtcgccttttgattcggccgtctcggcgtcggcgatggcgccggcgccggcgccggcgccgcgcgtcgtggccggagcgacgacgtcgtggcgtcgtaaagacggtgacggtggcggcgacagctcggccggtagcggcagtgacggcacggtgggctcgtgctgctgccgctgcccgccatggacgtcgttgctgctgttgctgtttctcctgacattacgctgtgacaccatttttaacgtgtcaaatcaaatgcgaatttctcagacgatgaaattacaaaaaaaatctctcacaatgacgcaattaatccacgcgattaatgtacgtgttgaactgaaaatcgtgtacaataaag

SEQ ID NO: 69152 - DNA, 3623 bp, Oryza sativa
attcctgcagcccctttatccgtatgtcacttattaaacttgttatgtataattgagtatcatagtcatctttaatgttaacgactgaaagataattatatcatataaactatatagacactataactgctagatccattatgcgctcggtaacccccgccggctggcagcctccgatgctcatcgacctacacaaaatgaattcatcgtcttgatttagggattgaaagtaatattttcataataaacacttagtagaggtagattttattgacgtgcaattcttttgcacgttcgcgaaaaaaaaggtagatttgcgtaggatctataatttttcagatccaccactagctgccatgtgtaccagtggttggctcattaatttgaactatgcattgtggttttacacaataaggagctaagaatgtgatgaagatctaaataggtgctataaatcatgtattacataaaaatgaatgtcatttttatcgagtttttatctttttttaaacttatttttctaagtaaatttcataaaaatacaaatactttgaccaaactatcgtaaaactgcgtattcatggtgttgtaccacaaaactatatatttaatattaagtttatcacaaaactacagatttaaaatatatgatcgcaaaactatagattaagtagcaaatttattacaaaactataggtttactgtcaatttaatcacaaaactacaacgtttatagttcaatcataatggtagtgctaaggatttcacctctaaattatgtggttttgtaataacttcgatattaaacatgcagggtgatacttggtcttaaatctatagttttctgataaatttaatgctaaatttgtagttttgtgatacaatgtattaaatatatagttttgtgattgtttgcttaacatatatgtagttttgtgaaatttactctactttttttattcatgagttttggtctccactctccagttaatattatttcccatgcattgctatcagtgtatagtacatgcacgtactactttatattgtccatctagctggtgcaatatatatttactggccagagatcgagaggatcgtcggcacagtggatttaattttgtttacaaagtctgcatggtcctaatcacacgcataactagggcctaatttagcagggggccaggtactggtgcgagataattagttgtagggttgtagtcatggtcgtacggtgtatctttgatttcctgccctcctgtcgccccacttagatatatcattacatggtccatgcatccacacacatctctgcatcatgcattcgcagtacgtactcgcctccaaatatttctccattgaattaaccataaatgatagcaaagtacgtactcgattaaactcgaattcgaatgcgcgtgcatatgtatatatatccacgtacgtaccttagtttgcgctgaaatggaaactaaacttgttgacatatgtattggattatttagaactcttaatatcatgtgggggtacatatatgtccaaatcaatggaaatatgatgtgggactcaaattaaatcttcgtctatgaactccaaatttaagtaattcagaaaaggtccaaattcagctaaaataaaaacacaggatacaacagcacgtccaagagagagctgcaattataatgcatgcgtggcccatcaagaaaagaaccgatcgacgatcgatctgctgcttaatgtcaaatatcaaattaataaagcatccatgcattaaacaacacgcattagcctttcaaagtacagaaacatgaagctctcactagactagctagcagtacactctactgtcctcttataattaaaagcactgatcgatcatgtctccagacatgcatgaatcgatcgatctgcaacttcgcaaacctctcgccatccaaacttaatttggatttactactaaccaaaccagtcatcacgatgcaaattatatcaacttacaagaaggcacagatatatcgcttcctagtagtagtactagtttgctagctagttatatatcacttaattgttctctgaaaatataaaatactccagttctgttcagcaggaggggctagtagttgagccgcaggcatgctcgatctaacggccagccacggatgcgccgagctatcggtagatgcatggtcggtggcgatcggtcacatgaggaggctcctgatgacggccgcctggtcgctggtgacgtcgggggaggcgagcagctgagcgagcgtctcgctgaggttgtccacctcctggtgcaggctcctgatgtagctgcacgtctcctgcaaaaccctcgccgccgagccctgcattcatacgcacacgcggctgtgagctcactagctacttcactcatgggggctctctctctggttgtgttcgacatggaaaggatgctatgcttaccctatgggcgccattgcgagcctgagactccgggagcagggcctgaagcttggagagaagctcggcgatctggtcctccgagatcgacgtcctcgacgacgacgacgacgacggcaccgagctcccggctcgccgtgagcgcgacctccggctgctcgacatggttgcaaattacaaccacttgcagtgcagctatctagctagcttatatagtactaatagcttagttgagctagaagagcaagctaggtgtgcgtagcttatagctagatttgatgcctgagattggcagttgcaggcgagctgagctatatataatggccgggcgccgctagcgagagcttgcttagctaggccgccgcaagaggccgggaggtggaagcggagctgggagagtaagaggagagagaggcgaggctgaggccagcagcagggagggagaaagcgagagttgtaattgtgcgacagcgagagagacgttgtgatgacttgcgagcataaatcgactaatagtcttgagcatgtgttgcggtgcgaggacgactgaggagaagctactagctgcagcctgtgtgtgcgtgtgtgtgcgtgcttctttttatttggttcgtacttgcattttggccgctggatttgtctgtactctgtactatatgtgtgtggttttctggccggccctgtgctgttctctgaatctgcactccctcccctggatctgcagatcgatgccgttcatgctagctgctgggcatcactaaatagattagtcatcgatcagtagcatcttaattattgtagcatttcctctcaaagaataaagcatccttgtagtattaatccattatctaaaaatcttgtagtactgagtaaaaaaacagttttaattttcagaacctaaaaaaacagtattgcaatttcactggcattacctagctaataatatttcgacacaatttaaatttttaacgaggctaattaagtattccatatgtacatcgcttctggttgaatttttgcaatagcgactgataagaaaatagagggatggtatggggcaagtcacagtaactgagaacgacaacagaagaatgcttagcatcgtgatgttctttttgtttccaaaatctgagagttgttttcagtacggggagagcaagtcactccgtatg

SEQ ID NO: 69153 - DNA, 6376 bp, Oryza sativa
cccccccccccccccccgttgtccatcgggatcgaaccaagcaaaatagccaaggagtccaaattcatgtttggttagaataaaggggaaaaatcgtcttttcacgtgtctaatcatggctaaccaatcgtttattagacggaaaatatgacggaggggcaataaatcgaagaaaaactagtggcatgtgcttgtggtttaaagcggagaaattttatgatattttttggaaccaatgttttttctatgctatgaatcaaattttctcttaaaaaatgggttttactctattcctatgttccgaacaccttatcgcatcccccctctactttatacatgcatcactattttattcttgtggtttgtattcatatatgttccagatgagctcttaacttcggtttccgtcgatataattatattttgcatacagtaaatttttaaaatacaattagatctgatatacacctctattttcatggatacaattaaactttgtgtacaaacatttggtgatctacacttttataatatggacctatcatgattgaacggtgcattcgctccgtcccaaaataaataaacttttgtatataaatatagaaagttgttttattctaggatagagagtaaatctttattatttattcctactaacataaaaagtttctaagttgaccgatctctcgtgtatggatacaagacagtagacatatatttgcccacgtcacaccgacgtcaacttggtactacgaagtaaattaaggacagataccagtatcactataggcggtgcggcatatgcatgtggagttcgccatctcgcgaaaagggaaacaggtgatcgatcgagctaaagagagcaggtcgagaattgtccggccggcttccaggccatgagacaacaacggcaggcatggctcctctcctgccatcggtctctcgccactgtccatctacacgtacgcaccccatctcgtaccgtacttgtgccgctctataaaccgcgtgcgtgagctatctaagctatcgtgctcgatccgcatccatcagaccctgacgaatatacacatgcctgtacacaactgaagctgaacagctccaggagtccagctgcattcgtgcgtgcgttcttgtcgctttgtcgtcagccaccatcgtcctcgtggcaataactcgaccagctcgatcaccatttgggcggtgtggtacgtgcgggcgcctagctggattgcatggagcgaaagctgcgaaaaccccaacgacactgttaacgaaagcgcagtcgtaggttgaaccagcaggtagtgaataattgtattggcaggtgtttgtgcattgcacgcctgcacatcccatcgtcgtcgttagctcccccgcacgtacgggggagccctgttcaccattgaaacgaggtatacaacgtcggtttctgcggtctgtgcagcgcgtgtatctgcgtactgtcaggtgtttgtatcctcttggtttatctgccgattgataccgttgttattgtgtgtatacttcaggccactgttcgttcccgatggttgccataccaaccttgtcgtttgtcgattccatcccgaacgtcgtcattgcgatttgcctattggactgaaacattcttgtactaatcgataccggtgtggcggtgtattaacaattataagtttgttaatatatgttgaattgttaaatatgttatctgaattttgggcatacgataaattcggattagttttctaatagagagagactacagaacgggattccgttagaacgggatattttaagtgactcctccccgcttccacgtgcgctctctcctgatacctggtaccttggatactagttggtacctgatacctagtatctttggtatcggttgggtactggctgataccggtacttagatattttaagtgattccttgctgatacctggtaccagggtactagttgatacttggtacctagtaccacttggtacctggtaccacacctggtacctggtaccttggtattgagctggtaccaaggtctgatacctaggtaccaggcgtgataaccaaaagagagagcgaacgaaggcatctcagcttcgcttgaggcggagagacgttgcgcgccgccggccgccgcggctgctgctcgcacggggcaagaccacagcgacacagcacgtggcggcgcgacgcctggacaacaccttcgagaagctcgcgtcggcgcacctccagcttgtggtggcggcgccattggtggacgcgctgcgcgggtcgcccaccgagccgctcgcgctccccgaccacgcccaccacctcccgctccggctccaccggcgaggcgcgttcccgctctccctcatgctcatcacgcccgccgccgagctcctcgccgtcactacctcccccgcggcggcggctgccggctctagcgaggcggtggggcgacggcaacagggagagctgcacctcgagtgccatctgatttgggggaggggagtgaagtaggaggaggggatccgaatgatttgggggagaagagtgaggtaggaggaggggatcgatcgatttgggggaggagagtgaggtaggaggagggatcgatctggattagaatcccgtctccacgggataccggtgtgtagattttctctttctaatagaactcgactattaagattagtttcctagtatgactcttaagtttttccctaataggactcttatatttctcctatatatatatccctcgtaaactgcacgggaggatgcaacagcccaatgtatcctctgcgtttgtattcaactcctctatagtgattattgccggtcggagcccgtggttttttcctgcaagggtattccacgtaaaattcatgtctccgttgtgcatctattttcataacattaaattgtttatatataatattgtaatgaaactaagttcaagatttctttcaaaatttaaaagcatgttaaaatgtgcggttattcggttgtatacgtggaaccaattcaaccaagtgctaactcaattttatttgtaagtgagcataagctttgagcatcattcgtatcaaaattgatcggatgaaaatttcacaacttcacttgccgcagcaaatggatcgaccaaatgatgagggaaaatattaaccaaagaagatatttcataataacatgggttgattggatctatgtcattacaaatatatcattttagataaatgtcattaatattcgtctattcgcatcgatatcatccgaatacatacaaaatggaaactataccaccgccatcgcattttagattttcgaccccaatttcttcttgttctcctctctttggccagccacaacagcggcgccgacaccatcaccgccgcacacaccggcgatggtgaggcgtggcacggggaggagcaacgccggtcatagttggcactggccgttgccttccctatttcctccctcactatcgaaccctctattattcccttactggccgttgccttccctattacctcccatcgtcgtcgttgcattagagatgtcgcactgcaccgccatcgatgtcaccctattgtcaatccccaacacagccagatatctccttgctctcactccccaactatccacctttccaccaatcatgggtcgctgatgaccagatccacgtgaaatgcttgggcagacttcgccggcgtttgatgacgctctctctcgtggctcgatctcctggtgagggggataactctcgctttgatcgagtgcgacgtttgcgacgtggctaccaaccagaacaagtccaggacgccatgcaatcgctacaccacaaacgatgtcgtaccaaccgtgacgcgtggttgatgatccctgtaatgcaaacgagagaacactgcaagaacaagataagatgcaatctaaatattgctaataggtaactaagcacaaaggaatagttgcgattgaagtggtagatctaatcgacccggcaaatcaacacaccaactattaggggctctgaatcaatagtcgccgactaatcgagcgaggactaaagacaagatgaatggcacttggcaaaattcaactaaacaaaaaccccattattttttaggatgtacaaagctatttgtagaggaaaataaagctaggtttaagtgctaattcgtggaggtggagggagacacttccgagatgggcctagtctattacaaggcccaaggcccaagtttggtttcagcaacagcactgccttattttggcgattcccgttgactcaagatgaatttggacatgagaccagatgcgtttgaaggtagcgagataagctttccacgaagtccaagatcatccaaatcggagttggtatgaagacgataggtccgtttgaaatcagtgctgtctccggaggccgaatttgattgtaaaactcattggactttaatatcttgtagatcctccattcatccaatgtattctttggcaatgttttatatttctcatgcttggttgtatgcatatacttgatggtcacatcagcgttggtgccgaccgcaccaactcttgagctccatcaacctcggcgtcttccccaagctctcctccaagaccaagctccttctcggcaataaggccatggctacctctcagtgttcgagacaatactggcttccatggtcggtggtccctccctagtggccggtgacgtgttcgcgcctagaacaatggtagctagcagaggaggagggaaagaaggagtagccgccgtccctgccgtcattgtcagccccctcccatgcacactggaactggcctctcgaagctcactgacggggagaagaagaaaagaggaggaaataaaagggtttgtgacggaaaatgtttccaatattgtgtgtattcgatgacgtggatacgaatagacaaatagtaatatcatttacccaaattgcatatttgtaatggcatagatccaattaatccaataacataatctagctactctcagcaacgtgccattgcctcgcttcttttgctatctaggtgtctattcccacacaactcgtaccactaacatctggggctacaatttatactattcttcacatttcaacaaatcttccctctttcactatttgcttccccaaattttaaaatcacttacttgttcaacaaaagaaattatagtattacttagactaaataaatatttattatttgataagctagaaagtcaatttgttttccgttgcaacgcatggactttaggctagtagtggtataaacaactatggtcggatctgcttcttgatcatccatgccaaggaggctaactacatcgttgtttacttcattaccacttttaactctattaaattaattttgatgctatcaaattttagtagaataacaaactaaacatattcatactatctctaccatacttaaagaaaatgaaagttctataagtttcctctcataaaaatactatcaaattttgaaaagatttcaaaataaatatatccaatgctactaaaattagacaatatcaaaatataccatatgtttgtaatgttgattttataaataagtcctcagagcagccactaaacctgcaacgcttcaaagcaacaaacgaggatgtggtcgacatttgaatggcttgcctgattagcatgactagtgttgatctggagtgacctgtatttgacctgtgtcatggctggaacagtacgccacttgacatttactggttttgagtagtgaattgaaattccacgcgccggctattccggctagtactgaaacggtatcgataacctcgcactaaactttacactgtagcgagttatagtgaaaagaaaatacactgtaaatcaagggaagatgcagtcgcgcttgcctcgtttacgaacgtgagatgggaaaaaaaacagcaaggaaaatgagagtaccgagtacgtacgtactccctccatcccaaagaaaaaaaaatttagatttctatgtctaactttgactgtccgtcttatataaaatttttttataattcgtatttttattgttgttagatgataaaacatgattaacattttatacgtgacttgtctttttaattttttttataattttttcaaataagtcgcacagaaaccagggtgggtttgtcttttttttttttttttgacggagggagcaggagtaggtcgtaaaggacaaggcacgcggctgtatcgagacggcaacccgggagagagccccactttggcaatcgcgagtaggcgcggcggccgcgtcgccgacctgggcgcggaacagtgcggcggattcggggcaaatcggccgcaacagtccgccccg

SEQ ID NO: 69154 - DNA, 3201 bp, Oryza sativa
ctgaattgcttcagagtaggaattgagtgctttgctctctccagcaaatgagtaaactgttctaacttgagcaattgcctgaaatgtttaaacccaattacagtcagcatgcaagtaaaaagtagcaggcaattatgtaaataaatattctttactcatttactggaagaggcaaatagagcacagtaaggaaatatgaaattgcacatcttttaaagcagctggaaattttatttccatatgacagttcaatttaataaacatagtagaatatctgtggatttatttggaaatgtgcaaaagtgatcacggatatttttgttgttgacagttgactgtccccatcctacgcctataaatggtcatggctaaccacccactacgcataattttgatactacaaaactctatccactttcagcaaaatttagtagtactgctctgtttgttaggtgtttcgcgcatgtcaatttagcagtactgctctgtttgttaggtagactatgccaacctggatgctcaagagaagtttagaaaagccttaattaattttattcattgagaaagatctctagtaaaaatcggtcactcctgatacaaatccacatgtgggatcaaatgggccactacaccaaaagttgagcacacaagtcagcttcaaagcagaaacaccataacaattcatgcagaatgttctgccccacctagttatggaatagctcataggattcccatggaataaaaatgttgaaaagcaccaaaccgcatgttggctagtcgccattcgccataagaaaacaagatttgggctcctaatcagcagacaacaccaaaaattactacctacccaccacccctaattcaagtgcaagtccaaagcacccaccacggaatgcatagattaatgcaatacagatcctaacccgaatccacttcgcactaagctgcagtggacagtacactgactagtacagggggtacagtaatagtgtaattacagtagcagtaaagttgctcacgggaatagccgtagccattattgttacctgctctgccacgacgccggcattggcataggactcccggctcttggaggtgagcccggtgagcgtgtaggcgtacaggccgccggcgaaggcgatggccgggatgacggccacgctgagcagcgcgagccgccacgccgcgacgaacccgaccaccagcccggcgaggaaggtggcgatgtagtggatgaagttgccgaccttctcgccgatggcgtcctgcacgagcagcgtgtcggtggagaccccgaacacgatgtcccccgtgcgcgcgtccgtgtcgaagaaccccacgtcctggcgcagcacggcgtccaggtacgccttcctcagcgcgatcacctgccgctccccggtgtacatccagcacgcgatctctgaaaccacgaagagataaccgcggattagatcacgaattctcagcgcccaagaaagaacgcaactcccgttgcgcgatgttactacgactttggtgcgcactgatgcggcctccacgccgccgccgccgccatgaactccggcaagcgacctcgccgccggattcggcgacacgagaaaaggacaaacatgattattgttaaatctctcctccccgtttggcctgatggcgatgggacttgtgtttgtgagtggggtggtcttcgagatgccccacaccggccatgaccggatcatgttttgcaataaagcccccgtatttcttcacaacgccccaaaagagccttggtgcgtgggagaaaacagtaacagagggtgcttgaagaaatttacggaaatacaggggtatgagaagaaacggaagctcacctgcgtatgaggaggcgcacaccaccagtccgaggtagacgaagtagagggcatactgcgagaaagagcaagaaacaggtgatgaacaccagcgatcttggacaaagaaacctcatcgaagcaacactaaaaatgattcgagagatcgcggagataagtttgataagtgggggtagtgaaactgtgaagagcacggaccttggagacctcgtcggtcatggtgcggaggtcggtctggttcttgccgaagccgttgatgaggtcaccgaacaggaggaagaagagcggcatggcggcgccgtgggcgagcgcgccaaggctccccgccgccatgagcaccaggtcccacttgtcggcgaacgtgaacagctcgtggaacgccaccgcctggtccgccctcttcttcccctcccccgccgcatcgcacccgttcacgccgccgttcgccgccttctccaccttcccgtcccccgccgccgccgccgccgactccgccattgcaatgcgtcccctcccaaccctcctgacccttcttgcagagccgagagccaacaacgcgcgcgcgcggctcacacccgcctcagcttctcacgccgccgccgcgccgccctgcggcattggagaatcacacacacacacgcacacactctccccactctccgggctccgcttcgctttcttggtggggttacagagaggaggaggaggaggaggaggggctttggttcgcctcgggcttcgtgacgtgcagggagagggtggtggtggtggtgcttttgtgttccgcgctgcggaggtcaggtcagacttcagaggaagtagggcgcggcgtcggggcgagagataaagaggaggagagagatgctggcagtgcgcggcgcggtgccagtgaaaactactcactccgtaaaaaaagagagagagagacaaacctggtttccgtgtttaatgtttgactatccgtcttatttaaaaaaattatataaaaaattaaaaaaacaagtcacgtataaagtattaatcatgttttatcatctaacaacaataaaattatgaattataaaaaaaatttatataagacagacagtcaaagttagacacggaaatctaaggtttgtcttttttttttggaacggagagactagcttgtggtgagctttacaatctcctcactgcaaatcctggattttatttacagctcaaatagcggcaggcaagcagcaagtgcagcagatcagctcttttacatgtgaccttagcagtgaccactttgtattaacaaaagaaaaaatcgagcttgagcaaaggagatgctacaactctaccatccgtaaaatatgagcagttt

SEQ ID NO: 69155 - DNA, 12232 bp, Oryza sativa
cgctgctgcgctccatgtggtgtggtctcgcctcgcctttccccttcgcctatgggcaactcggctactgaaatcagctcaactgcactgctgcacatctcgagctctcgcctttgaccgcctgtccgatgcaaagggatgggggggcgtccggccgtgacggcatccacctgcgatctgcctacggtacaagcaaggaccgcacgtttcagttttcacgatctcggcgagcttttcgggacggaggaggacggactcgctttgcttccggctacgtacatatgcgaccccgatgtcccgatggagcgtcggaccgacacgacgacgatacagtacttgacggcacgcgaccccctgaggatttcaccacacgtacgtaccggtacgggccaaaaaacttgcagctcgcacatggcgttatccagtatccacgcgaccagcatgtatggacctatgccagcaacagtaccgcctacgtgccaacagttaatattttttgcaattttacggatatattcgtagttgtagcaatgaagccattttttatcttttgttggagcaacgagcaatcagtgatgtgccgatgtgaggtagacaggtagtactagtaactttgtttggggacttaataatgtcattagcaacgcaaaagcaaggatgtgaggatttctaccctcctagcgaactagagatgatcatggaggatgggaaaagctgtgctccactagtatgcatgcgagctagaataatggtggcatcacgtgggcttaagtgttctttggacagactaatccacacattccaaaaacaaatgtgaacataacctttgatagaatgatacactctgaaaggtactcgtataatagttagcgaaactttctcagtacagaattcaccacatgtgtgttaatatatacgctagcttggattaattactacgtttgttactagtcatattgaccataaatcctttaggtagctgagcagaataattaagcagccgttttcgtaacaaatgggcatctttgaaactgacgaaagctttttttttttgacaactgacacaacattaggcctacggattgacgagctttttgaccgcccacgtacttctgatcgatcgacatccatggagttgctcatcggatttgccttgtcgatgaagatgttgacgtgttcagtgtttaacttcctccgtcccatattacttgtctttttaagtttttgtttgtcaatatttgatcattcgtcttatttaaaaattttagaattattatttattttgtttgtcatttactttattattaaaagtactttacatatgacttatctttttttatatttacactaattttttaaataaaacgaatggtcaaacgttgcaaataaaaagtcaaaaacgtcatctattataatacggagtgagtaggtagtagtgtaggagtagctactaatacacgtagtatactgtctctgttcctttctaaatgcttgttcatgttgctttccaaatgcttactgatagcatttgaaaactactccactcagtgcttcgccgcagtaaaaaataagggctacgcaaactcgggctgaaagcctgaaactcgctagcctgtaactcctaaactggattcagaatacacatcttcaaggaaaaaagattcagaacatgcacattcagggtgtgtttagttggggaaaagaaaatttttagatgtcatatcggacgtttgaccggatatcggaagaggttttcggacacggatggaaaaactaatttcagaactcgcctggaaaccgcgagacgaatcttttgagactaattaagccgtcattagcacatgtgggttactgtagcacttatggctaatcacggactaattaggcttaaaaattcatctcgcgatttcccccataactgtgcaattagtttttctttttatttatatttaatgcttcatgcatgtgtctaaagatttgatgtgatatttttaggaaaaaaaattggggaactaaacggaccctcggaaaaagggttcagaaaatttgaacaatccactgttcctgccttcctgatttgtagcatgagtagtatcaagctatcagtatcaaacatgtactaaaattcagtagactagtatttctggttgcagcaccactactgtcaaatcggaggcaaaacctcaagaaaggcagcgagtgagtgagcaaaacaacagggcctcagtgctgtgttggtgctttgaggattgctttggcagcatggccagattgcagaaatgattggagcagccgcatccatcaactggtgttttcacaaaaactccagatcacaaaaaaggagtattatactcgtacggatcggattatatattgtgtttgtcactcgaatcgccagtgcctcgcatgtttacgaggactagctcatcgtcggcacgctttacagggagaaacaggtgcctgctaaagctggtgtgttttttgatctctacctttttcttttcatttcgttcctttctttcagctcatcagaggatggagatggagtaaaaagaaaaggctgtggcagttcgtgtgcgtcctggacgacacacgccaccctgtctgctgctagcctgctactgtctgaattctgaaactatatgtgatgcgatggctgtcgtcgttgctgttacatgctgcatttcgataattcagagtttcagacattatcctgaaagttcccgtgccacaatattcaggacggtttctgttcatgctccagaacggcatcaccaggtgcagataatgaacagattacaattccttcatgatctgtttttgtttggaactttggatagctgcggaaaaaggagatgcgtttcggaacctgcagcgaaatgcgccgagatgttgggcacatgcttgaattaaagcttggtaatttttgcgcaagttggaagaatatcaggacagttttcagtgatgtatacagctatgtattctttcgtgtataatgcaagaggacagtctgcttttaagctaatcaggtccatgattagggtttgtgggaggcatgatccatcactggacctcaaaatgcatgcttagaatatattcatagctggtccctgcagattcatgtagaagattaagcttaggcaagaaagggattgtactagactgaataagaaattgcccccacgcacgctagtaccatgtacgtatcctgcctagcaatgcaaacactccaactactacctcgcatctgcttaacgagcagaaaaggttagggaaaagcaaacaaagctccgagctgtgacaccgctactaatcgcgcttttccctacccactagctaataacagtagcattgccattaactaatcaactgtattcaactgcactatctgagttagtcacacatgcagtgaagagtccagaacatgaacccaggatcagggggcaaaagttcagaaatgtcgagacaatcagtaacacaatatctctgtaatttaccctggtagtccctagctacaactgtactgtcccactattaacagtgccataatactcctagctctgtaaaattaaggaagagtgaagtgtttatttcactgtgctcgagatcactatgcatatgaggcaagtgcgtgcgtccaacttgcttggggggtccgccgtttcgtgctcgcgaggaggagctaggcgtgcctccatagttgtacttctgcttttccgatggtgcagctgagaagattgagagaggagaggagaagaaggatcagtgccctgcatgattgatggccctgtttgacgcaacatgtcaccttgtttgtcgagactcaccgtcctcggattcatgatcagttcctgtttggctcctgctgttcaggcagaaatgtactactgccactcggatctttggagcgctgtgctgtgagtgacctgtgtgagacagtgagggggtagcgagcgatgcagattctattacaatgatcatcaggatgtgatcatgcgagatgagctgctagatgcaagtgctactgatcgagtagcctgctggtactagcttactgttagtcacactactcatgtcggtgaaacggggcaaatgtgcagcagatgtaatagcggatggtagcagtcgtttttgatgtctttatcttcatgtgccttttagactgatcttgctgcagtattagttactacaggtgatgccaaatcaactgtttgatataccatgcatgcatgtacctgtgattcaataggagataccactatcctactggaaaagttcgcacgttatatcgatataaagtactgaatgcccatgtgaaattcttcagcattgcctttctgaattctctaaactgtcgaaggtagactggaggagaacgagactgataagtatgctaggatgcaaaatactaataactgaaacaacaatctgcatgatccattatcaactcatcgttagcaggtagactcactaataatgagagcatagtttcagtctttcagagacagctacaccaaagagaaaaacagaagaaacacacccatttggacatctctgaattcgtctgttcatctttaccaacttaccaaaacataatcaacgcatatatatctctctttgcatctgtactcatcgaatcttaaagatcagccaaacatatcgagtttcagtaaccaaagcagaaggaaacaacagctacaggacagtttctccaaacgaaccctattaatgcaacagcttcctgtttcagtctgtactctgtagcagatgtaaaaccgatgtaaccactcgaccgtacaaggcccagatacggtccacccccggcagttcaagtgggccccaaaatcctgactctctctctctcccagcccggcccaccagcacactaaatgcaagcccaggcagcacggccactggtccccaattaatgcgcacgcgcagatggtgggcccgcgtcatagtcaatgaccccaccggtcagcccgtggcgactcactgtacaccgcccacaggaacgggacccacctgtcggcgtgaaaggactcgtcgaaacggtgcagacggggagagccgagccagtaaaggcggctgggtcccaccgcgccatttcgaatttgcgagtagggtcacctcccaccgggtattgctccgccgtttacgctccgaaacgtttcgaatttccgaggtcgcgacgcggaaggtggatccgcggtgagagtcacgtgggtggtgaccggaatcggggtggtaaaaatccaaaagcgaacgcagcgcaacgcctagctcgtctttcgtctctgtgtgcgcgtgttgtttttttggcttctttttcgcttgccattcgcgtggaggcgtttcgaaaagtttgctcggctctccccgatcgagagagagagagagagagagagagagagagagagagagagcagcggaggagatggcggcggcggcggcggcggcgaccatagggatgatggacagcgcgtacttcgtcgggaggggggagatcctcagctggatcaatgccaccctccagctctccctcgccaaggtcgaggaggtaagggcccccccatttctttccttcccccgcattcgatttggttcctcggatgaaaccatgaaggcgtaggggtctgatccttttgcaatttaggagtgggtgtgtgtggaacttgtggttgggctgggactcggactgttgtgtgctgatttttctgggattttggtcgtgttcccctgcaggcggcgtcaggggcggtgcagtgccagttgatggatatggttcaccctggggtggtgccaatgcacaaggtcaatgcttcttcattcctgttgttttggatttgatcgatctgctttatgtaatgctgtataggtgccttaggcggttctgatgctttattgtcatggggtttgcaggtgaattttgatgctaagaccgagtatgacatgatccagaactacaagattcttcaagatgtgttcaacaagctgcggttgagcaaggtattggttctggcctcacaaatgagtgcttggcgtctttgatacatgtaggttttcatgatcacgcccttgcggctttgatggtttcttgagattctaaatttatggtatcaggagattttccattgaagcatgcctgttagtgacgttagcatagtgagatgacaaaaatattcatcatggactaaatttgttatgcaatattctgcggtactgaaatcagattgatgttgtgcttaacgacaagtggaaatgaaaactggttaagctcttttttgtgtagagctgtagtgtgtatactgcaaagattgattttgtgaggcatggatacaaaatgtctcatgattcatgatactggttatatcttagtattgtgcagcaaaaggcagcaatgtattctgtaaccgtactatcattaggatatggcaatgtgattaggttgtgttattatgtagaatgatggtggactggtgattgctttcatggtttcttatctcaaaattagtgcacgttgaagatgtactgttgttgtgtttgtcctattttcactctatgtaacaaggtcattagattagacttgtgccacaggatggcatctgattgtgaggcctttgttctaatgcttcatctgtgtccctctgcaactatttttagatcatatgccccatacaagctgtttgttctaatcaacagtggatgttccgtgcagaatattgaggtcaacaagcttgtcaagggacgtccattggataacctggagtttctgcaatggttgaaaagatattgtgattctgtaaatggtggaatcatgaatgagtatgtgccttggttatgctgaatatgtaagataattgcattctgttgctaattatggagttgagatttgagaaggcttgtgttcaattttcagaaactacaatcctgtagagaggaggtctaagggttgcaaagaacgcagtctcaaaggttccaacaagtcgtccaaatcactacaagctaatagattgtctagtgcaaattcagctgatggaggtacattgaatttgtttgatactatgtgcatcactaaagtattaataagtgagacttcaagtgtgcctttatggttcataggagtactttgctctcatactgtaatgattaaatcaattcaaggccttaagagaagctggatggtgccaccagtctctcatctacttaggagtgttttaaaatcaatgctcctttttatttggtaccatagaagcatgattcacttgtatttgatctcatttagtaatagctctatttttgcccaattaaacaggtccatgcgttggtaaagtcaatgttatctctgaagagcattacatagaacagattcagcaattatctgagaaggtatggaccatataatccaagtagctgattcatcttaataatgcgacctgcatcttttaaagtttcttctaatgtcaaaagcccaatgactattctgtttgactgttgtagctatccacttctttgaagttcagtgttctgtagactgtagttgtttacattgatattgctacctttaatccacattctaatcatcctcgctatgtagcgtgttagggtcatgttttgcatcttcaatgctaagtaaattgcaaacttatgagttttgataatgcgaatatctctattgagttgcagattgcaggcctgaaaatttctatggatagcgcggagaaagaaagagacttctacttttctaagctgcgcgacattgagatactgtgtcaaagaccagagttggagcatcttccggtaagtaattagctagggatcttccagtattgtgcctgtttgcgggcgcagattaaggctaataatttctgaggtcctatactcctattcattgaccaaatagtttcttttctttttggtttactactaacctgatgaatattgtcttgacagatgaccaaggctgtacagaagatactttatgcggctgatgcaagagattcgccattgcctgaggctaatgaaataatcacccggtcaccaagcatgttcccagatgaagcctagggagaaatggcatcaatacactcttaagctatatttagataattttgtggctatcctattttgtcgaatcgttgtaaatgagtaaataacgcttgacattagctacttgtggcaagtccaccgaagatatcttcggttctgacttgaatgtcaacttcctagaactagttgtgaactgaatatgcattagcaatgctcttctctcgtttctgatctccttggagatattttatggcattcgacagctcgtaacttgctttttttctggaatggttatgttggattatttatcttgatgctccacgtttgattttcattttctctaaaatgtggacccattatctatggtctattaacaggtgcaaattttacaaatccatgtaactatgaaacaacagaagtgaatactagtaacagctatacgaggaaggatgagtatctgtcacagctatacaggaatagcgaaaaaacaaaggtgagtatctgtaacagctatgcctatatccccatacgaggaagaaatgagtatcaacaaaggtgagtatctgtaacagctatgcctatacgaacatctggaagaaatatgagtatctcggagatcgaacatactgttgtcgctcacttgctctacatactgttgcggttcacttgctctacgtttgctgcccaattgctcctgtagtgcatcatgttaattgctgcattgcccaattgctcctgtagtgcatcatgttagttgctgcattgccggtgcctagctctagaaaacagaaaggaaacatttataattaagtaaacaggagttaataataattcatcaggagttagcaataattcaccatgagttaacaataacaaacaaaatagatataaattaaggctaataccttgtcttgagtcttcacctccttagcctgcgacttcgcctcggcctcacgaggctccggaagcttctcagattgcgtcttcacatcatgggactctagaagcttctcgaatttcttgatgagatgcgagatgatgccatctaactcttcgctagctttgaccgctttgtacagcaatgttgctacagccgcacagaacgtgaaaatggtgaggatacagggaggaatgcgcatggatcccttgatcctcctttctacagcttccttgaagtaagcagtctgccaaccaccgatcagaagaaccaataagcttgagagtaaactaggatctcctgagaatctctcctggactaatttgagaatccagcccaagagggagagccgggtgttggggaaggcgctctgggtgttggggaagccggggacgcagctacgaggactggcagtggaggcggtgcagggaagcgcggaggcggcgccgtcgatctccgggagtgccgagacatcgtcttccccgtcagtcctgcgcgcgcgcaggcgcaacacgtcgaagtgggtgaccgagttgatcggggtaaggcggatggccgcggaaggagtcgaaatctgcttccccaaaacgaaatcgcgtgacgaactcggcagaaatgagatgatggtggtggcggaagaggattggggggtttaccgaacattccaggcccggatagcggagcgataccaacgccatggccaccgtcgcggggaggcgagagggcgcggtcgccatggggacgcggtggggcatggccgcaggcaccgaggtcgcgccgcccgcggggaagcggagcgtcatcgccattgctgtcggccagcgaccacggggagttccgaaactagggcttggccagtaggtctctctccggcgcggacgcggcgaaatggcggcgcgattccgaggtagaggacgacacccacttttataggtggtgattattgattaaccagttggttattggcgaggcagcatagattacgtatcctccaagtagctgatgattaagccggtctaagttaactcttgttggttattagcgaggcagccgtgccctgaatttgcactgcggcaaatttggctatatgtactgaagtgatcagaagtttcagtgtacatgctacctcatgtagattcagtgcttcagaaatacgcaaaacaaaacaaactattatcatataactaattgagtatcaatcattttaaatttgaaaatgaactaatacgattattttaaagtaactttaccatataattttttttaaaaaaaattatactatcatttagtagttcaggaagcatgcttaaaaaacgagaggagttttcatcctaacttgtcctctcgaactcaaccttataaagaatgttatttcattcagactggagtatttaccagtgtgatgagaatgaatcagataagggttccacttgctagaaatccttaaaccagcttataacatcaaatccagacatccagattgcccaataacacattaaaattttttaagatactttcgtgattcatcaacacaggcatcatcctttttattattattattttgagcaaagagtacagccatcaaaatttgtgaaaagacaatcagttactcctgcaaaacatatatagcatgctatcttcattaaatggtcatattagatattcagatatccaaccttacatttgggtcattgagtctaccagaatactagttaccatctaaaatagaaaatagattacaatgagtgattccagtgaatctgtgaatagtgccaccagcaaaccaaaccaaacgactataacttaattatgttgttctagttttcttttttccatttgcatccatacataatgagaccctttgccacttttataagaccacctttgctttgcaatattctgtaaaccccaagccagaagagtcggatatagttggtgccaaccatctcatagtagacggttcggaagtatagttggacattaaggaacctgagataagcagataattgttagtacacaaagcaatgaagacatttttctctagggaacatcaaccacagtaaacaaggatctgtaatcagaaattggttcaatagacagggatcagcaaccctttacccatcccaaacccaattcacttatttaaagtttaaaatgaatatgtataatcctgaatagtcacaatttgcaatataaccctcaatcacaattacactaagaattagtataaaactctacaattcagaggttcatgccttctttgtcaatgaaatatacagaacaggaaaagtattccggtgatatgaatgtggtaacagaaaaaaaaagcttgattacttatatacgaggcatgcttatcgatgataatcaaggttaatatactaaaacactgaccagatcaatcctgcaaggacgccgtacgtgccctgtcataagaacaaaaaggcaaaaacgttaactagtgaggcttgaagcatatttgaatgggatttgcatgtgcctgtttgctgacgagaagtgggtattttatacctgataaccacggctatccttgaaagacaaaacaaataacagaactgcaatggaaagaaaaggatcatgcgctatcagcataggtgcaaacaaaccatacaaattaagtacgaaaaggatatacagtcgaacgttaaaagaaagtattttataaagcttaaattattgagcatatatgagtagaatgcataatcacgtatttcatgcacgtatttctttctacatgacatattctgcggacatagtaacccatggtaagaaaaagtcatggtaagacaaaaagcctttctgactcacctagttgtatccgtgcacatatgttatttgccctgccgttcctttgcaactctgctgctaagatgcttagcttgtagaacatatatccaagaacaatgtccacgaaaaggaatggtgtcatgttgcatagttggctaaaaccggcgataactaacaaagcacctgcaaacataacacccagagtaactcatgtacaaatcacctcagttcatctctggtgctgcatgcctgcattattcgtgttcatatatatattataaaagtgtctttctatgcagactgataagctaagagaaacatgaaaaacaggatcttatcccgtgtaagagactgaactaagggggtgtttagatggggctaaaactttttagcccatgtcacatcggatgtttggacgctaatttggagtattaaaca

SEQ ID NO: 69156 - DNA, 1310 bp, Oryza sativa
tttcataacagaggagaagtgcaggacttcgaacacaatggtaagagagagagagagagagagagagaataaatttcagaaaactccatgtttaatggttaaaattacagaaaacctattgtgacataaaaaaaagaatggtgctagaagagagaaattgatgggttttgtttttcttttaccggagaggatgccgatgtggaaactgcggcagcggaagaggttgccggcggcgccgatctcccgcagcacgcggaagacgggttcgagggggccggacacaagagcatgccatatagcgtccatctcctcccggcccttcccaggggggtcggaatccgcgagagaaaaatacgtggcgtcttcttcggacaagttctccgcccaccacggcgatccgggcagtgtgtacgagcctggagcaggatatggcggcagggcttccgagcagccagaagcgggagacgcggccgcgcaggacaacctcaagccaacgactccattgccacgcttgctgcatcgaagaaggccagcgctaaccctatcggggccgggccgcgtccccactggccggcggagcaaggcgccggctgatgggcagcatcggagagaagacgccattgtggcggagctcatcgccatgatgcctagggtcttagcacccggcgttctatggcgggtcgggggagttccaaaattaggcggcggcggcggcgggaagacgaaggggcgaccgccgaccgggcgagtgctcgatcaattagggccttgtgtcggggaagaggatacaactacgcgagcggagagaactgggtctggtccggcacgaccgtgcgcgcccgtgtccggtcgggttgcgccgtgcgcgcgcccgagaccaaccaaggatgagtggaccgagaccgaccgtcgaccgaggaggagtggacggctggtttcgagtccctccttccaaaagtataaaagtaccatttcattctttgattcttttaaaagtctatttcctccatccataattattgatgtaaaaacacgaggcctggaagatctaattaaactccagtgcaggttcaaaacttgcctttgggtgtgtgagcatgccagttgatttgatcctataatcaacaagaaacaaagaccaagaaaccgcggttaaatccataaacaatagtcaatcggctagttgccgatgacgtaccatttgtctttgagtcgatgtcatatgtagatcggtcggcagtcatgaataagaaagaactaaacctacttgatcggctgtagatattaatgatatataatccttatgtcga

SEQ ID NO: 69157 - DNA, 3860 bp, Oryza sativa
cagaaaggctgcagtaaacaaaattggatggacaacaaggtttaacccaacaaataatacctcctggaaacttatcaaggtaatcagtatgataacagcaaaccctcaagaataattactacttcctccgtttcacattataagattttctatcattgctcatattcatataaatattaatgaatctagacacatacatctatatgaatgtgggcaatgttataaagttttataatatgaaacggagagagtactaacttaattgcaagtgtgtgcagcagtaggaattgtgcttctacacatagttcttactgttcaaatgaggacaaggagcttgattaatgtgtgcaacaggctatgtgactcactcaccagacaaccatctcgcactagagatcctcctacgttggtattgcccaacctgaagtcccaaccatacagcctttctgttgcttactgcagaacaaaataagtacggttacatccacatatagtacggcttttgtttaatctgaactcctttaaatctcgttacctttttcacaccttgatcacggggtctctttgttaagttcctgcttcttgtcgatgttctggtggcagccactagagaaaaaaaaaagttaagcaaattaacaaaactcctcaatttcagttttaatggaggaaattcacaaacgaaaaatctacctgtacttccccgtcttggtaatcttaagaagataagaaccaagaccttcgagctccttgccggacttaatggcatcatacgtgaatgcaatggcggcagaggagaaaacaaaaacagaaagaacagatggagataatcggactcggtgcccaacttgatcggcaaccttcttccggatgctgggattcttcacagctgtgataagaagtgcagatacaacatggagaaacaggaacaaagtggatgtgcccgtgcccgacatggatgatccacctgtagaaatgtacacaaatcgctcaaacagggtagaggcggcggcgttgctgtctggaatctgcggcgtggccggtgcggagcttgtggcctcggtgtcgggcagggtggagatggcgtcgtcggccagggtgtcatcaccgtcgggcaagggggagttggtgccgtcgctcttgggccttcgtgctcgtgtgtgggagcggcgggtgacgacgggggaagccaactgctcgattaagaacacgcgaactcatcggtgggagaaaaggggatgggcggaggagcacgggcggttatggggcataccagagacggaaggcagcccgacgaagacgccggaatcacgaagacgccggagtcgccgccgcggggaacgaagacgccggagtcgccgccgcggggaacgaagacaccggagtcgccgccgctgggaacgaagtcgccggagtcgccgccgcagggaagcgggagggcggtgtcgccgatcgctgctcgattacgaacacgcgaactcattactcaatattcatcagtggagcgggctcgcggggcggcggtggagcagagccaccgaggtcggcaccgggtggaggcggagcgtcgagagcgacattgatgcggcgggggaggagcgaacctagggtttgggattagctctctctctctgtctctcctatggcgcggggcgcggcgggcggcgaaacgaattcgagaggtaccccgactcggggggaagacgatggcgccgcgacgcagaggaggaggcgagcgagggttttgtacttgtcactgactgctgggtcccacacggggacgggggcctgaccctctcgccggcgcgggcgtgcgatgcggcaccggacagcgtgttttggatcgatttgagccattttgggtcgatgtcaaaaggtataccaatttttagtagtttgaatagtaaacgggattgtttggtttaaaattaaatagttggcaatatgtttaatttggtataatcctataacttttttcatctaatatataggatataatttggcatccatttgacatcgattcaaacacactcatttacaatatcatcctatcaaaatcgaaacggtagtagtgcaaaaaacttggcttagttttaatattaccaatattttgatagggtattaaatcaaacaagtcctaaatacaattatggttgaagaacacactagaaccgggcggttaagtaccattctgcagaaaattggagtaaaaatcttgcacattaggatttgtgacccgactaacccttctccccagccttttaatcaaatcagatttgtcttagtgtagactagttgtgcacattaggatttgtgacccgaccaacccttctcctcccttagccttttaatcaaatcaggtttgagaatattcatgtcttgactagttgtgcaatagtctttttgagcatctttggtagttatatgtggtttcgttttcacgagcataaactatctcgtatacgagagactgagccaaagtgggcaccctagaatctttatgctaactacatgcgttcctcggtactccacttatataaatcatgatttgtaattggcatccatgcacggatatatcatagttgggttggtcttcgttgagcttagatacatgtggggaaatgagaaatcgacaacttcattacattgttctaggtgtcatttccatatccatacgtaaagagagactttatcacttttgtgagaccaccttttgtttgcagtaatctataaacaccaagccagaagagtctcatatgcttcaagccagtcacttcagagtagaccattgagaaatataactggacattaatgaacctgtgatcaacagataattatgagtacataaaccatgcaaatataggtcggaaccaaaagggaataatattatcaacaggcttcctaaggcatcaataaagagataaaaaatattctgctcaagggaatattaaccaaccggtaattaaagaattgtaatcagaaatagaatcaacaaagagggatcagcaatctttaccattccaaacacaattatattttacaatagaacacttaaattttaaaccagatgtcatttccctccagaaaaaaaaggaggtggctgtggagttggggggaagcctacttatgcattgcatctagagcaagattaacctatttaaagttcagaaggatttgtataataacctaaacaccacaggtttgcaatgttaaccttcaatcacaattactttgggaattaacatcaaaattttcaggtcatgctttttttcaatgatatttacagaaaaagaaaaatacaccggtgatgaattggatgttgccagaaaaaaaagacaactcaattatatatagagcagatttataatagatagtcaaagataatatgctgaaacactgaccagatcaattctgaaaggatgccatatatgccctgtcataagaaaaaagaaaggcaacaaaattaattagtgaggcatgaagccttgtttgagtaggtctgcatgtgtgagtttgttgagaagggggggtcatacctgagaagaactgttatccttgaaagacaaaataaatatcaaaactgcagtggaaagaaatggatatgtgcaatcagcgtgggagaaagaatacatagtacaaatggaatacatagtgaaacattaaaaaaagaaagtaatttgtagagtttaaactatatagtgtcaagtgttatactgtgtgtttagaggtattgtgttaacacttgtactctaacatgtggatcatatttgtgatatgtctttctacatgacatcctgcagatggcagacatggtaaccaaaagtcaaggtagataaaaagtatttttactcacctagttgtat

SEQ ID NO: 69158 - DNA, 704 bp, Oryza sativa
cgataactaacaaagcacctgtaagcataacaccttgagtaagtcatgtacaatttacctcgattcatctttggtgctgcgttatacgtacattaaaatttaaaagtatccttctgagcagactgataaactaagcaaaaacataaaagataagatcgtatttcttgtaagatactgaacttttgcttcaaaagtaaaaaaaaacgaaaagtagtatttagttagtcggtatgagagatgacacccatgaggagcagccaagcaaaccataagggcaggaagtgtagtttactatagaggaatagacaaacgcacaataatcgaacaatctaacatgcgagttggttttacttaaaaacaatggcgcgacgtgagaaattgttggatgtcttttaccggagaggatgccgatgtggaagctgcggcagcggaagaggttgccagcggcgccgatctcccgcagcgcgcgcaagacaggttggagggggccagacagaagggcgttccaaatagcatcaatctcttcctgcccctgcccagcgggatccaaatccacgagaggaaaaaacttctcatcttcctctttcaattcctttgcccaccaaggtagtgggggcaaggcttgcgatgcgggagaggcagatgcggcggcgcaagacagcttcaaaccaacgactccattgccacgcttgctgcatcgaaga

SEQ ID NO: 69159 - DNA, 25300 bp, Oryza sativa
cagtgggattgcaccattgtatcatgtttagttccagtatgtacatgccaagcagcaccaccagcagactgacacagtgataggcgccgaatggtacttctgtgagcgaggtgtacgagaatctttacagacggcgagccattttccactctcgtaagattgcggcattttgctgcatgaatgccggccgttgcattctgcattctcctgctgcccatttggatgacacaggacacgacccgctcgtgcaggggttgccactgacaatgccgagctatggaagccattggcagccaaagccacgtccatatcccgaggtggatgaaagaccaggcatgtcctccgtgaacatctaattcctcatgcctcctaaaccccaacacgcacaaatgaaccgaagctttttagggcactcccaaccctccacctagtgtctatagaatttattaggctgccacataagcaaaaatatgatctgtgttggcggctgtaaaatgtcgattctataccgccaacatctacataaagttcggataataaaacatctaacatagtgataggtgcttaatctcacatattccataagtgttggtatatatttgtatgcagatgataaaccccgatgttgggaggaaaatcagagtatagtgagagaaatgtgtatccatataaggaggggttgtgaacttcatcaaaacatcagtgaattaacccaaaactgcgagaaatggacagagaagagcccagggagtccacagatcgaaggccaggctaggagggcccagcccaggttcagccgaacccctctgatcactgttgatccttgggtttggcttggacgctccagatgctctcccaatgatggttgcgaggcaattcggacatttccccttacaatcgtcatacctgtcctataaatagacctcacttcattcactctcacacacacttccaagcttgagctgaattataagaggctctattgtactatattgtatactagaatagaaagagagtagagtagaagaagtcggaagaattccggagttgtcggtaatcttctcctatttttcttattctgtttataactttgaatttaatataatattcttctcgagtaatttagatttatcttgtgagaattatctcttggttagttcctaaatagcatacgtgattattgttcactataattaactgaaatatagtgattgctttggtgagttataaacactaaagtagatagtaattgcttagacgtggtgtttaggtaattgttatccagtaattgatgtgtatcccgcagtacgtttgaggtgggtgtagaggtggtgatagccctcaagatcacttgtaagtcctccctgtccgggtacatagtagagcgacatctgagaacagcgggttgccagtgcctgaagtattgcgttaggattaaaattaagctttccctagacactgtttctcactaataaatcctctctatcctggcctatcatttgcttggtgtccttggatgaatcggaggaagatctgatcacacacgttcccttggaatcgatacccttggaatactccgtaagggaaagtgctacatcggtatatctgtgcacttgcggattttatctgtgaccgtaagaaataccaaaaatctggcaaagaaattaaagaagggagagaagaaaaaagagagaaaccgtgtctcatgcacgagacggggttgggcgcaagcaccaagactaggaaacgagagaaactagcgttgggggcaactcatcgtttcttccgtccggattttcctcaagctcccgatctgctgcacccgcctccatcccaccgccatgcctaccaccatcccacgctaaatcctcacgattttttggcgtgtccccaatcctcttcgcgccaacaccaactcgtgcttccctctatccatcttgttgcctccttttttccccaatcacttgtcttctccaatctctctcgtgatagctagaatcagccaaaatcatccccaatcactcatccctgagaaagtagttctcccaagccatgtgcaaggatgaatccgacggaatcgaagaagcgtcgatccaaatccaatcaggctgccggtgaaccgaccgcccttgatccagatgccgctagtgttgtgggagccgatggtgctccagatgctactgctgttgcttgtggtgctctacgagctagtgctccaggcgctggctttcctaccgcaggtgctcatgccgccagtccatggtggcaagaatcatctcctgatagctcggaatggtatggtgcaaatttttgggtgcaaagatttaggttgatcaatgttattggtgaattaatgggttatattagactgacaactttttgcttcaaagaattgctaatatattgttgtatagctggtacttttttgcttcaaagaatttttcgctaggcttggtggcaagatgtatagctggtactgctaattacttgtattcacctgattaatcttagtcaagctcatatatgctagtttatggggactgatttttttctgaaatatattgcgcttgtatttcaccacttctgttcttgtcatagatatcataatttttttattgttttctttttcaggatgtatccaccaggtggtttcctgaattatttacagataataagatctctccatttagccagacacatccatttgtgaactatcataatgcaagtaagcttccagaaaatttccactttgttggtgcaccaattagttattctacaatgttctaaagcgataccgtcaccaactaggaggtgtgctgcagcacaaataggttcacaagataaagaaacaattgatattgaggacgatgacaccatttagcctttccgatgctaggtccgagaagcgattgaattggtcaaatgaagaagacattagattggtatgttaatcttctctgtttctttttaaagatttgagtctgtatgcttttaattttatttgcacttcattaaaggtacggtttattcttctcctaattgtaggctagtgcttggctgcacaattcatttaactcgatcgatggaaatgataagaagtcaaatcaatattggttagatgttactgctacatacaacaacaccactaagagtaaccgtatgagaaattgtaatcagttgaagcaacgttgagagcgcattaagaaaccagtctccgaattcaacggtttttatgcaagaatcactaaaatacatcaaagtggtatgagtgaagaccaaaagatggaccaagcattccagctatatgcctctgaacataatgacaagcgtttcacaatggtgcatgtagggaggatattacgacatgagaaaaagtggtctacatatttgaagaaaattaagaaggaaaaggacaagagtgtaactcctaacccaactcatgttgtgaatgtcaaagatgctccaaaacaacgtcctattgggcataagaaggccaaagatgaatgcagtggaaaacgtctgacatcagacgctatttctgttattgaccacaaactagataaattcattgaagcaagcagcaatgctgagaagatgggagaggtacaacaaagtttggcaaataagaagctagaagtagccaaccttaatcataaagcagctcaggaacaaacaaagggtaaaatgattgacctttacaaagacttactgctagctcccacaagtgatcttagtcaagaagctttggctgagagatccaaagcattggagtgtatgagattggctttgtttgctaaagataattgaggtatgtttttaatatattgttggtaaacaaattgtgttgtgacagtaccattcaaatctgaacaagtgacaattttgtcaattgtgtgaactcattttatttttctagtgcttgtttgaacataattaattatgtgaactcattattttatactgcatgttgaacacaattaattttgtgaacccattttctttttatactacaattgaatactatcaattgtgtgaatgcatcctctttttatactgcaactgaccactatatattgtgtgaactcattttatttttctagtgcttgtttgaacacaattagttatgtgaactcattttttatactgcaactgaacaccattaattgtgtgaacctatttgactacccaaacatatttatgtgtgtgtctatatatatatatatatatatatatcctctagctcacacattctccccctcccctgccttccacattctttcttccctctttactcttccatcttctctcatccttaacaccatgtcgaaccaatctgatggtgattcccctgcgcatgatgattctcttgatgaggtgagtaccatagatccaatggatctgtacccattggatcatattaggagcatactgcgtgatcttgctaatcatgtagtagcggaattgaagccgaagttgaagctctacaagatatgagacctactatgcagagtggtccaaggaggtatgttttaggccttatgaagaatcttaagggctattgaaagattactttgtacagaatccagtctataatgatacaaccttttagagaagattcaggatgagaaagcacctcttcttacacattgttgaagccctagggcagtgggataaatatttcacactgagaatggatgctcttaaccgcccagggttatctccacttaagaaatgtacatcggctattcgccaattgggaaatggtagccctgtagatcagcttgatgagtatctaaagattggagatagtactacaatggagtgcttgaagatgtgtgtgaagggtgtgattgatgtattcggtgcagagtatttgcgacgccccacggtgcaagatgttgaacgcttagtgcagattgatgagcgccgtggtttccctggcatgttagggagcattgactgcatgcactgacattgggagaaatgccctgttgcatggtagggaatgtatactcgtggtgatcaaggtgttcctatggtcattctagaagcagtagcttcacatgatcgttggatatggcatgccttctttggtgttgctggatccaacaatgatactaacatgcttaatcaatcaccattgttcatccagcaactgagaggggagggtcctcaagtgtagtgccatgtcaatggaaggctatacaacacaggttactaccttgcaaatggcatatacccataatgggttgtctttgttaagtcaatacatcatccacaatctgaaaagcgcaagttgtttgcaaaacatcaagaagggaaaaggaaggatgttgaatgtgcttttggtattttgcaatctcgctttggtattttgaaacgacctgcacatctatatgatcaaggtgatcttgagaatatcatgctagcttgtattatccttcacaacatggtaatcgaagatgagaaagacatcgagtagcttcctcttgatttgaatgagacatcaagcacatcaactgtattagaagctacaatctcgcatggacctaacctagagatggaagaagtgatacaaagaaatgttattattcatgatcgtactactcataagctacttcaatcagacttgattgagcatatctagcaaaactttaggaattcaaactaattaggtgattgttaatcatttaaagtctaatttacaatttgtgtgttgccaataactagtatgtttcattttaagttgcaatctctgttacattttagcctagcagtaccagtttagctaaatatgttatctcttatttttcttgctctaaagcttctgaattattttgatattgatttgccaactattttcttttttgtagatcaagtcctgctattttggtgctgctgtgctgctggaggaaatgctatggatcaagtttggatgctgtcgaagcgtgtggcagacttgtggttacatatgtttctttggtttgctgttgcagtgcacctagaagaactgctcatgtcatcagagactaatttgagtccaactatttcggctaccagtttgggtcctaccattttggctacctatatgtttttttcctttttattgtactgagatggatgaacttgaaaatttgctacttctttatgctcatatatgcactgatatctgctagttctactcatataatgtgatttgcactaatatatgttcatgttttgatatttggcactacagtattatgtagattgatattcaaatttggatgtatgtattgatgcgtgtcacatggatgtatgtattgatgcgtgtcacagttgatccttcgtttacatgacatgcaaatagttattaaattttcttctcttaagaaactgctatagacactgtgcattggggaggtagtgtctacaaatacatttattattgtttctctcttttagacactacctatagacaccgtgggttgggagtgccatagcatgttcacatttcattgtgattttcagtaattgtgatcggtatcccgggctcccaagttccacccagtacctatactgctcccagattaatcaatgtaccgacactaactgaaacctattaatgtcactgggagcatgctgctgccatttgagtcagtgctcctagacttttcttttcccggaagaaaggccatccaatgatagaaggaaaaaatattataataaagtttttactcccgccttatttactctatggatacttcttcagtaaaggcaacgtactacttgacaattgatgaattgtgaagtaactcagatgagtattactccctccgttccttaatatagggtgcaactgctctggaccctaataccaaggaggcgtaactattttctcgggtgacgacgcatgcaacgtttgctctgcccgtgtgcagcatgcatgcagcccttcgcatctgcctttaaatgcatgcatctgttcgcatcctcccccacgaacgaccagctattttggcgcgcgaaagaccccgcgaacgcatgcacgtaaaaatagcttggagatttggaggcatcatcaatggaatgcatcaatgaaaattttggacgcgccatcaacgaaaatttcgaacgcaccatcaacgaaaatttgaattgagctaatctaatcgccagcttgttctataaatatggtgagagacattcattccacaataagcttgtctcagctttcctcccatgattgaacacaatggcaggtttggatctaaatcaaccttttaattgggatgaagttgaggatttggagggtgaaatacttgatttgaactacgattatgtttgctatttagagaacgaaggtgtgtacggttgctgctagtgttttcttatttttctcttatgtacctagtgtttcgatcttcttctatgatctgtatgtgcttgatgatctagtttgttatatcggtcagatgaagaaggtgggcacgaagacgttgacaacacagccgcccgcggcgacaatgatgatggcggcggcggcggtgacaacgatgatggcagccgtggcggcaacaacgatgatggcagcgacgacggcggtggcagcggcggcggagacggcgacaatgatgatggcggcggcggtggcggtggagcacacgccggcacaggtaatacacttaagtgtttttttttgctcagcttgtttactggatgagcctttgcatgtagctatgcatgcacagtaccatgcaaaccatgagtaatcttgttgttgttgcttgatcgcggtcgatatataccatgagtaaacatgacaaaactatgcaaaccatgcaaatcatgactgtaatatatgcacgtactaagcatcatcaaccatgtctaggtatcaatatcaagaggaggaggcactaccctcctgatgtaaaacgaaccatatatgccaagttattagagaaatcaaatcctggcatgatgaaggagggagtgacaaagtcagttgctaatgaaatgggggtgccgttgagagttgtccaacgcgtatggcgacatagacagattggagatggaattgaagcttttgagtccaagaagaagaagtattgtggcacaaaaaacttccgtttgatcctagtgtcatcaaagatgtgccgcttggacaacgccatagcatccgtgacctggccaacgctttgcatatggcaaaagccacattgtttaggcgtttgaaggaaggattgtttaggcgccatacaaatgccataaagttcaccctgaccgaagataacatgaaggcccgtgtgcatttttgcatacaaatgcttgatagctaaagcataccggacgacccaactttcaaatctctgtataacgtcatatacatagatgagaaatggttttataggacaagggtagaccagagtttttacttgggcaatgacgaagagaatcctaaaagaacagtggtttcattgataaggtaatgtttatagcagcgcaagctcgtccaaggtttgatgagcatggcgtatgtatatttgatggaaaaattgggatttttcccttcacttactggcagccggcccagaggagaagtcgcaatagggagaggggtgaattgtttagtttttcttaattacttgaaatatgactactactcacaaccatattaatctttgttactcgattgaatgtaggaaccttggagttgaaggccatgatatcggtcacgagggacgctatccgaagctacctcattgaaaagatcttgcccgccatcaaagaaaaatggcctatcgaggaacgcggacttcctatctacattcaacaagacaacgcgaagacacacattgctgttgacgatctagaattcttaggtgcggcacaagaagatgggtgggatatatgattagtatgtcaaccgcccaattctcctgatcttaatgttttggatctaggtttttttgcagccctgcagtcgttgtttcataagtcatctccatcaagcatcgaagacattgagacaaatgtgatcaaagcatatgaagaatatccggtggataaatcaaatcgtgtgtttctcacacaacagggttgcgtgagagagattatgcgtgcaaaaggagggcaacattatgccatcccacatctgaagaagggaacattggaaagtaatggtctgctgccaataaggttgcaatgtgataagcaaatctatcttgatgcattggatttcatcaatgcatagcttaggattttactcttgtaactgtgctttgtccaacaactaaaaaaatggagtattcatgtttgatttcattttatcttcaacaaaaagaacttgcatttaaccgaactaaaaaaatagaggatggaacaatatgaaaataaagaactgatcttgaacaaattagaaaatgtgcatactctctcaacatactcagggaacattagttttgccatttccatagagacagatacaataattctagctgtcttccttgtcatcggtctgttcgagtgaatatggaacaatagtgtcgttcgctagtgaatcaataacataccgtacatcgtcggagttgattaaatgatcagcgctggccgcgagaccttcgcccatgatcgtcgattcaaccacgctgtcatcacaggtttcggcatccatcgctgtcctcgcaatcattgacgtggttagctcgctcctcctgcagccgcatgcgaacggcgtggagacaaaccattcgcgcaagagctatatccatttgcccttgctgccgcatgcggacggcggcgtcgcaaagcactcgggtacggctgagctccatttgcgcacgctaccgcattcggatggcgtggacacgaatcgatcgcgcacgaccgaactccatctctgcttgttgccgcatgcgccggcaactcctggccttcgtcttgccgctcgccgggcactccaccatcttctctgccatatccatcgctgctcgccggtgctcgccgatgtgttacaactaatgcaagtgagcttgtaaatggagtccggccagtgagccaagagctttaaagcaaccaaaagaaagaaagaggccgtaagcaacatgcaagaaatgaagagccaactccacgcattgaaaacctttgcatgcatgcgcacggaagtcgaccagagcatacttttgttttaatgctacttgcttgcatgtgcatgggcgccctatattctggtacacttcaaaaaatcagttgcgccctatattatggaacagagggagtatgtaggggatattggactcgaatttcattagttgcacctactaatatatgcatgcttgccaatagtctactaatttgtcatgctgcagtatagtatgtgcaatccgtttttcttgacggatttttttcttgacgaatctttttatttctccacaaagccgaacgtgggaatctggagatggtttggcaaagtgaccatgtcttggcgtcattttttctctcaaataatctagagacttatttgctaagggaaaggcaccacgtggcctaatcaaagcttgctagcaatatcagcattagaatataagataggcacactagttgacgcgctttctactagtggttttataaaccgtgcaatactcattttatgtgatattatctaaacgttttagaattcattctatactgtgaaaccaagttatcaggaaataagatagcattgatacattctgtttcttgaaaggaacatataatatacattttccaacctgtggtatttctatgctaccaaatcaattgccaagtaatgtgtgtcttgattgttaatttcaagtattatatgatccatcatcacctatccggctatcttatgtatctctattgtcaaagtgaacagaataaagttggtcggttaaattctaagctactgaagaaacaactttattatgtaaacatgtcaaacaatcaactgacaaatgtttttccttatttactgattaggacacactgaaattgtcacaaaggcaacataggagatacacttgatatgcggtcataggaggtatatggtctcaacccccaggtcccgtgtttaatatccaacacgctcacaatcccttcaaatcttgtgttttttttacaaaggcagcatgctttgacattcaggtcaggaggacttcaaatgaaattcttaaacactattatgttgtgatattcccctcgtccaattgtaagtgcaaccatgagttttttttgcccaaatttgatcatccatcttattggaattttttttatacttagtatttttgtttttatgagatgataaaacatgaatagcactatatgtgtgacttatgtttttaatttttttcaaataagacagacgatcaaagttgagcacggaaaatcatggctgcacttcaaatgggatggatggagtataaggccctgtttagattccctggcaagttttttcacactcacatcgaatgtttggacacatgcatgaagtattaaatatagacaaaaataaaaactaattacacagattgcgtgtaaaatgcaagacgaatcttttaaacctaattgctccatgatttggcaatgtggtgttacagtaaacatttgctaatgatggattaattaggtttaataaattcgtttcgcagtttacaagcagattctgtaatttgtttagttgttagactacgtttaatacttcaaatgtgtgtccgtatatccgatgtgacacggtaaaaaattttaccgctggatctaaacacaacctaagtgaatttgctgcttcttattagcagagtgggaaatccatatgcatttcagaagaaggttaagcatgtgatgatagagaatcaactgttgaaagcttgcttattatgttcagaaatttcacaaatgcatctccttccctgatgtataaaattactgctatagccaaagggaaaaaaaaagggccttgcactgtcaaaattttcattggggcttacatgcttgtatggctgcttggaccattgggctgcacgccgacactctatggggtcgatgagtctatcgcacctgccagataaatcacgaagcgccatacgagtcgcgagattgaaggagcgaggccacgaaaattatggcacgcgtttacatcctcgaaccgcgccacgccacgaggcagggccgtccgcccggaaccagcgttgaattcgataagagatttgtcacgctgcagtatagataggctaagaaaatttaaaacggaaaacaattttaggttggaaaacaaatttataacaaattaaatttttcattcctagtttcagtaccaccaacttgtaaagaagtcgatcatcttttggacgagtttgaggggactagatggtcactgcgaccaagtcgataactgcttgcactggaccacacaaccacagtcggccggaactcaaacaggaaggtagattgatggccgcttgtggttctaggaaatggagtgtcaactgcagctgggacaagcatccgattgcggcgtctccaccacttcaccaccttcgaaatcgacggagatccatctgaccgaaattggtctcggtctgatcgtgtggatggcgccggtctgactggtatagatcacccggactgactaccgatgtcgcctaccgcgcctgtcgccgccgccggtcggaccgcccgaatgccgccggtctgaccgccggtagatcgccggttagaccgccgaaacccggtaaacacaaatcgaagaactcttaaagtagatgatgactttattgattctctctgtgtttacaaagtgcaccaacagcactcaaccaaagctacattcttcaattcaaaattttcatttactttaaccaaacctgtagcgagaacggcacatgtagaagcatcaccaaagataatcgattcagtcttgcatgccttcttgagggaggagaaccaatttttatcaccggttgtcacgtcccaaaaggactctaaaatacatcctctaaattatgcctagaataattaaaatccgtgtgaaagcctccaacaattaaaatgtgcaaagttaaaagttaaataaggcttggaggatttttgtatatttcctaaaagcctaaaatgcgtaaataaattttagtgcaattttcagagcacaaataataattattaagaaataaacaaagttaaaatgattttataaaaagaaaaactctaaaaagtcccctttccctccctctccctcttgggccggctcagcccatctcactccccctccctctcctctccccgcggcccatccggcctctccccgcgcgcgcgccgctgacgggcgggcccgcccgccaccctcgctgacgggtggggcccacccgtcatccccttcctcccgccgctcccgccgcctcgcccgcgccctagcgccgccgccgccgcgaatcccaccgcctccagccgtccccgcgtgcaataaagaggggaaaatcactccccgtgatcccctctccctttccccccatttttccctctctctctcgcgttcaaacgggtggatttgcccccgcaaatctcgccggcgccattgatggcggccggacctcccgcgcctattccttccccgccggccgctctctcccccttccaaccctatttaaacactccctgcacctcctccgtccgtttccgcctctcgccgcccttccacctcgccggaatcgagctcgcgccgtcgctctctctctccgccattgccgccgagctccggtccgccgccgtcgtcgccccagaccacctcccacctcggcgctgcctccttcggcttcgccgcatcctcgccgacctcgtccacccctccgtttcgctcgtcgaccaccggagcgccgccgtccccgttgacccgagccgcgccgccgccttcctccgctccggctgccttttcgtcgtcgccgtcgacctagggtgagccttggaccaccgcctcgtttccccctttccctcccctctctcggctgccgctccgatgtgcccatggccgccgccggccaccataggggcgcgggcgcgccgcctcccgccggccgcgccgacgtggccgccttcgggcgcaccgagcggctgccgcgtggggcccggccgtcagccgcccgcgccctcgggtgcggctgacgcgtgggacccacggcgccggccggtgtgagcccgagtgcacccggtccaccgtggaccgtgagactgccgcgtgggccccactcccgtggacccggtccacgcgccccctcccctcggctaacgcaataaacccttttaaaattaaaatttaactgaagaaattcgcaaatattcatttaaagagcatataaacttcaaatggccataacttggccatttgaattcggaattggaccgttcaagtctctaatttttccttaagaagtcaagaacccatttttgtgctttgttcctgcttgttatatggagtttattagagtaaaagacttttcttttccgttggtcgtctagacgctgcagcttcggaagatccgctcttcgtggaagttgaagccgacgtttgggaaagcgagcaaggcaagtcacatcatccttgaacatattgaatcccagtttataaaattatgttgattaaaattattgcattatcgctttatttaaattcccgcgttattactgttttatctagccatgcctatttacctttgttatgaccttattattgttattgttattatttccttattcaccctagaataaacaaaaccccaactagtggacactctactcatagtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatattagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggatatctctaggacaaatgaaggctacacgagctgcggcccggtagtcgagatgtcatggcacagggccggtgtcctgctgctaggggttcagtcctgcctacctgtcccgggggttccggccgtaggtggggttgggtcggtactcttgtctatggctaggatgggttggaaactatgtcacgtcttccgtccgtataccgtggtggtatgtggcacgtgattacacgtgaggaagatgtgtcttgtgggtaaagatgtacacctctgatcagagtataatctattcgaatagccgcgccctcggttatgggcatgccgagcaatgtacccaagttagtgttttaattcttaaaaccagcttaacaactaaaatatggaatggttggcctgggttggcttgggacgagctgggacccagggtcgggttgccagttcggtctgaatcatcgtagaccttgggttaaggcaggttcgtgtgggttcacggccttgattaataatatcgtatagctctggaatcgtgtttacaaaatagctttgagcaactaagtgtctcttaatgctgtttactgcaaaccctaaccctttatattataacccccttgtactcccttgcatttatcctgcacttgtgggtgtgtcttgttgagtacggtggttgtactcagtcttgctcaatttttccgaaacccagaagaggaacccctggaagatgaaggctttggtgtctagctcgtgcttgccgtcaagcgcctatggtcattgccctagtcttccgctgtttcccatttgtctttgtgtgtgctgggccttcgccgcccatataataaattaactatttacgcttccgcttgataaactctgaaatgtatcaacttttggtgtaccttgcctcctgggacaaggaataatacacgcacgtaaggaacgcccgttgggttaattccggtcgtgacaccggtcatgtgccgcgaacaaccggaatccacgatccacacgttctcctttcttgccaccaaagcctacacagaagcagaagttgaagcctcagtactggggttagatgataataaaaatttaggaatccagtactgagacatacgaccagaagatccaataggcatatatccatgtgcaaaatcaattttagaattttcagaaaaattcctccgaggccggtctaaccgaggtacagcagccggtcagaccgggggccggtctgaccgcttctgtaccgccggtctgaccgatgctcagtagcaggtctgaccgcaggacctagtgcggtctgaccggtttcctcgagggaaaaccagatttttgccactttgattttgcaaaagcaatctctctctcctttttctgtttatgtgctaatctaaaacaaaaaccaacaatatgtccatctttgccacaaaaggaacaagtatatttttggcgatgattagacacattcgtagaattagaagacttagcaacacaagcaacaacaggagattttgaagaagatgcattcaaggtagacatgataccagcagatttaaacacagttttgttagtatcaggtttaaccaaaatctcaccacttctagcaccaacacctaacacaacaggaggatgtctagaattatgagcataaggattaaaatctaaaccacggttatgtgtgctaacctttgattgatccaaaatcatgttgaggttctctttaccatcagaaaatcttagcaaagaatttttcaaataagaaacctcttttttccaaattagcacaattttcacaatctaccatgacacttttgcttttatgacatttggggcaagaaagcacttcattgtttttcacaacatcttccatgtactcaacacgacctaaagcatctttcaatttcaacttattcaaattacatgttgagcaatcgaaaacatcatgaggttgttttaactttttagcagaaatcatgttaaacatcaatctagcatgaaaagcaattatatatttttacaacaactttttagttaaaaaaactcatccaaagtgcgtgtgtgcaaagcaaaactacaagcaagagaagatctatttttcaaatcatgtgcagcattaacatctctaatttttgaaatctcattcattaaaacctaacaatttgagcaattatcatcattaggaataagagattttaatctagcaatttcagatttaagagattcagtgataaattcctgttttctatacatcttctcacacttcttattttttgcactcaaaatattaatagcttcctcaaaagcacctacctcattatcttcatactctgtgtcagattcaccacgcgccatgaagcaaacatcggagatgttctttcccttatcatcatctccactttcaccatctacatcacttagtggctcgaaggcggcgcaaacttgttgaaaagccttcctaagattgtccagcttcctcccttgggatgaacccttcggcttgttgttgatgttggtcttctcaccatctttgtcttctcttttgcctctcccaagcttaggataatgcgaacgaagatgatcaattgaaccacattcaaagcaatgatttggaccacctcttttcctgttcctggcattattcatagctcgagcaattctgttagcaaccaaagccaaatcctcctcctcgatttgttcgagttgatcatcggatgtggcattaaaaacagtaagaaaagaagatttagatgaagaagcatcaacatccaaagaggaagaagaagaaaccaaagcactcgacttagaatcaacttttcgagaaagaacattcatctcatgtgttttcaattttgtataaagtgaatccaaagtcaaagtagacatgttaacagactcctaaatagatgtaactttcatcacccaaatagacatatcaagaccattcaaaaagtgacgagaaatctcatattgtggataattagcatcataagaagaatctacagatctaagatcactcgaaattttattaaacctagagagatagtcatccaaagcttctccaggtttcatctcaaatttaatatactcctttttgaaaatatcacgacgaagttctttaatgttatttcttccttgatgaaagttactcaaagcattccaaatttcatgagcagttcgaaagtgcgcaacacgatcataatccgaacgagaaataccactcaaaagaatgttgcgagctttgcaattttgttcaaaagcagtttttcagcagcagtattaatagcttcaggaatcacataaggatgagaaacttttctccaaatatcataatcttcagccataatataagattgcaccctaatacaccaatgagaaaaatcctttccatcaaaaacatgaggcttagttgaaaacttagcaggagtagccatggtaaaaactctagatcgataaaaatccaaagaagaaaacaaggctctgataccacttgtaggatcgaatcacaagaactaagccaaccagaggggggatgaatggttggtatacccaaaaaccgaaaacttttagcggaaataaaagttacccttgaaatcgacggagatcgatctgccggtctgatcgtgtggatgtcgtaagtctgactggtatagatcacccagtttgaccaccgatgtcgcctgccgcgcctgtcgccgccgccggtcggaccgcccgaatgccgccggtctaactgccgcttgccgccggtttgaccgccggtagatcgccggttagaccgccgaaacccgataaacacaaatcgaagaactcttaaagtggatgacgactttattgattctctctgtgtttacaaagtgcaccaacagcactccttacaaaaattttgactaaactcgaaaccctaactcaaaactcaattcaattgctctctaaagcgataccgggaagcctcacgctccccctctatttatactcgaggtagagagcctaaagccacgaaccaaactcatactaggagtcctaaacaccttagaaaaccctctagtacaagaaacaaactttacataaccaatcatatcaaattcggactccttccaaattcgactccgcatcccatacgcacacaatacctccatcgtatgccatatggaatctccatcaaccacgctcatcaactctagcctaagtatcccgcatgatctctgaccaccacggacgtcgtcttatccccaagccgactcccggtccatcaccgcaaatactctcccgaggcatcgagtcacctacacatgaaataaacaaagaaaccatattccgagaccaagctatctccaacttgactcattagtagcaaataacagtattacatacgtatagtatccatctagaagccataatcatgaaataatcacggatatccaaacaaataacccgaaaccgaaaacgacacagtctgaccggcctgaccgcttggtcaccgccggtctgaccggcatacacagcccggtctgaccggtcacataaaataataaaatcctgcgatcacctatgaatccaatcatctccaaaaccacttcgtgaataaattccaaataacaaaaccaataatttccaatgcccaattgttcatcacacaataataatcaaaaacacctttgattttacaatacaaacatctggctggtaggatggctacggcagtcggcagttgccttgcaacccttgaccacgggttgactccccaccaacgcaccttttcatttgatttttgctaaaaaaaaaacaagtgcggcccaaaaaacgagcctaagaactaactaggctgtcctgtcgcccattcattcaatgacttgccttagtctggtccgactgaaggcggtttattgcccagttcatcataaaacctgccggttaaagtggtctgaatcgattcaattgcatgtcctgtctttctattcgaccgaactatgccaacctctattttcggttttctccggttgaactgcctgttcggtccggttttttctactatgggcacaagacgcttcttgttcacgctggatttttttataacattgaaactattcttctccctcttccgttaatggaaaagaaaggttcataacagattacggagtttacaaagaaactactgttaaagcagataaaactagctacacttcatagccggagaaatatgctttcaataggtagagccgtactgaggcctgttttattttccaaatttttttttccaaaaacgtcatattaaatctttggacacatgcatgaagcattaaatatagataaaaacgaaaactaattatacggtaaatagcgagacgaatcttttgagcctaattagtctataattagccataaatgctatagtaacccacatatactaatgacggcttaattaggctagattcatttcatggtttccagacgagttatgaaattagttttttgattcatgtccaaaaacccatttcaatatccgatcaagcattcgatgtgacacttaaaaatattcttttcgtgatctaaacagagcggtcaacatatatcggggcgttcaacaatattatccagaacacgacatgcttgactgccatcatgcatatgtaccactactgcaaccacaactgtaagtctgcaacaagatcacactataacatgggagagagaaaatgaaggccgataaatcggtacataggctaggctgtgttcggatccattcaaacttccaattttttcttctgtcatattaaatatttggacatatgtatgaaacataaaatgtggacaaaaaaaatcaattgcacagtttgcatataaattgtgaaacgaatcttttgagtctaattgtgccatgatttgacaatgtggtgctacagtaaacatttgctaatgacggattaattaggcttaatagattcatctcgcagtttacaagcggaatctgtaatttattttttattagtctatatttaatacttcaaatgtgtgtccatatacatcaagcaaccgaccaccaagcaactatctctccaggatttctcagattgtccattttttttaaaaaaaagtcaaaatttagtcaaattcaattaaaatttgttacaatatcaaatatttcgtgcaaaaaagttccagtaatcccgaggttcacgaaatttcggtgaccactgaaatgacaaaaaaattcagccatttccgaaagtgtaaaccctgtacataattagctaatcctgtgcaactgataatgcgattttccctaattgtatctggtatataattttgtcttttttctgcaaatgcaattgcattttgtatgcaactctatcaattaatatctaatgttataaattcgttctaccaatatcgaatgatgcatttttctcattttcttctattaactttgtaatttatagggacccggagcgaacatgtatctcctttctatcctcttttggtaatatattaagatagattgtgctacaaaaccacctaatacaacaagtagcagttcctttttgctttgagtgagtaattgaaaattaaaaatatagtccaaactaggaaaagagaacacgaaatctaagatagttggagtaaaataattcgcgcaaacagtaagaggaaagaggttgaagagaagtctacaatagctggagggaggagctctccctgttcaattaagatcttatatcaagttagtcattcagtctgaatatatgttcttccgtgaacaagcaagatttgttgcttcaatcccatttctataatcgattagctgcttctatatatgcaattacatattttgcatgtgctctaattaagtgatcgatctgcaaactgagatctctatggtgagtggtgcccatcactacaatcgatcacttaggatagcttcgaggctgccgacggtcgatcgacggtgatgccaataaatcacaaagcttagtgctgaagtacaagagcctatttgatctgacagtgaagggaatcgatctgaagccccagattaattgtacactcacctgcagctcagggaaaatatattgccctctttcctaacctttttcttttttgcctaatctgttttttctccatgccacaacccgtgtactcctactagaagcgcagagttatggaagaaaaaaaatgcgatggccaaacatatcttcatggacacgtcgagtacccgatgccttctaagccctatacgctatagcaccagcaccagcaccagcatatataccagcctctcctatatatatatatagtatatgtggtaactttcagcctgaattgcagattggattaatactagacatatggtttctttacggggctgccggctgcagataggagtattgagtatcgcatcttgttagtttaatttcttcgaaaatatctaccaactgagacggaaagcgcatagacaaattttatctcggtgagataaagatttttttcttgattttctttagcacacttttcaaactattaaacgatacgtttcgtgcgaaaaatatctataaattgttttaaaatattaaatatatccatttgttaagtttgtaataattaaaatttaattaatcatgtgttaaagttttttcgttttacgtacgtcagcttaatctttatctcttcatcagtttcaaacaacactaaaacatagggatctaagccccaactccaaacgtacgaccacagcccacaggacacaggtagcactgaaaagagataaatgaagatggttctgtgaaagaacattagcaacctggaattaactcgtccccgcacttggcccgaacagtttacacttggttttgggtgagagatataactagggatagaaaggtcaattcatataccgtaaatcattggattctttctttatcatttctttaattccatagttttggacccacagagctgccatcctgactaggggcaaacggtgacttattaagggcgaaatcacgtaccctgcattttacctctaagtacaagctaaagcatgtgcgttgtaattatattataaagagtaaatttcataaaactacacgttttatggtccaagttgtagaaaaccacacacactttgacacttagcacttaattacatatatttggtagtgtagttttacaaaaccacactatcaatgaatggattcacccgcgagatgacatggttgtttcacataggacgaggacgtgtgatcctattatcagccatcgcacgaaattaataggatatgccacgtcatcatcctagatgtaacaaccacgtcatcacatgggtaaatccattcatcgatactgtggttttgtgaaactaaactaccaaaatataggtacttaagtgccaagtgtcaaaatgtgtgtggttttcttcaacttgaaccataaatcatgtagttttgtaaaatttactctattataaaaggtaaaagcaaaagtaaaaattacaagtttataaaatagttaattgattagacatataatattatcttcaagggacaattgcttatttgaccctgttttaaagcctaactaccaatatgaccctattttttttagtttgcttatttgaccctacctttttaaaacaaacactccgtttggccctttttccgtagcaccattaagtttttatttaaaaaaaagaatgaaatataattacttttcttaatgaccaaaataccatcgaacaaaccctatccttatctatcctgtctctccccgtttctcgtctatctctctctcggcgagtgccggtggcggctcgtggagggagcggccgtggcagcggccgcagggcgcggagcgggggaatccacacggcgctggctcgtggagggagggagcgacgtcggcggcctaagagcaacttcctcccgctgccctccttgtgcaacggcagccgcgctgcggtcggcggcggctcgatgaggtggaggagtggctgcgacgacagcggcatgggagggatggcagtggctcaacgaagaggaggagcgacggcggcttgatgaggaggagggtcggcagtggctcaacgaggcgaaggagtggcggcggtggctcgacgaggaggaggaggggcgacgccgacagggtggatccggcaaaggctcggcgatgaggcgacggatccggtggcgccgagacgcacatgcgatggatctggctccagcggtcggcgaaggcggcgcggcggtggcggacttcggtggggaggaggcggttctgcggggagggagggaacaccggtggcggcggcgcatggtgaggcaggcgacgatggctcgcggagggtcggagggaggattggtggaagcggctgctccgcatggatgggcttgagagtttgccgtcggcggcgcggtgtcaacatgtttttttcttttctttttttggtacacataaatctgtgccatgtatttctgtttgaggcaatttaatatatactaattagtgcacaaaactgcattgaataaaaaactttaagaaaccaggttaaattcacaagggtataaatgacatatttgtcttgagttaacaccgtcatgttgacttcatggaatagggccaagtctcatcttcattagtaaaaggaaaaagtatgaattaccccctgaactatcgtggtcgtccgaattaccccctgaacctaaaaaccggacattgctcatcctgaactttcaataccggacgaattacccccctcgacccaatccagagcggttttatcctacgtagcgtacgcgtgccaatccagtcagcatttttttttaaaaaattgtgggacccatatgtcatacatacccttcccctcttcctctctcttcactctctctctctcacggggcgcgcatgagcggcagcgcgagcggcggtgggcggcggcacgctgtgaggaaggggcgggcggtgggcgacagcgcgaggcgagcatggcgtcaccggaggcggggtcccgtggctcgcggtctgctcccccctcgccgcagccgctcctccccttcctttccccttcttcctccaggtccagcggtggtgacggcagaggggcgacggcgggagcagcgagcgtgggcagctgcgagggcgtcggactccggtcggccgaacgggatggtgg

SEQ ID NO: 69160 - DNA, 7181 bp, Oryza sativa
tccttcatgcgcgcgccgccgcggcgaagctcagttcagctcagctagctcgccggagatgaagacgacgacgatcgatcgatcaggcagctagctgctgccgaatctccgagctgagccactatccatcgatcgatattaataaggcggatttggaccaagaaaatgattaactaatgccccgattaaattaatccattggttggagcagcttctccgacatggtgcatcccgttaattaactgtcggattagttgaggaattgaacgggattatctgcatcggattaacgacgacgactagcaacaaacgaacggcacacgccaattaattaattcgtcatggcttatgataaaattgcttttacctagtaaaatttgtaaatggggtcgatttttttgatgggaaaaaaacgaggtcaatttgcttgacaaaatttgctcttgattaactttttctgcaagctatgttcgttggatggattcaccgcgtccttgtagctatcattggcatttgtatctttttctttttgaaaatgatggtatttgtatcggaagttaccttcattatctggaaaatatgatcgatcgtcgcatcaagaattgaggatgctgaggcgcgccaacggccgcacctcctatatatagtttgactgtttgtgttgtatacttgcgtaaaattagagtaaaaaatcaggggcatctcagtggatgacttaaaataacaaaaactatgtgaagtaaattaaattaacatgcaaatgtagagaagatgcaaacttggatagtttttatttgaagtaatcactatattattttttttaaaaaataatcatgtgtacatacaaagtacctttgaaaaatagaagtaactatttccagtactaaaagtatgggaatattttttcacggtattagaagtaactctaaaagtatttgtgtagcattttgttttagggttaattagatccatgccattgcaattttgccatattaaaaaaatgcttcgcgatatcagctgggtgccactgaaacttagtctattactattgggtatgtggtattcataaccatgacaatagcccctgacttcaactcaaatgaattcatgtttgtcatccgcgttttcctgtcaaagttgtcatgctcacttggtcgttctcgataataattgagaagacatggagtactcagcatcattgaaacaagatcaacagttcataagtgaatttgaattgtgtctaaacaactaccataaacgagcctgagaaaattttggcggcaacgcatatgaacgagttaatgttctcaaccgaagaccttcgaacaacagtcacaatgctcgcttaaccattctcggacgatcgagaagatacagagtgtgcgactaaatttcttgtctcgccgtaatcgagaatttgggttgaagtcaagaatttttatctcggcgggtacaccatcgctacattccgtaatcttcgtcgaactccaccaaccattctcgagtaatcgagtaattgtataatctgcgacaaaaccctgaaatatgacttttctgaaatcaatactcagaacagattgttagatacaaatggtctccaagcgagcactcaagggtaacacaatataatatgaatttaaaaattgaaaataaattgaatttacatgtgacaataaaagagtattctctctaaatctgccctcagcaattggagtatggtacccttcctagctcccagctatctttatggaaaagtcgtttttccacaaaggcaacttaaatcttataacaaaccaagctgaagttgacgaaatcctagcccccaatcgtgaagttggtaaagccaatttccgattacacggcttagttaatacgcattcagaacagcgtaaagggacgaaaggatcgacttcaagacatggcgatattagaaaagaggatcaatagataaatattgcatatacaaacacttatagaggttgtcggagaatccatctcttgaacccatctcgtttaaactttgaagcaccaaatttcctctacctggcatgccactgtcgactactattgggtatatggtatccataaccatgatacataagtcagtacaatcttcttcctctatcctcccctcttctctctatcctatcttcatcttgttttcaaatgtgactgacaacgaggagggcgttggcaagggaggaggatgagcgaaggaggctgatgatggcggattgccgctgatgggaggtcgacggctcccgagctctaccaccgcggatgggagaaagtcgaagacgatggcgacgacgatagtagctcccgagcccacccgccgaggatgagaggatgtcgacgagcgacggcggtggctctcgagccattccgccatggatgggaggaggtcaaagatggcggcgacgacgacggtgaggtcgacaacggcggtggctcccgagcccacccggatggttggaggtcaacgagcgacggcggtggctctcgagctctcccgccttggatgggaggaggtcgaagatggcagtgacgatgacggtggggttgacaacggcggtggctcccgagccctcccgttgtggattggaggaggttgacgacggcggcagcaacggcggtggctctcgagccctcccaccgtggaggtggtagacgacggtggcagtgatggtggtggaggatgatgtcggcgaggtggtcaacgacggcgccggagagagagagactagagaaaggtagggaaaagagaagagagggaagaatggtgaacaagatggaactgacagctagatcctatgtgcagttgaggctaacggagattttttacagatttcgtaacagagtggcatggtttcaatttcctcaaattcaagtggcgcgtagccgatatcgtgaatagtagtgacattatctagatcgacatatttgcaatggcatggatctaattaaccatttgttttatagctggtctctctggcatgatttggcacagatattagtgacggtggatagttttgtaaaattctgaatgcaacctgcatatatgttctaaatgtttacttattccacatgaattagatatgcaaccacaaaaacttacctatgttttcttttggttgctgtggttggtgacggtttttatattttggatgcacaagatgtagccagcttggcgtagatgggcacaaaccacacgcagccgtaataaagtgtagttctggaattgagacggtaactgctgcgtccactatgacgtgttctgttcggaggcctcgattccaattcgaaggtttcggaatctgaaatggcggcggcggcggtgcgggcggcggaggagcttgcggagagggagatggcggggcgcgacgcctcccacgacgccgcccacgccctccgcgtccgcgacctcgcgctctccctcgccgccgagctcggcctctcctcctcccccgaccgcctcctcatcgtaacccgccgcttcctcctcctcgctttatccgttttctctcttttagattttgttgtgatagactttgtggttgattgattgctgcaggtggagatagccgcgctcctgcatgacatcggtaagttgatgatgtttttgatttcattggttttgtgtgggggagagaagatgccatgttttttttttttttgctaattcggttcttgcaggtgattacaagtacaccaagtgaggatacttcccccgttgctcgttgatttgtaattcagtaagcacgatgatcgcgaggaatgctgcggcggcggctgcggcggtgttttttcttttttgtttacttgctttcccttccgcccccaactcgaacacgttgggggctccggcagcagattggggctggatctgtgctggacggcggcggccgctcgttggcaacggcgagcggctcgggctgcacgcttcctcgtcgacggcgggctgcggccccgttcgcagtggggcgatggccttgttctgctgctgccattgccggcccttgctctcggccccctcccagttcttcctccccttgctcgtaggccctctttgtttaggcttaggcttattggctgacttttaagtcagcttattggtttatatgatttttaagtcggtggatttaatgtcctaagtttagtggtggagtcatacatctatctcacataagctaaaaaaaacttctccaacctagcttttggcttgagtgacttatggcttcaaaaaagccaattgaaaaagctgcttatttgtttaggcttaaacttttcggcttataagttggcttataagcctaaacaaagagggcctctatagctcgtgcctgaggtgcttggacgccatagggttgatgcggcggtggcaatgccaggcattcatggggacggtagtgtgtgggtgggaggaaacagatcccctgactttgtgaaatctgcagttgtgccactgacatgtgggccccactttttcgcgatggctcacatgtcagttccacaactgtaaaatgcaaaccgcacaaagtcaggggagtctctcgttcgcgtgcgggatggggtgttggtctcttaagagttgagaatgagatggtgtagtgttgatttcatgcggctgcgttgatgttccgtgtcgaggagtatggcaagacttccttcgtcatggtgttgtttttattttcttgtaacccgtttggatttttactctgcttgttgaaatataattggcagcttttctgcctgtttagttttttgaaaaaatgtttgttgggtgagtggatagggacaatgctgaggatatgagcatcgtggagaggtttcttgaagaggtggaactggagcagggccagagggaggaaattgtggcgatcattaaggggatgggtgagttcttcatgtttatgaatctgtggatgaaactatttggcaaacagcagctggcttgagcttacttaattgttcatcgaacttcaaagccatataaatcttatagtttataaaatccgttttttttcctgtagtacaatcccattatgataatgttgtatcatatgaaggccataagtagttcttagtgtatccctagttatgcaatgcatacgttataacatctcaaatcttatgtgcaggattcaaaaatgaagtttcaaagaagtctgttgttgagcctactcttgagtttgcaattgtacaagatgcagatcgtcttgatgcaattggtgcaattggcaagtactgcataaccgaagtttctttatcagctctactcaaacaaagtttccttcaacaattaggatgcagtaaatgttgcactggttatgcaaaatcttttccatgcaccatcttgttttttccccttcttcctttggactctgatggcataaatttatcaagtgtttgccactttgcctcatcatttagtttttcaatattgactagcgcacatatatcattatttcttcctctactgatagaagtacgccacaatctttttcttggttttaataggactgtcacatatgttttattgtcctgagtcttatgctcttacttatctcagcagttgtttccaaatatcatgagtttataagttactgtacctcttaacttgcttcatatgcgttcatatgctaattgcactttacccccttgtcatatgaagctgaattgaaattactgataccacacaaaggcaggatatagggaggaaatttttaggtagcaatgatcccctgaaattgtagacgagcaagaaatagggagagataaaaataagaaaacatcatgtactgttagtttgcaagattgtactgtctaccctgtcctgtccaggtccaagtgtcttccaacgtatgctgatatgggtaatgggctaatgggaatcctactatgtctgtttcaattgagaaatgcatatgctttgactgccttttttggtctcatgtagtatgaataaatgctctgtgttcgaatctttccctaaaacacctgcaggtattgcaagatgttttacgtatggtgggagcaagaaaaacacattgcatgatcctaagatactgccgcgtgataatttgtcaaaggagaaatacatgtccaaggatgaaaaacagacatcaattaatcatttccatgagaagctatttaagttgaaggacatgatgaagacagaggtaggtgatgagttatgtagacatgtgttcttaccgctgtcctagttgaagcctatggagaaagcattaaatatttggacctattgaactcagtactaagagtagtagatctatgttgggtcttatcttcatcaatttacacgtgttaagtacatgaaagaaaattctgcttactgatgctcatggtatatcttctgatttagcatgcatctgtacattggcgaagtgtatgaaaagtggattctgtgtactagtcatcaatactccctggagattcctattataccttctgatgggctaataatcactcattgtctttactttattcaaattattgagcatgcatcttaataccatgtactccaatttacctagtacaaacattccttgtagaatcccattatctcttcctttggcgttgacaccatttcactttgtgcataggccgggaaaaagagagcagagaaaaggcacaagttcatggaggactttgtggctgaattctatgaagagtggagtggcagagcttgaagttgaccaaccaggttatgggctgttggtctgtggcatagcttgaagttggccaaccaacaacaactcatattgctagtcgtctacttggtgacattagcatgttttgttgctgatatgttaagccatgcaaaaaaacgagggataaagcacacttgagtggccaaaccactgaataatgctcctcaacaggtactttgcctgaactctgatttttttctggagcacctgtgattgatgtacatttgatcggcagcaaaaccatcacatcttgcagttattgtgttgaaacagccttgctaaaaattattagtaatatcatcttaaagtattcctcacacgcatatacattaaattctataggcaccacacttggctacagtacatattgctatttggacaaaaaggaaacagatcaaatactagtacataacagcaaacttcaaatgaagaaacaaatgcagaaga

SEQ ID NO: 69161 - DNA, 9482 bp, Oryza sativa
tttccactcgggaatcggtaggggttgcagcagaccagctggcctttgatgttctgccttgactctttggcaaacgtcacacagggctacgtattctgcgacatctcgcttcattccagtccaccagaagtatgccttgatatcttggtacatcttcgtacttcctggatgaatggaataggcggactcatgagcttcctttaggatgagatctcttaactccttcttggccggtacacagatgcgtggaccgcaccaaactgtgccttggttgtctatggagaaattggtgtctttcttctcctgtattctttttattaattcttttatcccttcgtcgtctttctgagcctcccggatttgcgactctagggtaggctgtactgtcaaactggcagggacacctggctgtaccatggtcagccttaacttctccaattctctgcacaggtgatcttggtcaggccgtatttgagctacattgcaataggccttgcgacttagcgcatcagcgaccacgttggctttaccagggtgatagtggattctaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgccttgatgcatcacagaagatcttgaaatcttttcggatatctggcaaggtgagaactggggcagtggtcaaccttttcttcatttcttggaagctgtcttcacaggctgcagaccattgaaatttcttttccttctttaacagctcggtcataggtctggttagcttagagaatccttcaatgaatcttcgataatatctagctaagccgaggaagctgcgaatctctgacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgatgatccctgagcttttccattatcaacctcaggtgttcagcatgttcttcctcgttcttggagtatattaggatgtcatcgatgaataccacgacaaactggtccaggtattccatgaagattttgttcattaagttcatgaagaatgctggagcattggtgagtccgaaggacattactgtgaactcatatagaccataacgcgttgagaaagcggtctttgggatatcttcagatctgattttcagttggtggtaacctgacctcaagtcaatttttgagaaaactcttgctcctttaagttggtcgaacaaatcgtcaatccgtggcaacgggtacttgttctttatagttacttcattcagggctctatagtcgattaccattctctcagagccatcctttttcttaaccaggagcactggggctccccaaggggatgagctaggtcgcacataacctttactctctaattcttcgatttgtcttttaacttctgctaactcattagctgccattcggtagggtctttttgcaattggtgcggtgcctggcgccagttctatggcgaactcaatctctcggtctggtggcattcttgttaattcttccggaaatacgtcgggatattcacaaactatgggcaccgactccaaggaggtgacttgtaaacaggttaagatagaccgacttgcggtaggagtgttaggggtaaagcggacttgcttttccccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgttaattttgggttttccaaccatttcttttcacaaaagcttgtgatatgaaagaatgggaagctcccgaatcaaacagaactattgcgggtacggagttgacagagaacatacccatcacaacgtctggagcatcctgagcggtttcagcttgaatgtgattcacacggcctcgaccaaagtggttggaagcacgtgaaccttgtccacttgcctgagtgctaggacgagactgagctgccgctggagtaggagttctggcagtgctgccattagcatgccctgagttggtgttggtaggattctgagggcactgtctagcatagtgacccatctggttgcaccggaaacactgaattgctgacggtccctgtggtgacttgaaagaggtaacactgtttggcgcagtattgccactaggggcacgctgctgtggctggggtgccgggcggttcatctgaggacgaggggcgtagcctggctggcggttagcctgagtgaccgactggtggtattgcatgggttgaccgtagcgagggcgaggtgcgcctcgggaggaattcccttggtggttagatttgcgtttcttgtattcttcggtagcctcttttctggcatcctcaagtagaagtgccttgttgatcatatgttgaaaagtggggaagtcatgtgctagcaactggagtctcattccaactgcgattcctttcaagaatttcctgatcttcttcttatctgagtccacttcctcaggggcgtaccgagccaacttgttgaacatacttaggtactcattgacactgctgttgccttgcttaagtctattgaattcctctttcttcatgtcaatggtgctttcaggcacatgagctgcacggaaagccgtggcaaactcatcccaagcaatgctagtgggttcagggtgtgcattgcagtaattctcccaccaatctgcagcaggtcctcttagctggtgagaggcgtagagcgtcttctcgactggagtacactgcactaagttgagttttctatcaacatctttcaaccaatcgtcagcctcgacgggctcgacggtctgagagaactctggcggacgtgacctcagaaaatccgtcagcttggatctattgttgcccatgtgagggtggccatttccatgagcattatgctgataaccggctacggctgcggctattccttgcaagatttgtgtctgaactgccattaagtgttgcatgttgttttccacatgaggtggggaagggaggcgttcttctccagaattgtgactggcagtgcggtgagagcggtgagactgttccatctctgcatcacgggaagctgtgcgatgcgagcggttgctacggcggggttgctcaacttctgcgttgcgggaaacagtacggtgcgaacggttgctgcggtgagactgctcattagctgattcatgatttgcttctggttcggctctaccttcttcaaaaccgaagcgggctggcgcacgagctgcacggcgggggcggctagccatctaaactcccagaagagggcggggtaagagtcagataagcacttagggggggcaaggagcaaagtaaatagcaactcatatagcacgcactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctaacacacgaacggctgctgaagactgcctcctctactcctcgtcggccgggctgcctcctgtagtcggctcctccgtcgaagaaacgtcgatcggctgacgcgaagggaccggcggaacctgtcgagggccggcagcagcgcgggccgctggcggtgggggagctgggtggtggaaacggaacacggtggaagaaccaacaacacgcttccgcgcagtgcggataaagcgtggaccacggcgggaggaagcaactggggtgtgtccgggggtgtaggaagggctaactgggtgtgggtagggggagtacactggtgagtacggcgcacgcgagctgggggagcgcgggccactgggagtgcaggcagagccgcgggagctgtgggaggacaggtggctggcgtggcagaggcggcctgagtcccaggagatagtgtcaactgaggtgacaccctcctcggccagacgggcctccaaagcggtgtagcagcgggccagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggaaaggtcctggtacgcgatctggagagtgggcctggccacggtgaagtggtgggggcgaaggccagctccgtgtataccttcacgagggtagaggtacacggagagctcacagtgagggggaacacggtccacggagtaccccgtgtactcgggacacgagaagccaaggaaacaggcgaggtcacgaagctgagcgacgtggtgaccctcactaaaaccgtgggaactgaagctggcgttcactgccatctacaattttgaaagagggagaaagatcagtaaccattttagaaacaaactattgaaaataaagaaagcagaagaaaccttagcttttcgcaagtagttttgaacttagtatccttagggtcgtcctaagcgtcgggtttcgccctagggccaagcctgtgctctgataccatctcttgtcacgccccgaactagtaccgaccggaactagcccgtgacgctccaaattaacctgttaatcgataccagtcccaggaaacagtgctggtatcacaggaagacggattatcacagctacagaagtctctttattatagagtagaggtagagtcatgttgggctgcggacagatcccgagctcacaactgcattacaaaagggaaacggaagccaggacttggaccaaacaacacaggcgcgacttgggaactaggccgaaaccctaaaattcatcgtaaccggcttgctcctggaagaactcctcatcagcaggatccgcttcatcttcttcagcaactgcgggggggttatttatatagagcaagggtgagtacgggagtactcagcaagccataggaaataagtgtttaatgcaggcttcaaagaaaggctgttgtttttgcaatttattttatttgagctcttttctaaaaacaactaagtgagtgcttctcaaacgacacggatgagacagtgctactcgtccggtcggagtatgtgcaatgtatcaatctttagatcttaaaacaaggttggcacccggccaacagcttttcaaacggccacccgggccaacaacttttcaaacggccacctgggcctagctgatcccgtcagctgctgatttttcaaacatcgaaccccttttcaccacagtaatttcacaagcagttgtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgttcagatgaaattccaaggaaacggtccttaggtgcaagagcgggaaaccgtacacccggtaggttccccggtccgcggttttggaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaattttaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggacttacggtttggaagatattgaatttctaagattattggatttttggtctaaaggaaaaaggatttaattaaatcctttttggaaaagaaaagaaaaaaaaagggagagggagggaatatagactttcctcgggcggctagggcgtggcccgagaggaatggggtggtccggccgagctaattgggccgaccggcccaagacggcccaagacgcgcgtacgcgcgggagggaggagagagagagccggtggaccgggctcaccacgcgcggtcccgggtgggacccgcttgtcagcggctcggctcaccgtgcggagggagcacgcggcgcggcgctagggtggaggatggacgtggtgcacgcacgcggttcgcggaggacgcaggtgcggcgggcccacgcgcagcctcacggctcgcggtggaacgcgcgcacggggagggactgaccggggtcggcccgtcccgacctcggctgagctggcgccgacgtggcgcctacgtggctgccacgtgggctggcgggaggtagacgacgacgccggccggaacggacggcggacaacagcggcgagcggcggagcgaaccacggcgatacgggcaaaagcgagcacaccgggcggttgttcgtgatgaggggagacgaaccaacggctcggatttgccgggggttgctagacggcggcggattgcggcggcggcaaccggcggcgggagaagggggaaacggcgacgaggtcactaggggctgattcccggcggcgagagcatctacgcggttacgggaatccgatgctagcgtcggatttggcggaactacgctgagcgaggccggcgacgagcggcgcttccgagctcgggcggcgacggcggcgagcactcggcgagcgacggcaacggtcggggcagcgccggctaacttcggggaggctactcgagctactaccgaaaactaaggggggggagatggagcgaggaggaagaacggagtgaggcactaccgtgcgggacgggcgcggtgacgagaggccgacggcgcgggagtgatctctccggcctcgggccgaggaagaggaagaagagggtgtgcccggagtccccttgcgcgtccacgaacgcaccggctctcccggcgcttggcgatggacggcggaggcgagacagggcacgggagcggcggcaatggcgaggaggcgaatgggagaggaaggaagggggaggctgggggtttagatgggcggcaatgtcggtttgggaaccgacttgcgtggtcaagggcgcgagctggcgctcggcggtcgcggccaaagcggcgacagggaggatgacgccggcgaggaggaaaaaggggaaaggagggggagaaaggggcttgcccttttgccgattcggaaaaaaggaggaggggagcgggggcgacgtggcagagggaggggggcgctgcctccgtcccttggcggcttgcgcgcggagtggcgggggccgggcggtcggccactcggcacgcgcgcgcggcttgcaacgggaggcgatgacggcgggcggtttggagcggcgcgacgacacgggcgacagacgcgtgcagaggctgacggcggcggcgaccgggcggtcggccactcggcacgcgcgcgcggcttgcaacgggaggcgcggcggatggagtggcgcggctcgggcgcgggcggctcacgcgcacgcgaacacggcgcgcgggaagcggcagcggggaagcggggagaagggctcggctcggcgcgggcggcgcacgcgcgcgggcagagcggaggggcgcagggcgcggctctcgcgcttgcgcgcggcacgcgagggaggggcactcggcgcggcgacgcgcgctcgcgcgcgcggcgcggggcggagcggagggagagagggagagagagagcgggagcgcgccgggggagagagcgagagagagagagagagggggggatcagggagagaggggagagagaggggaaagggctgggggagaggggaagatgggccgagagaaaatcggcccatcgaccccgggggaggcaaactagacttttgcggagggatttgatttggaaggatttggattcggaattgaactcgacgatagatcggggattgagatcttgagatggcacggacactaggcaacaagcaaagaaacaggtttcgcaattagggtttttaggagataattttcccgctaggcgccacgacggaacgggtgctacatcaacgtagaagttgaccttaacgggcgtttgtgaaatgtcatgtaacaacatgtgttggggagggcgagccggttaagctgagcggagtgagccgggagttgcaaaagatcaagcgagccgacgtggagcgcggcattggaatattggattggtaaagtctccacgcgtcatgctcatccatctataccagagctgcacagcacatgggcgtgggtttgcacccggatccacaccaaccctgcattaacttaacgcctacggaagtggtattttgggcttctggcacacacactgtgccacgcatagtacacacgcccagaacctgttccccacgacagtagactaggcatatgcatcgctgggctatataaaggaccttaggtgtgtttagttcacgccaaaattagaagtttgattgaaattggaacgatgtg

SEQ ID NO: 69162 - DNA, 1993 bp, Oryza sativa
tgcggtatctacctattagtggatcgtggatggtattttgttttaaaaattgaattaattgactgctcgtgtataactaatccctgaagaatcggtctgtacgcaggtagtgggcggtgaggaatggtatttaaatcatcaaaccacatactgcttcatttgttcagggctgcaggaacttggtttggacctccgtagtccagctcgaggatacgccgccgcgcggcggtgctgatttaggatggataaacaagtgaagaaccacagaccttctgatggtacggatggatcaaggtatgttgttctgtttcagtgatttatttcagtatgtgccgctggttttttttctctgaatttcgccgtgtgaacttgagcaattctaaatcatcaattcagggaaattcttatggacgagcgcaaccctaccatggacatagtagatggtattagtcaatctgtccatgattcacaaccggatggtggtcagtcaaggttggatcgtagcttccgtgaatttaaaactctgtaaatggtagccagatactgacacatcttgattgtgttatgaagccgtgtagcaatggaggaggacgtgccgtcgcgggttggatcacatgattcagggcatggaattccagagacaaggtatgtgcatggctaggtgtcagctgagcattcactttaaagcagtatatactacatagaaatgttcagtatgtgtcacatgagaaagttcagtatatgctatcttctaggaaagttcagtatgtatcacatagaaaagttcagtatgtgctatattgcagaggagttcagtatgttgcacagaaaattcagaacatactatatgctgtcgtataacaaagttcagtacatagcctcccatagaaaaattcagtatatatgtgaaaaattcagtaaatactggtgcgtatcaaagttcagactacgaatcactatggaaagatttagtatacgtgtggaaaatgcagtatatgctatcgtctagaaaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctgggataccgatggaaaggtttgtatcagcatgttacggatttttacgattttttttttagccaggatattggtggtattttctgaaaactgattgtacattttcttttcagaatggtggtagataatgttgatagcagtgctgtcatacctcctgagtatgctgatcctcaaattcttactccgatgctgggacaaagatttaagactgagagggatgcctataatttttataatgtttatgctgttagtaaaggatttgggatacgactggacaaagatcgcatgaatactaaaaagcagagaacaatgcggcaaatatgttgttctcaccaggtacatacattatgtaacaatatcttagtagcagaaatttacctaaataaagacttgacgtactatgtgttaatttcgaaatcttttatgcaggggaggaacccaaaaaccaagaagccttccgttcgaattgggtgcccagcaatgatgaagataaatatgtctggagctggtagtggctggtcagtaacaaaggttgtttctgcgcacaaccatcctatgaaaaaaagtgtaggagttactaagcattaccagtcgcacaatcaaatagatgaggggactcgtggtattattgaagagatggtagacagtagtatggggc

SEQ ID NO: 69163 - DNA, 1426 bp, Oryza sativa
accaattaaatttatcgccaaaacccaatattgccgatctatatgtgcacataagtacggacgtttagtaggtattaaaaaaaaggtacgtacatgtattccaagataaaaaagtacgtacgtatgtacataagaaggccgggttaacgacatatttttatcttctttttttctcactcggatagaaaaaccaaactgcccatattaactatgctctacttacgctgtaaaaatataggcacatgtcatcgaaacaccaatgaaaagcataaattaattaaagtatatattatgtaatagttaaattagacttgcattttttaaaataaaaacaattctaactgtgactagcaattctcaaaagttacctattccttacttaaaaaaataatgatatgtcaaaatgatatcactaaatttatcatgaatattctgttttctctattcgtataatatttaaatatcaaagattgtatatattattttcacaccgtactgatctcctttatcttctacttaggattcatttgatctagctggatggctgagcttattcaggatacatgaaaagacacatatcattagtgcaagattaattaaatattaaatataataaagccaaaatagatttatttaatttttaaacttttatataaaatatattttaataatacacaagttgcttttaaatatatacgatgtaggttatggttgtcaatttaattatagtgcataaaatggttcagatggatttagatattattatcaaaagatatgtcttttgtaataattcctatatcaatgggtagataactaggaaaacatgcttacgacaaacaaggagcaaccaatccgataattactctagaacttattgcttatttactaaaacgtttaatatgtagtatgtaatatactttatgaataaaaaatatcctaatatatcaatcatatgccaccaaggatccataagtacataagttttatctgtcaacatttgatgtcgcgattccggtatttgcataatatggggatcattggtactagggtatacgtgagactgaggtaaaaaagatggagacagagatttttatacaggttcaggcccctgaattgtcaggtaataaccctacatcctgttggccgaagccggtattgctcttattcaccataatcacaccagtacaatatttggggtagtctatctaactgttgtcgacatggtggtctgtagttctgactcgtagtcgacaacaggatagtcttccttctcgaattcatgcccgacgagatcagagatagcgctttcgtctctcctgacagtatccggagacaccgtaggggactagccatgcttatccctgaagttgatatccagcgtcttgtcttggcgtatgttggcttctgttgttccgtgtgtgttgat

SEQ ID NO: 69164 - DNA, 2338 bp, Oryza sativa
taatgatcctattccgtgatataagaaaatatgttgtcttctttctttctttgttttggatttttttttcataataattctgggtttactgtatattctagtgtagttttttataataattatgggtttactatataatctagagttatatgagtagcactgagtaggcgtatgatatttagttaaagaaaatgaatgcaaattcgttgttttggattttttttcttaataattttaggtttactatatattttagagttataggagtagtactgagtaggtgtggtatatttatagaaggcaaaggagtagaagttcgtgtggttggaaagggaagatagttttggaagcctctagaatctatatgtgatatttttctctatatttttccttacatatgattgttaggtgtttttttctttatgattttttcttcaaagtaagagacgccaagtgaaccaatcaaaagctagtaaaagagctagctttaccttctgcaatgtgtgagtctgtaagacctatctagtgttactgtattatttttttttcttttcttctttaccatctttacaagagggaggctagaggaggcaactgcaatgtgtgaatgtaagacctatctagtgttactgtgttattttttttcttttcttcttaccatctttacaagagggaggctattctttcttttcttttttttaaggggaggcaagacgccaaacgctatccagtgttactgtgttattttttttcttttcttctttacaagagggaggccaagacgccaaacctaccccaatttctattaatagaaatggtaagttgctataaagtttaactacagccgagtttagttctaaactttttcttcaaactttcaacttttccatcacatcaaaactttcctacacacataaactttcaacttttccgtcacattgttccaatttcaaccaaattttcaattttaacgtgaactaaacacaccctacaataaagaatagaaaacaccagacaggaggtcttttctgtgagagtggcgccacccatctagtgttagtacaaatatgcagtgctttgctgaagaagagcttgtaaagaattctgaaaaatttaaagtcggaatgacacaatgtggaggaatgttgtagcagagggaaaataaaaaaaaagagggaaaaaacatttgcaagttggtaggaattatagcactgtactaaatgaaaacaaacaggaccatgactactccctgttgtcaccgccgcccggccggccctcccccccccccccctctctctctccagggtattttggacacaaaaatctctaaaatggcatttcattcgataagcaatgtattgagtggcattttatccggttcattgtattgagtggcattttatccgaactcaccttagagagtagcgtatcgtcagttttctcgctgatatgttatacttccctcccctttcctttcggcttgtttggtaactcgagggaaagggattgggagtttagatgatgaaaataatggtgagattatgatgagaatttgatttttaattctaatatttttatttatgtcaggttattaatgaaaatagatggttgagatttgtttaagtagagttaatgaggaattctctcccaattaccacccctatccatgtattgaaaaggagaaaactcctttctcaattccccatcccatcctaccaaaattctcatgtctcccaactaaatagttaatatctccatccctctaaacttctaatcccttctaaaaactctccccaaccaaacggatcgtttatatacaccgcttctcccctttcgagcctttgaggtcccgatttctccatttgctgcacaggagaatatgtgcaagaactgaactattgtattctccctgcaatcgtcgatgcagaaattgttaaattcgacttgattggttctgcaatcgtcgatgcggaaattgttaaattcgattcgattggttatgcactcacatccatggataacaacctactatctctctctttttttttttgaagacaaacaacatgctcattgtccacatcccacaatctaatatattgacgtgcaatccttaacctgcttattatccacatcccacattctgatatattgacgtgcaatccttttacgcgttcgaaaaaaaaggggattgccatatatcattcgactgaaatatggggatgaaatcttacagattttggaccattggatccatgccaagattcgtgcaccaccttctcttctccaactccgacgggctccccttcttctccggcgccggcgacaccccaactccagc

SEQ ID NO: 69165 - DNA, 8809 bp, Oryza sativa
ccgctgcatgcagccgtccgccgtccagcgcccacccactcatctcgcgccgccgcctgcctactgcccggcctcgcgcgccgccgtccgcccatccgccgctcccttgtctcgcgccgccgccatccaccgggaggcccctgtggtcgacgcggccgcggcgcgcagccccctggcggctaccgcctcgcctcacctcgctgctgcccacgctcgctgccttcgccgtcgccgtctgaactctgaaggacaagagagagagagagtgagtgagggatagaagagatagaagagagatacaaaaaccgacaggtggggccacctattttttaataaataagttgctgactggactgccacgtgtacgtcacgtagaccaaaaccaccgcggattgggtcgaggggggtaattcgtccggtttgcatagttggaggtgaagaatgtccggttttgtggttcgggggtaattcggatgaccgcgatagttcgggggtaattcgtacttttttccttgtaaaaaagagggtcaaatgggtcaaactcaaaaaagaagggccaaattagtagctagtcctcaaaatagcgtcaaaaatgcaattgccctgaaaaaactaatagacaaaaagaaataaatataatatggttgtaagtagttttttttatcttgatggttgtaattagttgggatgagggaatatgtgaattagctatttatatatttttaggacacattttaaatgttaaaggcagcaatatattgagatggaaggagtaataaaattgacacaatgatagatggcactctgctattgtgtgctcccataccaccgaaagtaatataatatttataaactcgcttatacattatagctggtatatctataaaagtaaattggaaacatatgaaaattacacataaacgtatacatatatatttaaacctgacgtccagtgatcaatatatacaatatacgacttctcatatgtacgtgctccatccagggaaataaactctcttgttaatcttgcagcaaatcacattattaatgataatcacagggattaataactccattatgaattcaaggttgaggtcacttttattctttttcctttatttatcaaccgattaattaatcaaacataatattaaaaagagtagagataaaagttgtgcgagcctcctgattagtccaatatatgtctcatatatgatctaatggtgtagttttatttatcagttttatcaaacgttactcgtattttagaagatgtggctcattctctttgagataactttggtgctttcacatattaagatgccaccagctcaatatattgagaaagcgtactgtacaaatgccaaagttaaattatcatcaaccttccccctaattaatctgcaagtactaagattatgtcgctgcgatttactactccacaagcacaagtccacggaacttgccgatcgtgagtttgtcaaaagaaaaaaaaaagggtaaagtttcagagtagtttaatgattgaaataatcaattctcagctgatccgtggaatggaaggaccgaagtgtcagtgatatgccctgcaggcaatcatagagatgattgtatcacatactatgtttatatatttatccgactttatttcttgaaatagataactcattattggttaataaatatgtgattctttcatgagactctttatgttgtgtgttgctatttctaaaggattcctgatcaaatatcatatgtggaacaaatatatttagatgatcagcacatatgttaattaatgatcatgtctcatggatcatggtatagagataacaaattaataatgtggacacatgttggtgaacatgttgttggatagatccaacatgagacactgcaagagccatatgtgttgtgtcatcagtgatctcatttagtgttggtgttgaatccttagattatcatggttcctagctaacatgtgtagtagcttacttagggattgctaaacgctactctgtaattgggtagttataaaactagttttcgggtatgctatgaaatatgtagtggaatatgaataatcaagatgggatttgccccttctatggagaaatatctctgggcccttcgatgttgtagattatggaaatgcatggccatgccaaaggtgattgaggagtcaatcacgagttatataatctatcaacaggttcgagtgaatgattgagctattagaggatggcacatatctagccttgagcttaatcgatatcgtgaggcaaaggggttcatataagtatacactagaggttcagtcgatatgatctttttgtatgcccggtggctcaatatgttctgctaggggccgctgttgatgcgtggaccgaaaaagagttttcgggttatagccgagtgtacatgaacctatagggtcgcacgcttaatgggccggaataaggggattggatggagatctaatatgagcttaattcggataggaatccaaatatgagtcctacgggccttggaggtccgagtaatggatcttatatattcgtgaggagtgtgaccggcggagatattgcatcacgtgagaaaccctagccgccactcccttcccgagcagaaccctagccgcacgagggtgcagcacatctgcgcgtggcgttccatccctgtacgtgtggataccgatagaggcgctgctggtttacggtgctgatcggcgtgggagtacggcgagcacgaggaggagaaggtcgagccggtgtgatcgactacttcctctacatcgacgcccgctacttcgcgagagttccttcaacttctcagcgtcttccgctgtgcagcttgtcgagtggtaacgatctatgatctaatacttgtatggttcctgatttacacgatataaaattttgattaagctatcgtaacctacgggtatcccaacagtacccctggctcacctctgttctactgcacagcggcatcactgatccattgatcaatcattcacacatagatagcatatcgattggttacaccacaagtaattgtaaaattagaagatgagtgtagctcgacagcgaaagatagcgagcaacctcatcttttcgctaatgtttatgtttattagctaaaattttatttttaaccttaaaaacattgcgtactgaggctaaccgagttattttcatcgaagtttattttttagcttttatttttacatcgttaagaacatgtattttacaaattattttcgattgcaaatataccgttggtttatttctcaaaaaagtaaaacaatgcggacgaggccgactgagtcattgaccgtttgctccgcacgcgcggtgctgaaatatggtcatgacgtgcaagaaacgaacttgcctgcagctagtccagccggccgacagcagtagtagcatatcagcctcatcgattacccatatttcctaataagctattttaatttattataaaataaaaattaatttataagtaaagtttttatatatgtgttcctgacgagttaaaaataaatgctaaaagaactacattatatcagtttcaaaattatgtttgaaattttaaattttgattttggctttagcctattatgacaatcgatgaggctctatgtaaccctccttccttctgcatttgctttacttggtcacagactctgagctggaagcaggttacaatcaagcacaggtcttggggaatcaggaaatactctcctatgcatcaccgtataactagttcccaaggtctcctaagccctatatgctaaagcacacaccacgcatcaacatgtcaacatatgcacatgtgttagctagtgttgcgttcttttctgaaaaatgataacgttatgctggatatttgctcttttttttatgcagctgagatatatatagcggcatccaactttgtactatctcttttttttttgtaaaaatcaaataaccaaggaaatttgacattgatttaggtgagatatattcaacaactggcagtgtcgaaacatgaattcggcaataataaaaggggtagcgcacgagacctaaaagtggatggatgcggagacaaaggatttagataggttcaggccctctcaatgagagataataccctactcctatttggagatttgaatccgccgggtgtagtatagatctgacgatcatatgtgctcatgcaccctagagggcctcctgcccatcttatataggatgggcggcaggattacaagatagaaaccttaaccaatacggtatcggtttcctaaatctattttacaatattatcaaatcaagactttaggccgttccataatatacagggaaacgtaatacccaagtcatgatccgttacatattctatagatataagttatcccatataaccagtcggataaccatgtcgtgtgggcatgtggtacccataatctccatagtagcccctgagaccttcacagtcaaaaaacaatcttctctcgaaccagattactccaaagccaaatgcttcaattatctttgccatggtctctcgagtacttttaccaaatatgaagactgtggagggctgaaaaataaagtcaggtgcatcgattagacgcacctaataggtgtagcccccgactatgtggttagctaaataaactaagcatatagtcaaggaataaataattcaaccaaccgagtggctttgataattgtaatcaaccaagtgaattgatatcaatatatagcatatgcggtgtgaatctccgaataatatgatccgagtaatataccgactgctttgtaaaatatgatgtgtgcaacctaaagttggctacatcattgaaaattcacatagcaaaatagccataaagaagcttgtatgctgtgaataaagaattttctaaagtattgggcatacgccatgcgcacactgctttaacagatgtgcttaagtccctaaaagacacatggtttcaccacacctaaaaatatatggcatatgtggtgtaacatccgagtaaataaactcataaatgatttaccaaccacctagaaaattaccacaatatataatcagcctaagccataatattggtcaataaaagtgcacacttacgtgccaaaaagcaatgatatcgtatccaatcaattgctttattaacccaaacagcgccttgactatatataaaaaagtcagcggggcagctatgaaaaacttcaccgttgggtaccttttaagatgcattgtaccaactcttaaaaagttgagcaactgcggtataaaaggattttaaggtattgggcacttgatcacgtgcactttggcctaagcaaaaagtgcctaagtccctaaaataacgtgacaggccacacctgaaaatatgggctgcagacatattaggcctaggccaaaaaatatgccttcgacaccctttaaaggatgacgcatataacatgctcctaagtaataaatcttctgggtgatatataccaagtgtagctcatgtgaatagcttctgatctgagtgattatccctcatgggatactccaaaatagatataaaaattaaatcccgactggcacaagtattcggttgatagcccttacggggaataatgaataatccagtcattgagaataagaaatcgactcatgaccataaattcaagttgaatgtatctggaacaagtccaaattgaagatataattctcgcgcttgagttgatgagcccctatgcatgtagcttatccttctgtcgtagtcataattgtccattgataatagccattagcaacggcgaagacgtcagggccgatgaagtatatataggtaacggcgagcatgtgcataacgaagatgatgcaatgccccttgatttataaaaatgacagtagaacttgatgttatagctgttgtagaagcttcacttagaggaatgtagatgttgttgtccaactcgtcgaaactgagctgattgattgataactctaaactcccggacatgtatattaaatctcaaacttgacacttgagcaatttgaagcagattgtggcggcatccagaagtcaaaattgccagtgaaataataagagttgctgaagtagaacgtctgctctgaagtaaagacgaagataatgactcctaaagttgactccttgattgattgattgctttatcttgacataaaacttgtcggattttgagtcttgtatttgtgtagcctccgactctttggttagttgggaaacaactgaacatagagtcgagaactgtagcttgtcgtcgagtactcattgcttaagtgaggttacatgttgaagatgtccgagtataagtcttgaaaattatagaactacttgtagtagtagattagcacgacgtcaaatttcgtgacgcatgccaatatgtcgaggctcatgtagacgtcgtagttggtgaagtagcacaacttgcgaagtagcagcaatagagattgccggtgcagaagaccatgaagatgaagttgctccaccatggtgacaaagttgcatagcagtaatgaagttgcacatgagtcagcggcaacagaagcaaaccggtagtgaagatgcgcagttgtgaagataaaagcaccagtcggcggtggcataaccagtcggcgacggaagacgatgatgtccatcagtagtggtagcggtataaaccatatgtagaggtgagggcactagtcaacagcagacgagatgaccggcagtgaagaagataaggccaattaacactggcagaatcatgcagccatggaaatgaataaactagtcggcagcagacgtagacagcttgcgttgaagatgatgacgcctattagcggtggcggcgacgtagccagccgtgaagaagatagcatcagttggcgtcataacaggccagccgtgcaggcggaaacaccagtcggcggtggacgaggcggccggtcggtgaagacgtagacatccaacaacggcggcataataggcaagccgtgcaggcggaaacaccagtcggcggcggacgaggcggccggtcggtgaagacgtagacgcccaacaacggcggcataataggccagccgtgtaggcggaaacaccagtcggcggcggatgaggcggccggtcggtgaagacgtagacgcccaacaacggtggtgtgaccaaccaaccgtataggcgaagacaccagtcggcggcgacgacggcaagctggtggtgatgttctgactgattcattcctggagcgtaagagataagcttaaagccatgaatcccttttgtgcatatctggatctggatcttgcagaacaaacatataggatgagtagtatctgatgtaaaaacagtcctcgatgaaaattcaagtactttaaaatatttataaatatgtatttcttctcttgtcaattttgatttccacgagcaaatgactcattacgtttaaacactctgcccgactagtcatagccaccaggcaccgggagtcagcctaagtacttcccaaacatgcatatgagtgacatgagttcgtcattaatggaacaaagtttcacggatcagaatttactactcgggtacttttgcaattattaagagcagaaaataaatttatctcatctctatgcttctgatttaattattccgagtaatactaagcaccttgcgttattcggtccatccaacgagcccccgggtgctaggaatcggcccaaaggcaactatccattggcaaaccaaacggaaagcataggaagatggaactccataactcgataggcacttttgtactcagattatgtcgcaagcaatcaagataaatattatgaaaattgttaaaaaatatgatataacatatgtagcccccgactcactagtcaacggcgaaccaattgatgtagtgaggtagaggaaaagaaaaatatcatataaagaaaaataatgatgacttagctttgtaatattccccttggtgatggcagaggtggccaatgtgggaacaaagtcgtccatcaataacaatgaagacaccaatcggcggcgacgaaggcggtcgacggtgaaagcgatgcccaccaacggcggcataataggccagccgtgtaggcggagaaaccagtcggcagcagcgacggaagcgagacggtcggtgaagatgatgtcgctatcagtagcaacgtagtaggccggccgtgaggacgaacaaaccagtcagcgatgaagtccatgtccatgaagatcgtgtcagtgatatcggaaacaacgtgcctgttatatggctgtcgcatagtcggacatgtaaatacaaatcatatctgattaggagataaaagaatgtgcaagcatgcatctgtatttgctccagtagattaattgactcatatgcactgatcgatgcttattggacgatcggtctcaagcctgcgattgttggtagcagcctgtagattaaggaatcttgattggttggcttgtagcaggcagccatgcaatacatggtgatgatgagtagatgcatgtaataagagagctgctccgaagcccctgattatgtcgctgtgagatcgaggaaagatgctgaccggactgtttggctatcgaagcagtcggccgggccatgatgcgcgtgcgtagccaaccgcacaccacatatgtcgcaagatcaggactgcaaactttgtagcatgccgtgtatcgtccaaggcatgcggcccatgctattgacgatcctgttgacagtagtatccggttattctcctgacgataaagtttctctctctgaagcga

SEQ ID NO: 69166 - DNA, 614 bp, Oryza sativa
tcttcctcaatctctactgaagctacagatgccagtgcaaactgaccaacataatcttcaaaatagtcgctcccaaaaagcattccaaagacagcagttggatcaatcatgttatccctaaaaaagccattttaaaagttcaatagctttatgttgataataactaatacaatgtacatgcagcatgcagctaaaacttcaaatcgcttgtgcaattgaattttgttttacaatttggccgatccaattctatagaaacaaagaatttggagcttaatttctatctaggttgatagaatagtgacagaaatattcaagacttactgtggaaggccttcttttccatgcttgtcataagaatcctttcttacaggatcactgagtatttgataggcctcacccagttccttgcagaagtaaccaattttagttagtaatcctcctataaaggtagtgggtgaattaataagggctactgatagggatgcaagcgggccgacccatgaacccgcttataggcaaaattagtgagcagtggcggagccaggataaaatatagtgggggctccttagtcttttgagccttataacaatctcagacaaagtttatttta

SEQ ID NO: 69167 - DNA, 602 bp, Oryza sativa
cccatccacatcggcagaatcgtttcacgtcacgtccacccgtgcacgcatctcgctaggctagcattacatatagccagcagcgcatggtcaccaccatgatcaactctcgagaaaaatcgagcagctagttagttcctcacttctagggattcgctttggctacgtacattggtgtacgatggcgtcgtctcgctccgtcgtgctccgggtgctggtcgcggtggccgtcgtggcagcagccggggcgccgcgcctcgccgtcgcggactcgccgccgcttcaggacatctgcgtggccgacctgcgggcggcgacagcggtcgacgggttcccgtgcaagccgacggcgtccgtggtgagcgacgacttcttctgcgacgccatcgtccaggcgcccagcacgagcaacccgttcggcgtcaactccacgcgcgccacggtgtccgcgttccccggcctgaacacgctgggcctctccatcacgcgcaccgacctcgcgcccggcggcctcaacccgccgcactcgcacccgcgcgcctcggagctcgggctcgtgctcagcgggaaggtcatggtggggttcaccacggcggccaacc

SEQ ID NO: 69168 - DNA, 6904 bp, Oryza sativa
aaaaataaatataagggtgaattagatataaccataggaaaaaatactttttttcaccattttgaggtatatttttgctcttgcatataccatatatttttttaacattttccttttgttttttattttcctatgcgtaagggtaaattagacaaatcatatagattttgcatagaaaggtgacatggcatgtccatgtggcaattttggtgggaccaaggactatattagcccacatgacaaatttaaaggacttgtttggacaatatgaaagaataagaactaaaatgacccaggatcgaaactttaggtaccatattagctattctcccaatgtatttttgtgttgtttcatgtatcacaaatttataattaagttgacatgcatgtgtctatataatgtagcgtatgtgttcatgcatgcacgatgattaagttggaaacgatgatgttcaaattagccccaaatttctagcatgcttaacaagagtaacgcaagttattagttagcaagttcaaatatttgggacgaagatgtgagaataagatcaggatcccactaattaacacagttaattactatagaattaaagagaaaacattttttcttaaaagaatttcctccattgtagcgattgcaccctaatcaacacaataataaaaaatgacacattttttttgtccaaaataacatggctgcatgatcaacaaaacatatcaatttccttcttcacttactgtcatatatgttgtactttgatattttttttaagactttgtactttgaaattatagtatctacctatgttcatgttattgagggagaatatgcaaagatgaacaaacatgtaaatatagcgtattgacaatgaattacatatgaacctacaaaccgatgatcttttactgagtttatatgttctttgtgataaaatatcaattttaaaataaccacacgaacattcggtcatattttatccgattgtgttattagacacaaaatatcgggggcgtctaatgggcgggtgatcgctcccccgtccctccacctatcacccttcccccccctcccttatacaatacactcctccctcctctctccccttcctcctccctttcttctttttctactacactaacccacaaaaaaaaatttaaaaaaaaagttaaaaaaatttttccttacaactattatttttaataaatttgaattcaaattcaaatttgaatccgctttttaaacttttgacttataacctttggttctttaacctttaggtttataaactttacatttttaaaaatcctatttataaaaactttttaaatccaaattcaaattaaatcgcatttaatctaaattcaaatttaaaaccggtatgtaaacttttgacttataaactttaggtctataaactttaggtgtataaactttagatgcttaaaaatactatatatagaaaatatttgaattcaaattcaaatttgaatcaaatataattcaaatccaaatttaaaacaaggtatgtaaacttttgacttataaactttgggtcattaaactttaggtgtataaactttagatgtatagaaatactatatataaaaaaaattgaattgaaattcaaatttgaatttgaatcgaatatataaacttttgacttataaactttggttctctaaactttagatgtgtaaacttgaggtgtataaactttagatgcataaatttactaaaataatagagtaatacggtgccaaaaaaggaaaccaggtggagggagggagggaagaggggatcgatcgctaccccatagccaaggcgatcgattgcccattagaggtttcgcaaaatatcaacttaaaaaaacatcacgatcatactcttaaaaagaaaatgtaaatctaagaaaaaaaacacgtaaattttttttaagggaaaccgaaaactttattactgaggcaggccagccaaatcgctggtcaccaaatactcaaggcccggcggagtgccggcccagctacaagggtcaagcaaattacaacccagtttcgccagttcatgcactacttgttacattccctggggcaataattaaccaagaatgaaataaatcttctagaaatgacattcttgatctccagaatcacaccccccatgacagagagattgaaagagttctcctggagtgtagacttcagcagcagcgagcctatttcaaactctaccttcattatccccctttcacttgccgcccctacagccgctgcacaagcaataatctcagaatggaatgcatccatcatgttatcagctccgccagctccagcctgaaccacccgtccatgatgatcccgaataacatatccccatccgccttgtttggtgctgctgtggaaggccccatccgagttgatgttcaggacatcagaggtgggttttctccattttgccattctcctctccttcaacttcccctctttccaattcaacttcaagaattcctctccctggttatcaatgatatacgccaagtcaattgggtctctggctttacctccttccctcacttcattcatctgcttccaccattgccacaaacaaacgacagctctcatctgtatattctctgggcacccccaaatggtctccagcacacttcttgcattaggttgttgcgctagagataatctcaggtcttccaagttcatcgcctaccaaactttcttaacaagcttgcacttgaaaagcacttgaaaaacacgtgaattttgtaatgcaggattaccgacgatcatgttcctaggaaggaaatgtaaatctttttagaacacgtaaataacggaaatgagaatcacgggtatagtagagatgaggtaccgatgcggaacctgtgtacctagaactaagaagacaattatgcccttctccatcttaaaaaaaatatccttttacacttactacctaagtacctatatcagtacttaaatatcttttaagtggtatcttttattatggaccattagatttttaccaaacaccgtaaaatctctccttcaacatatagggaatgccttggctgtactctcgagcttccgttccatgaagcggccgttgtagaacaccggcctcgtcgtcactggtgatgaggacgcctattcacccattattagttgcaggcattcattgccgctaggtaagctggccaccctaccaatgccagcactccagccggcgccaccaacgctgctacgccgccctcagcaccctccattacgtgccccttcgtccacggaatcgccgccgcccatctcaaaccccttcttgcccagatctgtcaccctccactgcttctgcagggactccaccaccaccacgccggtcaatgtggccgccctcccctggggaggtctcctaggtctcggaaacgccagatcggggctctagcagcccttaattaaggcgttgtttaggcctcgtttacttggcaaaaacttttgcctatacgtaccacatcggatatacggacacacatttaaagtattaaacgtagtctaataataataaaaaaaactatagattccgctaggaaattgcgagaggaatttattaagcacaattaattcttcattagcaaatatttactgtagcaccacattatcaaatcatggcgcaattagacttaaaagatttgtctcgtaatttacacgcaaaatgtgtaattgattttttattttgtccacatttatactccatacatatgtccaaacattcgatgtgatgggtgaaaagtttttgttttggaaactgtggccttgtttagttcgcgaaaaaaaattttaggtgttacatcagacgtttgaccggatgttggaagggtttttgacacgaataaaaaaactaagttcataacttgcctggaaaacgcgagatgaatctttttagtctaattaatctgtcattagcacatgtgggttactatagcacctatggttaatcaggtgcaattaattgcacagtttgcatggaaatcgcgagacgaatcttttgagcctaattagtctatgattaaccataagtgctacagtaacccacatgtactaatgacggattaatcacgctaaaaagattcatttcgcggtttctaggcaagttatgaaattacttttttcattcgtatccaaatacccttctaatatccggtcaaacgcccgatgtgacccccaaaaattttcttttcgcaaactaaacaaggccgtaatctagacacgacgctccttcaatccgctctgccaaccagctcgtctccgcatcccatcgagccttcaaggagaagacgcaaggaaggtgctttatctaccttgcgcatgaccatcaagtggtgactatcagggcaatagcaatgcgtcccatgtatataccgaatctcagatgccacatgggctaaggaactgtggtagtcacaagattcacaatgtagcaactccaaagtggggtccacaaaaataaagttctccttttttttctccacttttccccatctccttctccctttcctcgggaccaccgctatccttcttctcccccatctctcacgccttcccctctctctcctctcatgctcgggtggcaacctgactcagtcttctctccttacaccgtgttgggtcggccaggcggagcagcagcctgcggaaacggcgccgaggtggccgggcagagtggcagcctctgaggcaacggagctaggcggagacagcgccgatgcggccgggcggagcgccggcctctgcggcgacggagccggacggagcgccggcctctatggcgacgaagccgggcaaagaggcgacggcaaccgagtagagaggcgaccgaagcggtgacggtgcaggccggagcagcggaggggtgggctcgccggatctagcctcaggttctctctggcgcggatgcggctccctatccctacccccacctcctctctgtctctctcccgctttctccccacgggcggatgcgatttttttagcaaaagttgattttttttttgacgaggttcttggagccaatgttgatcacgtgaacccggcgaaggaatggtcaccacttccctctctcctccacgcaagcactttttctacctggacaaacattgacacatgtcacgtgcgtgcaccgtgaatggcctcagagacccaatctgatgtttctcctgccatcgctcaggttattgtgcctatgaatgcactaaggccattcacagtgcatgtatgtggcgtttggtctcgatgcaccagctcggcgattcccctctacacaagcgttggtcgtaaccctgtgaagtccgcggaaccaattttgtgcactcgttcttctcacaaaatcaaggtcgcgtggcatgggggagaacggtgcagacgcattgtgaggttgtggccttacgggttcgtggctccgcgcttcccctccccatcccccgagctggcgatgaaggaagaagaagagatggcggcggaggaggaagaggaggcgacaaatctggtgcctacctacttgacgccccccgagccatgttgtcactcattgtcgtgtgtcgctccaacccaccggacccatcctcgttttctgatctatgctgctgctcgtcatcatcgcccactccaagccgcaacgacctctccttgacccctccacagcctcaatgggagcctccacgacccatccagatcgatgcgccaccgaggagagggtagaggccgcgctgccgctcgtccttgttgcccatagccatgggcgccgacgaggagagagaaaggatttggcaccgacgaggagaggggtgaagggatttagcgccagagaggggaggagagaggggagatctggcgagcttcgggcttgttttggccgcccggcgctgtcgcttcatggggaccaccgctgcaaacaaccctccgcctggctcgccgtcaccgcttctgcctttcacgagagcatgtgggttggggaaaggggaagcatcggttttggggagagagacggaaaaaggcgagaaaaatattgttttttcatggaccccagttaaggctacatagcacggtgaaacttgtggctaacattattctttggtgttcttggacctacgtgacatatgaggtctggcaaaattcgatgttgcactgctaatgccctaagcagtggtccctaggcaccacctgccgtcaccccccatctctagtgcaaccttcaccgcagagcacctggacggactggcagcgctcacttcgatgacaagctatgcccttgccaccaccacctccaagaactatgcatggaaggcaatggcacttctcggcgacacgcccaattgatgacgagtatctcagcccaacctcctacgcccttgatgaggagcactatgtgacatcctggccctattaggatatggactgtgtggctcatgagagccgtgtgctcctgtttgataccaccttgctaatgtagtgaaaagctggaaccaacttataatggtttgtccctctagtcgtatcactcctaggttaaccattttacacaaagcaaggatgaaagtatatgtgtgctatgtgtaagtgggcccacccataggatggactaggttgcgcggttccaaagggcgtgttgttacatgcttaatttttttccattttggttcgcgttaccataacatatcccattctctaattttatttattcttcaggagaatccaatgatgtgtggttttactttatggatcaacaccgtcagcccgacgtatgatggcagaagagtaactaaagctgaatgcaaacaaagtacaagagaatgaaggagcacaaagttgcagtacgtgctaaacgacgtagaagggggtagtagag

SEQ ID NO: 69169 - DNA, 859 bp, Oryza sativa
actcttttctccccataacaatactgaaatcaaagtggaggaattgataaacctcgccgtcgccggcttattcaatcgatcgtccaccgttacgccatagcttgcacggtggctcgatcattcactcgctgtgtttttcaacagcacgcgtcgccggcagcgcttcatcatcatgtgcaggcagctccgacgagccgtatccatgcagctgttgcttcccggcgccggagtagcatcgcctcaggttgctcgcatgcacgacggcctgcacgtatataataaaatgagttcaaatattccacggtgttatttattttgggatgaggagagtaactcgctacttactacttccgtctcaggatatctactactacttaaaaagtaaaacctgcttccgtcgtccgtgaaaaataaaacgctgagaaaaaaacgaaaaaaaaggtccgattcccattaaaaacaaaacttccgactcacttggaaattccgttgaaaaaaaggaaagaaaaattactgtatgaaaaaaaatcaagcgcgagaaaagggcaaaaattttgttctgccgatcccaaaaaaggtgcgacaaaagagtttccgtcttccgtaaaataaggaaaatctatatctatatctatacctattataaaaatacgtaaggtttttgtattttttttcgtccgtcacttttttttttgttattttcgccttttttttccgttttttccgtccctccaattttttttgcctttggttcatttttcctttttttcacccgccgttttttcgtccgtttcaggttctcttttttttttcctttttgtcggcattccttccttcaattggtcgtaaaaatcgattc

SEQ ID NO: 69170 - DNA, 1775 bp, Oryza sativa
caatcaggcacaaaaaaaaaaactatctgaacattaattcggtcttacacctaaaactaaggtttagggtttaagaaggatacaggaattaatcgaaaaaaacctgtagagctgctcgaagttgagcttttccatgtcttgagcgtagatgtcgcggattgcgtccgtcaccgcctgacacgagctggcggcgagggcagcgtccatcctcgtcctgcggaaggggagaggttggatctgcgagcgcgtcgtcatctcgtgccgtggccgcgccgccgctgcagaaaaacgtacgggtttcgatcgggggtcggtgtataaagtgtatttataccgtctcaaactatcctatttaatttgcctctcaattccaataccgagtagaaaacacccctggagaccggggagacctcagcttggttgggctgggccatccgtgagtggagaggccggcttgaccggctgcgtgtggctgcgccgctaaacgagccgaaccgggccgtttttgatgagaacgaggcgagacaagccgggtctgagtattcgcgagagcccaaccaagccgggtctcaggccttgtctggtgagcttgtcccagctgcagcttttcctaaaaactgtttctgttagaagctgtcccaaacagtcaacagcttctgagaatctgcagttatagattctaaaaaatgaagaagccagaagctgggtttcagagcttttccagattctcagaagctggctaccaaacagctgcttctcagaatttaaagctcccccaaacaggcccttagtattcgctcgttgacttgatgagatttgctccggtccacctcgagatacagatatctcacggtaccaaatcattttttattgcttggtataataatgtcaatcctgtctagctagattcaacaatcggaaacgatattgatgtgaggtatcgatacctcgagatactttttgttggaacggagcaaatcttggactttatatgttcttcagccatatgcaacagacaacaacatgttcatgctcccatcacatctcttctttcttaaagctaatgcccactacactcctaaagctcaatatacaaacatagtatttattagcactactaagacctacatgcaagcatgccgcatcacccaattaagctcacaaaactcaacatgcaaacacatagtaattatatctacaatttattttattttaaaactaaacatacatatgctaaattatcattctcaaatcattttcataatatttcaatgcaaatcatttatcatttctccattatctaacatatatcccgcagaaaaacgcggggcatcaactagtatgaggttaggggtggagccagccaaaaataacgctgggttcactgaaaaaaaaaataactctaaaatttgggaatgaaatcttatatattttgtatcacaagtagaagtgaaatagtgttgaatgtagttttcacggacgtgcaacattgacctgttccatcctgctgagttagcatgtgatgcccacgtatcattatctccttctttcccttcttccttcctcccttctctctatctctctctctattcggcccttcctccccggccggcttctcccaagctaggggcacacctactccagcgccaccctgctcactaccacggcctacgtcgacatcattgagccaatgcaagctatctccagtcacggtcgtcgttgagacgttgactcttcgctcgcggcctcctgctctagcaccaccccactcgacg

SEQ ID NO: 69171 - DNA, 4989 bp, Oryza sativa
gaaggtgggttaatcctgaatcgttggatctcagggagacgatcctgaccgatagaatgaggaatgtaacactgtgttggtaaattatagggtagatttgagaagacgggtgattaacaacgttatcgttttgtttatgcgcataccaaaatttaaattttaaaacataattttaattttaaagttgattttgtgtttgttttatttttaaaatgacgtaaagttttacttacaaatatcttttggcttttaattaaccgtacatataaacgtaagcaaaaggaagcagtgaacctataacatgtgcatagcctcatgtgtacttaccatgtgcatatcatgatgtgatttttggatataaaattggttctcctttagaatatgatttttaaaacacggaaaacgtagaattcaagtgccttggcacctgaaattctatcaaaaatttatgggttaaaaatatactgaaaaactgtaaaaaaaaaaccttctagatggagtgtagaaaaaaaagaatgaaaaatagagattaggcacataagatttttttccctataggtcgaacctcatgttaaaaatcctctaaaataattatgatagataatcctaaggaatttaataggatatttggaatttggaattgctattcctttgttacaaatggatatatagaaaaaaaaatttcataggatgtgaatcctgtaaaattcctccaaaattgaaaaaaacaaaggaataggaaaaacacatgattctggcaggaatacaagtgtaaaacagaggattgaaaaacacaggaaaaacataggaatggccgtttgattggaccataggaaaaacgcaggaatcagataagagagatagattcagaggaaatgttccaagaggttagacctcttgctaactttcctccaaaatgtacataggattactcattccataggaattttaaaggcttggatatgattcaatcctttgtttcaaaggccataggatttttttactataggattgaaattctccaaaattcctatatttttcctacaaatcaaaggggcccttagagggtcattctaataacggacatgaacttaacataccaatttgtagctcagctggtagggacctgttgacgaaaaaaatcgaacacaccggcctgggagatctgcttagctcatgtgcaggtccaaagattgatgatatgcgggcgtgccagtcagtttgatcctgcaactgataagatatgtaaacagcagatcaaaacagccgatcggttgacaagccgatggagtagttccagccggtagccaataatagccgatgctgataccagccgatagcgatagggtttaagcaatcggctatatgtccaatgtagataacgatataaaggcaatcagctgatgatgatgcaataaaataacaatataatccagtataaaccaatcggctagcaatgatatgataaataagcatcgatccgaaggttaaagcacacatcggctggaggtccgatgtcatgaaatccacaagattagattaaacagtgaaacctttgttgtcatcggcgaaatccaacttatatgtatgtgcaatccttatgagccgatgcaacgtccagataactcaccggctgaaatcccgatgaaacccttattggcaatcaagaagcaggctagagattatgtttctaagcacgacttagtagatcaaacttaactgatgcagcactaagtatgaaaagaaacataatatctagacaatcaagccgttgactgaattttcagggtggtagatgtctaagctaatctaatctagcaacacgatttagccgataccggcagaaaccctaaaacgagaagcagccgatagagctaaattgatatgctaagactagattaacagagacatatgataaataggtaagcaagtatatcatccaaaccagagcaatccaagaggtcgaacgtactgatgcaaccttgaacgacgccgatgtagatgagacaattgtctgggccgacggaacattggacttaccctttcgccggagatcgaacaccgatgcagccccgcgtcaggtgccaagtcccgccggacgataaaataaagtaaaaaaggtaaaaggtggcgatgcgccaaattgtattgatcgtgagatagattacatagaccctaggtgtacatatttatacccaagggttgatacaagtccttgtcggataagaaagaaactaacctaaagataaaaagaaaatataaagtccttatcggacactaaacacactttcctaaagataaaaggaaactaacaaactattcctaattaatagataaactgccatgccgcatcctctttaaactcggtcacttagggataagttccctttagtagattgatttccttaaccgaatatagcaggaatccgactattggcgacttgataactcccatcggctgattccgagatgctgcagccgataatgattctaagccgattaccaaatttcactgttaacaggaccaaacaagaggcatgtgcgagtgtgcggtctgtgtatatggtggtgcgtgatttgtgatccgtaagcacttgcaccatgatggcttggctccgatgcgcatcaatgagaccagccacattgtgaactaaatttaaaactacactaggttttttattggaatactgacaagatgtccgtgttttgcaataggatcataacatatttggaattgaaggtggtggtggtgggagcgacacaatccacgatgtgggccattgccgtattctttcatgtcaactcgttaaaattggccacaccatgtgagcgagggtgacgaacataatatctatatatttttttaagtaagatgacaaaaggtgaattatgcgtttaggatgtttaccctcataaagaagttgttggtgacatgcataccatgcgcgccggttagaggagagatggtggtctaccatgatttggtgcacaaagggagtccacggaaattcgaaagctagattagatcatgatacaagggacagctaggatcaacctatagttcggatggctcggatctaagacgggtataccaatcgagatccacatgtcaatcgacgggcaactgatgcattagacccacctatcaactcgggtgatcaaacactactccatatggttgctggagatagtgcacatcaatagacagaggggactagcagaaggaggagaatgaaacgattttgactagcatacacgcaaaggtaaataacaatggaagacaatcgaccacgagtttttgcactgcaactcatttggtcttaaaaaagggggttcaccagcaggcttcaatgggagagagttgtgcccaaggatcttgtaacttctgcgatcattgaagtggatcgatggtgcttcgaagggcaacaatgatgactagagttgatgatgcatgatggagagatacgaaactttgtgctacagctagggcaatcgacaactctagaggggcttgagggtgaggatatgggagccctattatgagggaggggatgttgacacagagactacagtgtggcagcaatattttccttgatgacgtagctaagtcaagcctattaacatgacggcgtcgaggatgacatggactcctaccgagaaagagacataacttacaattgggctacacctattactgacagcaaaaagctggtggcattgggctgactcgggcaattgcacgcatggagaataacacatgccaacgtggttgaatgtgcagaggttttattcgcgtgtcacgcttgatagacaatgggaatattttttttctagatgtatatagataagtgatctgtgcgttgcaatatataccgattataccatatactaattatgacacactgatatatataacacgggtatcggatttggatttgcttggtaacccagctgaactctctgaaccggttttcttgtgtctcgtcgcatcgccttatgtctgataacgattttaaatattttcatatatttttctcaaataatttcaagaccggtaatttttcttagtaaaagatattttcaaatttaatttgatactgtggaggtcgcaatttgcaaatgcgctaaaaatgagcccgtcacatgatctaccccaccaaaacaaaaggagagtaaagtttgactccacagtccaccacccgtgaagctctggagtcgagcgtgaacttggtccactacgccatggcggccgcaccacagcaatccgtgcacccaagcttgccctcctcaacctcaaccctccgcctcctcatctcctcctccccacgacggcctcctccgccgccgccaagagcccgccggtataacaggctcgcggcgtcggcttcggcggcgcgggagatgccgtggccgcacgtgctgacggtggccggctccgactccggcggcggcgccggcatccaggccgacatcaaggcctgcgccgcgctgggagcctactgctcctccgtcgtcaccgccgtcactgcccagaacaccgccggcgtccaggtaggtcgcctggtttcttcttcttgattttctcccccgtgtgctcctgcctgggttctctggattaaggagggagaaatgattgggggttggtgcaggggattcatgtggtgccagaggagttcatccgggagcagctcaactcggttctttcggacatgtcggtggatgtggtgagcccctttttgccttctttttttttttcttcctatctgcctttccaagttccacgaatctttacagttattatatcttagctggttttggttcttgctacatagcttagtgcacaaaatgctctgtgatttccatatgtgtgtgatgggttgatattgtgatatcggtgacgccccctgttccagacaccatttttgtgcagaattaccagcccctgttgaaatctggtgtgccacacaaaaatcgaatctaaaaactaaa

SEQ ID NO: 69172 - DNA, 2463 bp, Oryza sativa
attcctgcagcccatatatatatatatatatatatatatatatatataaatataagttggtcaaatgattttaaagaagttaaatcgtcttataataaaatgaagggactaataaataaagtctcaaaagataacataatttacacaaaaattttgtctaacagattgaaagtaagtttgaagtgggatttttcacggcacgcaaaatgaacaaaccattagagtgtgattaacggtgtgtttatcactaacttaaaaattagattatttgattttttttaagaaaaacttccatataaaaagcttttaaaagtacaccttttagaagtttaaaaagcatcctactttaaaacttaccacccataactcactaccgaatccgcaacctaaatggctaaatctctgtttggatttcaggagaaaaatgtggataattttaaggtaaacatggttgtcacgtgaagctttacaaaaatgagtcatcgttaaggtctgcctttgtttgacacaagagtccggttttaaccgataagagatcaaaacaacctctaatacttgctatgtgaagatttacaaagagttatagtagatcatcacgctctgcctttgtttaacatatatatgtgtccagttttaacaggttagagataaaaaaaaccctaatgaagaacatatcacaatatcaaactcccaaaaagaaaaaaaaacagaagaaaagaaaaagaaagccacccccggacggaaaacgaagatccaaatatagagcaggcccgtataatcagaaggaaaccaaaaaagaaaaaaaataggagaattaaacgagcaagatatatcgtcgacgaggcccatcgcgtgcgcttcccctcccctctcgcctccccaaattcgcgttcgccaccgtcgcgtcccccctcgcctctgcctcgccggaaccctagggagatcgccggagcacggcgctggctcacgggcggcggcggagatgaactcgcagaagaagcgcagccccaagatcgagcccttccggcaccgcgtggatgcggacccaaagtccttcgacaaatcgtggaagaagctcgaggacgccatccgcgagatttacaaccacaacgccagcggcctctccttcgaggagctgtacaggttgatagatctacgccgcatcccctgccctgatttttttctgttttatgctaggttgattttggcgcggcgtcccatgtggggggcgggggatacggggaatcgagttttgtatgaaacgccagctcgattagtagatttagtttctcacactgtcatcgttggagtcatttttttttccttaggttttgctgtatgatcatctatgtatatagattggatattaggcgatgtgcagggagtttcaaacgattttaatcgatcggatatatgctacatgcatgcctattaggtagttctgtgtatgctacatgcatgcctacatgcagtacatatgtcggaatttgcaaccctagttcatgatttgcatccattgtacagtagagaaaaggaattcccttatttatgatcgataatagtggttctctggaaattgtaacgctttggggtcatgggctgtggtgtagtgatattatccgacatatgtactgcacagtgcacatgccgtctatttcatgaaggccacatctatgtattaccctatggtaggattttgttccctctcttaagcttcaatggattcgaaattttctttaagcctgaaatattgaatataagtcggtcatatctgctttgctcctatgatgtttctagaatagtgctggataattttgtctcctcataagttattctgggttggaagtttgataccctttgcatatgcccttttaatcaatatgatattttatagcttaaaggtaatctatttactctctactagtgagcatgctggttaatcattatttcaaaacatatttcattgttttctatatgctacatttcatcgtggtgttgtacgcatatgtgtccttatcttaacaaacactatcttacctggttttaaccatcataatctacccatttattattgtgtaactacttagcaagtagaaataatagtaaccactagaaaaggaaaaatttgctatacttaataatgtttcatattctaaagattttcccactctgctaaagattttccctgccaaaatatagtattattgtagatttattaattcattagttttggttgagataagacatagtgaggtcctttcttttgagagtttggtgtatatattcaaggaacttgatcttcctggcagtgcattgtagtgctctctttacctgcgtaagttacagctgataaaaatatcccttctttgtttggtcctcttcattttattagacaccaaagaccaaagatagaaattagctgataagcacctttcatgcattgctcttgttggccttttgttt

SEQ ID NO: 69173 - DNA, 4713 bp, Oryza sativa
ggagtgatatattacatattgatctatcttatcaatttttttaaaattttttcgtaaccatctaattgacatgcaataggatggacgtccactcgaactattggaatcctctccccccaccaccctattttaaaatttttcgtaaccatctaattgacatgcaataggatggacgtccactcgaactattggaatcctctccccccaccaccctatttttctggatcgtacaccatccacttccacgttgatttcccggatcgaacaagagggagagggcacaggcggcgacggttggcggcgtgcgactgttgactcgggcttcctccggcggccggcgacggcgacggcttgtggcagcggcgggcgggcggctgcagcatgcgacggtcttggcgaggccgtaccccagggcatcctcgtcctggcctcgccgccctcgacctcgattcgccctggatctcgatgccgagtttggatctggagatgcggggtcgcatcctcccgctgtcgctagccgattcgccttcttgccagaccatcaccactcttctcgtgactgcgagaggtacacatcggctgcaccaatttgctctctttttgcatttttctcattgtgtgggcagtggatgtggtgaaggagcttggcgcgtgaggtcacgatgcagcccaaatgcgatctgcatcacgtggttcaatctgatgcgtgcgtaggtcaggagtctcgttgagtccttttttttcttttggactatttgaagctctaattttttggttgaaccacgttcttacgatgtgctagaaattcttttttttttgtgtgtgttcgaacgtgtgttcctgattcttttttggtgagatttcctttcatgagcttcacgttcaacagagcatctaagtaattcgtgttccagttgtactccctccgtcccctccgccccccccccctccaaccaaacaaacctttggttttcgtgtctaatgtttaaccgtccgtcttatttaaaaaaatatgaaaaaaaaattaaaaagacaagtcacgcataaaatattaatcatgttctatcctctaacaaaaataaaaatacgaattataaaaaaaaatcatataaaacggacagtcaaagttggacacggaaacctaggatttgactttttatgggacggagggagtatttgtttcctgagttgattgataccagttagtggagtatgtcagaaaacccaaagcaaagccgtggtgatgagagctacacatccacataacttgtttctattctgattttactgactttaatctctgtgttgttttagggtgagtttgagggataggggattgaaaagattggaaagatacgcaaaatgaagtgagccattaacgcatgattaattgagtataaattattttaaatttcaaaaatagattaatatgattttttaaaacaactttcctatataaattttttttgtcaaaaacacaccgtttaatagtttggaaagcgtgtgcgcggactacgatgtgatttctcaccctaactcaccagaacgaacgctcccttattgtttttactgtaacgtttctgaaaatccctgattgaacaagcactcaaggaggctcccgaaattcgacatatattaaggttgatgagctcgctagtacctagtacttggttatctgaaattttcttgctctattgagcagctgggatgaattggagcaatcatgtggaacagagccgtttggatgtattggtcggaacattttgtgcaaattaactttttttgctcagtatatacccatagatatatgatgtttcatttgactgactgactaataagtttcctgttgaacataccatttttactctgtatatttttgacagaatatacttcttcagactaaggtctaaattttactgaaattattaacttataattcttgcaggcgtcagcagctgcagtgtgcactcttgcagtggatgctctgctgaagacgtacatgttctaaattttttggttgctcatctatatctgaattttctttttaatcgtgaattcatctgtgtttaggaaactacgtaagaacatgagaagattatgccagtggtggtggtgccactggaatggcatcctggtcattatcctcgacatgtctgccgtcaacgcacgtcgccagcggccaaacacaaagagcaggggtgacgcagagatgtcgacccaggacgagcacaccacaattgatgaccggcttcggtggcaggcgatgccaaaaatcttcacgactgatgccctctggactgataatttttgacaacgagtgtatatgtgtgtttgtaacgatgatggcacgatcaattgaagaaaaaaaccattatacgtgtattctcgtgtagtaaaatatttactgccttaagcacaaagcaatttatttactgagaaaagacgaaactaatatttcttgccatatcaagagtttttactgagagaagactgagagtaaattatttatcgagagaaggacgttggtacaaaaatcaggaatgagataagggcgcagaactatctaagagtaatacatttagtgaaagaagaaatcgacagagagtaatacatctagtgaatgaagaaatcaactgagagtaaatagtaaagtaatacatttactgaaaggagaaaatcaactgaaagtaaatcgtttactaagagaaggatgcgagaagaaaaaacaggatagagaaaagatgcgaaccagggtgcatgtgggggcggttgggggtgtggagtcgtttactaagagaaggatgcgagaagaaaaaacagaatagagaaaagatgcgaaccagggtgcatgtgggggcggttgcgggtggggaggagagagaaaggtggtttcctggtgggagtgagggggggtgggggtggagggtaggttgtgaggggagcgttttagttattacgcaccctggatgtgatttagcgctgtcctatatatatttgtttgtttgtttattaatataaaatcatagtgaaaaatatgtttaggagattgtgtcgttgtctaaaacatcaattaattatggaactagagagacgataccatgttttttttttgtgaaaacttgttgagttcccttttctattctttcgtgggccaaacatgattattatacttggtgataccatgtgctttgctacggaatatatggatgaaaatatgtttaatattatagaaatgataaatgttgaagtattgtgaaaatgatgcgaggaagatgatatgatatatgttgagctctagtattatattttgcatgattagtcatgcttgtatgatatttaaaatactctataatagtaattgttagtgggtgatgatgtatcatacttaggagatgagtcgacaataacaaattaacatagtaaacaaacaaaatttagaaaataataataaaatatcgttatcagaaaacaatatcttattttccttacccatacaagcactaattattatctctaaccggcctatagtcatgtataaggggaaaatcttttggtcctgggaatggcaccccttatttgttcaaacatataaatatttatgggaacttcttaaaatatttgactacaattatgtaggatctaggtctacaaaatttaacttgattcacacatcaataattttttttaaaaaaagcatataagcaatacatgcattgttctgacctagatttttttttaccaaacttgaattttggtgaaatgataaccatactctgtattgtcaaattattacttcctccgtttcatattataagactctctagcattgcttacatttatatatatatatatatatatatgttaatgtatgcctagattcattaacatctatataaatatggacaatgctaaaaagtcttataactaaaacggaggaggtagtatatcacaatatgtgtaagggaagttccctttagatagaatgcatcttccattcgtttagctgtagtatatgttacaattaaactacgctcggagggatgcttgttttatagccttaggcccatttggttctgactaacacataggataatgattaatagatcacttaaggcccacatgacgagtcgaaggaataaagttggccatatatcctttttcatagaaaaaaaaacaaatatcataaactactctcaggaatcttttaaaaaacaacttttttggcgaacttttataacttttgtatgtcaacaaacacgccctacttccgttgttaataaactgaagaccctattctctcactaaaatactttgtcttcactatacctttttcccatgatgttgcatttgtatcatttaatagccaactgttcacttatttcattgctcactcaatgttcgttaggccattcctaacccaataattaggatagtgtccatagtattaaataagctaccacatagaatgaaaaataatgtgacaagtgaataaatgaggaaagagaaggaaaccatgtcttgcatgagggcagttccaacccataacactagacatggtttctataaactccacatcatcaagaaactagtagtagacactactgttccaatgcaaataccactattccatacttcaatttaatgttacttatctcacatgatgttttggatgttgtgtagaaactatgtctcatgcaagagggctgcaggaat

SEQ ID NO: 69174 - DNA, 2757 bp, Oryza sativa
agaatttttgaggttttattttctacgtatagtgcgttatttgagactagtaatatgtccgtactaacgttacggcaaaatttggtaatacacgtgcaaagcatatggtaaaaatataagttaaactgagagcataaagctttactggtaatgcagccggaaaagtttacctggcacatgaaattcatgttaccaagtaataaataaataagcatgtatttaaaccacgttgtataaaaatacaagtgcgtttaaggatacaataatacacaaataatacacagctccaccattgtacatggtataaaataaatgcaaaaaaaaaataacccctcaaagatgaaggagcagaaaatggacacaaaagtcactctgatcatccaatgctactggccatacaaaatttatgcgtaaaatttgtcatttaaattaacctaattattattctgagaatgataatacgcatgctacaatctgattcaagtgcccgtaaaaaaagatctcagcaaatttggtagcagaattcagtaaattgataatggtcgcttacttatgtttgtgcttcaactgtccaagtggaaataaaacagagaaattaacttactaatttgtcaaaatgcccaactgaaaacaacacaattgaattgccagctatatcgaaaagccaaaaatcaggattattcatgttgtagctcagcaaccaaaagtatgagatacgggatttcaaacattactactaatatttaccacattagctagaaaggcgataagctataatattaggaatgattataggaatattgaacatctgaatagaaaatgtaggattatacgatattactaatctgccatatctggctttcgttcagacctagaatacacctgaataaaaatacacatgattaaagttgttgctccaaccctcaggccctcatgaggctcatcctgcggcaaacacacttaaattgtttgtctagaaggttgttattgatagcaaaatatagagcaagcaaagaccagtaggtatttcctatagggttgttttcactctccatgaatccttcatgtcaagataatataataaacaagctaagaaacatcaatcctaataccggattaacataagtaaatttcttttgtagctgcagctctttctcctagaggcattaatatgttgcggcaactatagcaaatcaatatgaaaaagaaagaaaaatattatccattaccaatccttgaactcatgacctcttgagttaactattttttatcttcaatgcactaacaatctcaacctcatataattacatgtaaatatgtgatttgtattatttatatctagttacttgacatatattaatatttggaaaaacgtctttacatcgttttaaatgccttaagaaaatgcctttacatatgaaacaaattttaaagtgccgaaaagatgtctctacaagataaatttaacaaagtatactaaaaatgtctctaaagtgtctctagagtaaaaatattttaggcgattttgaaagtgcctctaaaaagtgtctctagactatagagcttcaaaacttagaggcattttgaaaattgtctctacaaatgagcctctacataaggtttttgttatagtgaaagcaaaggtgatactgatcaattatgtgatttgcaatgtatgtctatggagtgatatgtgggaaaagtgttttcatccctcgaggggatatctcctaattttgtgcatgtcacctaaatagttataaacaaatttgaaaaaaaaaatcacaagaaatgtgcaccaatactcaaatgtatagctcaatgctcagagcagcagggtttttcacgagcaccttatatgcataaaactacacacaacctatatggatgcttggcgctgttcacagcagcaagtccacgaggccaaggtctaagtggtcgatacagcatcatttagctttttgacatgcacagctaagagctacgaccatcaatccgtagcttcagggaacaaatatataagaggtagactcagtgtagaaagcagaaaattgagaaccataggataaccatgaagagaacctgtcagtcttggctgttctatactttgctatataagagtagcacaaaatctaccatcgcaaaagatatggagaacataaagatatcaattcttctctaagatcaatgtgtaaactaaatttgtaaacactttatcacatgatatctcaaagaaacatgtatgctgcccccataatttcatttgaaaatacaagctgatgcttagattatcatcgatagtacgattgtaacatatatactctatagttattatactccgtcttgagctgcacctccttcctcggtgcccgcagatttactggtcccaggaatatcttagaaaagcaccttccaagcccaaaaagcacagaaacaatattagaatatcacaaatccctcaaaaaaacaggttagacagaaagcaagaacaagttcaaaccttctctgttgtaaaaaagaagaaataccatgtgcattgctcaggagtagagacgcaatgtctccgtcgcttatgaggcacgttgctcgatccaagtcctactcaatctcatcaagtccatccactgtcacaattagcacattgccacgatcattcaacagcaaacacattttagcgacacagtgattcagaaagacgaggtggtgtcccgagctgtgctgacgattgaatgaagagtaagggccaccacttcggtg

SEQ ID NO: 69175 - DNA, 3486 bp, Oryza sativa
aatgccctaatacttgcaaatggagctatcagcaatcaggtcgatctgactgaaatttctggtttaattattttgttattctagttgtcaacaaatatccagttattataacatgagattattactctaagacaaaatactaggatcatgaaattgctttggctcggtacatccacacttattagataaacaggtcgaatgctttcactatccttaatgaaatattccattatctagtaaagtctatagtaataaaccatttcttttttctctcctcccttctcaaggaaagataaaccctatataccaaatgattacatacaccttacacgtaccacactttacatgcccttaatttcttttaggaaccaagctttactttacatgctctgctacttggttcactttgtgataagagaaaaagaaaaaaaaagagtccaatttactcccccaaactatctcactgaatcacttaaccccctaaactattttgcagctaattttacccttgaactattaaaatagttcactttactggttacttacatttcacttctttactgatctttttataccagcaatattttaagctttaattttgtagagccatatggtctcattttttttgcttatgcttttatgcttatcagccaaaatttaaattttcaaccttaaatttggagctgattttgaggtttttttcattgaagcttatttttagccattgcttttagatcgctaagaacacatctataaaagttttatttacaaattacttttcatttgcagatatgaagtttcgcttattccgcgaataagcgaaataatggctccgatagatgacaccattatcaaagttcaaaaattttcatgactttctgcttgaacttaaaacctctatgttaaattagtcttagtgcttccaccctagtaaacaacgattcacaaatttcaaaaaatgttgagatataagttataatgcataaatatatcccaccatttatcattgcaaaatatgacatatagaaagagaaatgaaaaagaaaaatactcttagagaataagacgaaccatttttaataattcgaggtgtaaaatgagtcaagaaattgtttagactccagcgaaaagggttaacccggaagtgatatggttggagtcgcttcgtgtataagtgttaacccggaagtgatacggttgaagtcgcttagtgtataagggttaacctgagagtgcactttcgttctcgcttcgtgtacatacagtgaatagtgatatatgattggagggacaagcggacgttgtaagttggttgcaaccacacaactcaggcaggctcacagcccaaccagggaaacctacatctttggcccacgaggcccgtttaggcccaggagcgagtccacaaaggcatcatcgcatacgtgggttgccgaatattcgctccgcttcccccctcacgcgagatatttcctctcccccggtgggccgagccgccacgccacaccgccccctgtatcgctcactcgcttactatatagccagaggggagggagcgggtagggttttacctcctcccccccgcagcgccgccgccgccacacactcccccacatctccccttcccttccactcctcctcctcctcggatcgggaggcggagcgagcaatcccccaaggtgatttcctgctgctcttctctcatctccccccatcctctccgttgcgtgaatctgttgtgtggttcgtcgtcgattatcttagctaggctagattcctcgcggtggtggtgatttgagtgcgtccatctggtcaaaggttcgaggtaggagtagtagtatgtgtgggtgctctcagttcgttgcatgtttgggttctgtatctggtttggattatcatgtttagtggttggcgcggtagttgtaaatctgtggggttttgtcacgctggttaattttttggtttcgtcccggttccgatcgacgtttctttgggtcgtcaggtgtagcgaatggatgggattggttcgatccgtctggtagggattcgttctgctcgtagatctgctgtggattgctttcgcggtcgcctgctggagctaatttggcaggattaggatggttacccatttctccagggcagatctatgctatgttcgttgattggcgtgtgctggctacagacttgttcatgttgttcactagattgttaaacatgtgacgtcagccggtgattgcttgtctgccacggttttgtttgttgtcctagtgaaatatgcacagatacttaagggccgtgtttttgttttcacaataatggcagtagatgagttgaattcagtttgtcatatcgtttttgtatcaaaacaagtttttttcttactggttaagtgcttctcgcggtcccgccagaatttttatgtactgggtatctctgttatgagtactcccatatcctgcatgtacagtactgcagtggtgaattggtgatgtgctgatggtaatgaatatggcggaagtgtatcagtttgctgcttttgttacatttgatgtgtgttttcaagtttcatcttttttttcttattaatgctgcatctatcaagctgtgagtttttttctttgatcgtcttaaacctaacagtgtaactgcatcagtgtggtatttggaggtagtattagtaaaactggacatgttaaaaattcgcatttagtaaaactggacatgttaaaaaatcgtatttagtattttgtatcatgtatgatgcttaatttttgtttgcgatatcaattatatttttatttgttgcattgctatgtttttacttgagtcatgccgtgatatatttgtagttagaattttgattttaggttttgtgttttgcatggttctaactgggtttctttttttggtacaggaatttgtatttgtagcgtgatttgcaaagctagtcaagatggtgaagttcacagtagaagagctccgccggatcatggacaagaagaataacatccgtaatatgtccgtcattgctcatgtggaccacggtatgtgccagaatagttatgactggtgtattaatatctgatcataatgttattgttgggtttacttcaattggttatattccatttcttatacaattgacatttgcaataataaattcatcggattctgtgacatgagtcgatcacagtcgatctctgcatgattagtgccacaattacttgtgcaagttaattcatttggaaggtggcgatcattttaatttactctctttgttgagacggggggagtagttaatagtttgatcattactgtgtgttagcttaaatatttatgctgctgtgctggtcaccaaaatggtatgctaattttttgtatgtgctattttgcaattttgcattggaagaatatgttgtgtattatgctcttttatttaatagcttgtttacttttgcttattgctaatttctctttttgatatgt

SEQ ID NO: 69176 - DNA, 8036 bp, Oryza sativa
gcctatcagccttctcccgtgtcattgagaatgccaatgtcattatggcaacatatgaagacacactccttggtgatgtccaagtctaccctgagaagggaactgttgctttctctgctggtctgcatggctgggctttcacactctcgagctttgctaagatgtatgcttccaagtttggagttgatgaatttaagatgatggagaggctttggggtgagaacttctttgacccagccacaaagaaatggaccaacaagaacactggctcagctacctgcaaaagaggtttcgttcagttctgttatgagccgatcaagcaaatcatcaacacttgcatgaatgatcagaaggataagttgtggcctatgttgcagaagcttggtgtggtcatgaaggctgatgagaaggagcttatgggcaaggctctcatgaagcgtgttatgcaaacatggctgccagccagtaatgctcttcttgagatgatgatataccaccttccatctccgtccaaggcccagaggtaccgtgtggagaatttgtatgagggtcctcttgatgatgtctacgcaactgctatcagaaactgtgatccagaaggtcctcttatgctgtatgtttccaagatgattcccgcatcagacaaaggtaggttctttgcctttggtcgtgtcttctctgggagggttgcaactggcatgaaggtgcgtatcatgggtcccaactatgtccctggccagaagaaggatctgtatgtgaagagtgtccagcgtactgtcatctggatgggaaagaaacaagagtctgttgaggatgttccctgtggtaacactgttgctatggttggtttggatcagttcatcaccaagaatgccaccctgactaatgagaaggagtcagatgcctgcccaatcagagcaatgaagttctcagtgtcccctgttgtgcgtgttgctgttcagtgcaaggttgcctctgatctgcccaagcttgttgagggtttgaagcgtctggcgaagtctgatcctatggtgctctgtactattgaggagtctggtgagcatatcattgctggtgctggagagcttcaccttgaaatttgcttgaaggatctgcaggaagatttatgggtggtgctgaaatcattgtttccccacctgttgtttctttccgtgagactgtccttgagaagtcgtgccgtactgttatgagcaagtccccgaacaagcacaaccgtctctacatggaagctcgccccttggaggagggattggctgaggccattgatgacggtcgtattggcccacgtgatgatcccaaggtgcgctccaagatcctgtctgaggagttcggctgggacaaggatcttgcaaagaagatttggtgttttggacctgagacaactggccccaacatggtggttgatatgtgtaagggagttcagtatctgaatgaaatcaaggattccgttgtggctggtttccagtgggcatcaaaggagggtgctctggctgaggagaacatgcgtggtatctgctttgaggtgtgcgatgttgttctccatgctgatgctattcacagaggtggtggccaggtcattcccacggccaggagggtcatctatgcttctcagctcacagcaaagcccaggcttcttgagcccgtctacctggtggagatccaggcccctgagaatgcccttggtggtatctatggtgttctgaaccagaagagaggacatgtgttcgaggagatgcagaggcctggtacccctctgtacaacatcaaggcttacctccctgtcatcgagtcctttgggttctcaagccagcttagggctgcgacatctggccaggccttcccccagtgtgtgttcgaccattgggacatgatgacctctgatcctcttgaagctggctcgcaggcttcaaccctggtgcaggatatccgcaagaggaagggtctcaaggagcagatgactcccctctccgatttcgaggacaagctctaaatttttggccgccgcatgtgttgtgccgttacccttacatgttctagttggtctactgctaagagaactgctttcgttgtcgtatttcatttcccttttgtcgaatgcatgtgtttcacatcaacaatcctatgttcgcgtgctactgagaaactatttttactctgtcgtgatgtaacggatgtggaacctggatcatctttttgctgtctaagttatagtgttcacattcttgttgcgtttctgttgagtggtatttattgtttcctttggcttgccgttgtaagtccgcttatttttgttccgttcttcctagtttgtagttgttacttggtagaacctattctgttgtgtgttcttctagtttgtacctggcacttggtactaccagttctgttgttctagtttgtaggtacttcatactatgacgtatctagtttgtaggtacttggtactatgacgtatcttgcctgttctagtttgtaggttactacgacgtatgttgccgtttgatcagctcttttgccttgttaactcctggtctctgtttgatccgaactgttgcatttgagtaattttcccccgattgctctgaagtctatcttcgtgttcaatctcttttcatttgctttaatttcaatgggtcatgatgtcatcgacttatttctaatgccggatggcatagagcagggtttaccaaattgtttgggttgggttatcgtcaccttccggtttaaccacgtgacggactttagttagagttaaactactttaaatttaactaagtttgttttttttatgaatatagttatactaaattagtttcattaaatcaataattgaatatatttttataataaatttgtgttgagttaaaaatattattattttttctacaaacttaggtaaatttaaagcattttgattttaaccaaagtcaaaacgtcttataacctgaaacggatggagcatcaagttaccatctagtgttacaaaacgttcaattcccttgtttaatccctaatatttgtgttattcagatctgcttattctgatcgcattccctgatcgcttgcatgatattgaactcaactcacagactccacgaccccaaaatctaataccgcatcatatagtaaggggaaagcaatagccctatttggaaaacttaactatataggaaacgctaacccatctgaaaaagccaagtactccctccattccaaattgatgtatatatagttttttttaattattcctaaatgatttacatatttgtgttcattcattaagtctattcgttatttgtgtattggagtaaatggacattaatgcatgcatcgatgcacacaagtatttataacccacatgcaatatcttgatttgctattaactaggaaatagtggggatggtgcatgtatcgagtttgttgctagtgtaaatatagtataagagagttattagcttttcttgattttggtgtacctatgaaatatgtagatcaatttggaatggagggagtatgtcatagtctttaagtgataaagattaactaatagtctctcttcttacatgtccttagtccacctaattatcattttaaattaattggttgggtcctatcttgatagaagcacaatcattttggagaaaaaaattttaaatttttaatgatagtagaaacacattctttttaggacggagcatataataattagttgaataaaaataaacacctgaagattgcattgaagcgccagcagcaacacaaaggagcatgtgcattccgactgatgttttacactaacacacagtgacacagccacacaggagtaacaaacaaccaaggcccattacaaaacattgggccgaatggactcaaccacgaattaatacacaccaagactgaccagctgattattacacgcgcagacaacacacacgaggttaattaacacgcgtacatgacgccacacgactcgccacaccgaagcgttcgtaatcctccggcgggcgcgctcgccgccgtcgccgatccgccggcgacggcgatcgacggcggcgtgtctcagtagtaatacgaggaggacgacgacccgccgagctggaagccgtcggcggcgacctcgtcggccgcgggcatcggcgagaacatcgggctgtgcacgtacccctcctcgaagtacaccgccgccgccgccgccgacgcgcccgcgtcgtcgtacccgccgaactccagctccgacgcgtcgcaccacgccgcgccgccgccgccgccgacgacgtcgaacacgccacccacattctgaccgccaccgccaccgtaagccatttcctgggcgtcgccgccgtgtgcgggctgagccggcgccggcagcgcggcggcggtctgggtgtcggcgccggcgccggcgccgtagtagtggcggtggaggtcgttggtggagaggtcgggggagaggtagggcgtgagggaggagcccgggggcaggtccgggtaggcgaagttggtgcgcgcggcggcgccgcggatggtgcgggcggcgcggtcgtaggcgacggcggcctcctccgccgtgtcgaacgtgcccagccagtgccgctccttggtcgccgggtccctgatctccgccgcgtaccggccccacggccgccgcctcacgccgaggtatctcgcctcgttccctcctccacccccctcctgctcccgctgctgctgctgctgctgctgccgcctcgtcttcttctccggcgccggcgccgacgaggagaagaagtagaaatccatactcttcgagagatcgaggagaagaagtagttgtggtcgttggcgatgaagctgctgctactgctgctgcatggggaggttgcatggaggagtatatataagggcgggaaagcttaaaagttagtggggaaatggattaaataagcgaggtggtactaatgggcgatcttaagcatgattagcagcaggagtaatggagggaaaatgtaattggtgccctttttaaaaaaattgattcgtttgtgggggcggcaaaagtggtcaaccaatgatttgctctggtggtgactgcatgatgcatatgcttgatgggatgattaacatgcatggccgacttagctagttagctctggatccatcatactaaccttattaatattaaatcgagtttacatatgggaattatgatagtgatatgctcaagtattaattaataaaatttcctctcatcatatgtctatatcgatatcttccatgatagatttgctgggagtattgcagactagtaccgaactaccgatgttcagagcaattgatcaagtgggagttgtgttaggcttgcaccgtccagagtcaggcagaagtacagtacttacttctaaattaaacaataagtgtattatgtatagcaaagatagatgggaatccttttaccatcatataatctggctggtattgcaatttatacaataagtactatgcataattaaaatgcttcattttgatgtgggaagatcatgtgctgatattcatttttgcccttctgttatttcaaatgcgcaaaatcccaaatcctgcaaaatgaatacaaaatacataaagtgctattgtccatttacttttacaaggggcgtgcatgatttgacttgacgggaggttatattgctggcagtaacaaaaaataagtgatatatagtagagaaaatgttttcaaagatgaattcaattgtgctgtttttcctgtttcaagatatacttactgttggactaattgttagtagagagctcgcaaagaatgaatcttggagtacatgggcggcctataaaatcaacacagagagtacccactaattaaggttcaaggttttctgtccaagatagagaatactaagcttattattcaaggaaaaaaaatgtaataccatcgtcctccagaaatagtctattacattcatgttatacctatctataggatctataaataattcgaaatgaagaagacaatgaaacatatatcaactggtcaaaataggaatcatttacacaacagaagtataaatgatgaacaataaactacaagattctgacttataatatgcaacttctgggacatattaattttcctatacgttggttgcgaaatgtgtacaacaagatccaaaccgaccaaactgtgattctgattattctaatgccaagttgcaaagattagtctccctgtcatgtgttctctcccactgatgtcttgatttcactgtccaagaccacaagtcaaggtcaaagtttgtagggggcaagaacggcatgaaaatatactggtcctaatgcaaactctaacttcacatgccgccttaatacctgaggtgattatcgttttcctgcctttgattgactagattagctagctacagaagatcgcggtgtgtgtagtgtggtctacctacacaatatttttctattcattcgatcatgctcaagggatcaagtgaagtaatcagtagataatataatgggatctaatataataatgatgcctagcactaactaaagctaactagctggatgctcagtaaatgaattggagccattggattgatctgtccctacaagcgacacaaagagattttataatgttctttattgatagtagaatttatctaaacattatattgtgggcagtctcggcggtagctttcttattggtctggtgatcggtccagtgttaggtttctgctttgactctgtgtaggggctattgatgcgtggtagtggttttttttttcattcctgaccactaactttcagggtactagctaatttgtaatgttttcgtactctatttaatgaaccatcattctatctggtgctgatcgttaaaaaatgaatttttctaaacattttatttttttctaatctaatatgtcatgtctatttataccagctaccatcttaactatataaggtattagtataattttttgtattagtagtagaaataataaatcaataatactgtcaatagagactacccttgatttgtagcgttccagtagtaaactactcctatattagttcaactgaaaggtgaagtccacagcagtatagcagtttgtcgccggtttggctgggatcatgaagggcgccattattatgttgcttcccaaattttgctgcgctatatatatagcttatgaaactctctagcgatcactagcaaagtagcacgaactattgatgcagtttcagcaaagagcaagatctgtgcgtgtcgtgggtcattatatattttttttcacgaacgcgcaaaaagattgcacgtcaatatattagaggaatagagtttttgttacacaccgcaattggccagaccggcctacgtcagggaagggaaaaaataaagttaaaaaacaaggaagagaaaaaagaaaaagaaaaactcgaatgctactccaaacaacgagaagggtcagagccacgctacactcccaacaagttcccaaaggaagcaacgctcactaacgaccacaatcggccctccgacaggatggactcttggaccactgagaccgaagagagcgcggagtcaatcaccctagagttacgttcctttcatagctgccacaagaccaggaggaccagggagtcgaaactggaacggaggtgatcaggtaaaccagcactggaagatggccaccaaccctagagccagctgccacggggggcgagagggcagtccagctaggaggcgacagcacccgtaaccagacctgacgagcgaagatgcaatcgaggaggatgtggttcgccgtctcgagctcttgagcgcaaaaggggcaggccaagtggctatcgatgccacgcttttggaggaatatatattcttattataaataaactatgatcaaattgtttattgtagtaaatcaaactaaaataaatgaaaattttgttgcaccagacacaattacatttatgtgtgatgatctaatttcttatttgtaacaatgtgttgatgg

SEQ ID NO: 69177 - DNA, 1029 bp, Oryza sativa
tttcctattttttatagaatttcccttctattttctacacaaagattcggacaccttcatccgaaacagacactaatcaggacaaactcatggtgatattcaaaagtagcaagttgcaattgttgatgcttcagctgaacataagcatccatattacaaatccaaatactactacctggtagtacctcaactgtactcaaattacttaatggtaatctacaatcgtctctggccactatcggatctgaagcattgttcgccacaccggcgttttgggtcttcttgagccggctccgtcactacctccatctggtgttgccagctccaagccactaggagacataaccatggaggaggagctggagagcggccaggagggaatgaatcgacgcagtggcattttggatgggaaggacaggaggtgtggccgccgccggaataggggatcgatggaggatactgtgcagcagtacagatggagagggggccagcggtggcgatagggtctgatgtgaccatggctactacggatacatccgttgctcacatcatggatgaacaacaagatatcaagttcaagtcctccaagtgctggaatctgattcggccacctactacactgctgacttcaaacggccgccgaatctccatatgacctccgttttcggcccgtgagtacttgatggaaagctctcggagtcctctttccaatgcatcaagcctcattgccaaatttcatctcagtcggcagcaactgaagaaacaaggtgctgcgacacctgtaatgggcctatgggcttgtaacttcgtctgggaccccggcctaagtggggcccatgtggggtgcgccccaatcaggtggaggacgacctagggtcctcctatctctataaatagcttggtaccccttcagggtatcgcgggttttgatagattaaaatttagccattgctacttgcttgtagcgtgcgtgtcggctagaccgtctgtctgcttgttctttggaaccccaacttatcatttgtatta

SEQ ID NO: 69178 - DNA, 29949 bp, Oryza sativa
ccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctgaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaataaagtttcacggatcagaatttactactcgggtacttttgcaattattaagagcagaaaataaatttatctcatctctatgcttttgatttattccgaataatatttagcaccttgcgttactcggtccatccaacgagcccccgggtgctaggaatcggcccaaaggcaaccatccattggcaaaccaaacggaaagcagaggaagatagaactccataactcgataggtacttttgtactcagattatgtcgcaagcaatgaagataaatattataaaaaatatgatataacatctgtagcccccgactcactactcaatggaagaccaattggtgtagtgaggcagagaaaaaggaaaaatatcatataaagaataaaataaatgatgacttagctttgtaatattccccttggtgatggtagaagtggccaatgtgggaacaaagtcgtccatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgcagacgcccaacagcggcggcataataggccagccgtgtaggcggaggcaccactcggcggcgacggaggcaggccggcggtgaagtcgtggatgcctatgaacggtggtgcgaccatccaaccgtataggcgagaacaccagtcggcggcaacgaaggctagccgatcggtgaagacgtggacgcccatgaacggtggtgtgaccaaccaaccgtttaggcgaggacaccagttggcggcgacggaggtaggccgacagtgaagtcgtagatgcccaacaacgacggcataataggccagccgtgcaggcggaaacaccaatcggcaacagcagtgccacagcattacatgtaaacaacaggaaataccaagagattaatctgatatttagagatcaatctaataaacaacaataagttgaaaaggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattctcatggaaacaaataaaataaatctgattaatatcagcaaattaaatgtataaatctcagcgattgaatgcatgtatggctggattaattaatccatgcatggcggttgaatcgacacatcctgtacatctccagcgatctcgttatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagattgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaatctcgacgcacccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacacagggtttcttgacacagacacaaaagcagaacaatcgaattgctccctcagctcctcaaagatgaggtttgcgatcgttgtcttccctaatcccccaattccaacaatggagatggtccttagatgctcggatgccacatgcccatcatctttcatcaacagatcgatgagctccttcttcggctgatcaaccccaactagagatgacacatcctgaaagatggtaagagctctttggtctacggtcgcattagctgtcctcatcaaactgatcccaccattcatatatcgcgcattcctctcccccacttctttgatttgtgccttgaactcagcaatcatcttggcaatccgacgccgggccatggtcttggtcagcaaattcctgcatttgacgatgaacccatccggattagcggatccgtcgacgacatggagcatgaactcgtcgaggctgtcctcgatgtcgtaggagagctcccgcacctccctcgtccaggccttgtcctgagggtcagcgttcccctcctccgaatccgacatcctgaggaggaacgcgtgcatggcggcgaactcgtcggcgaggaaactgatctggccgcgcaccccttcgaattcgccggccatggcggcgagcttcaccaggacggacttgagtgccccggtggccgcggtcaccagaaacccctccatatgctcctcgaccgtacgcaaagaaagatcctgcgaaacagaagcagaagcagatctagatcagcaggtggggaatcaacacgaaccgcaaaagacggcgggggcgaatgttgattgatggccggagctcaccgccgtgatcctggggaagctcggcggcgagctggaagagttccacgcagcagcagcagagactgatcagtggtcagtggagtggtggtcaactggtcatagacgaagaggacgagaacatgtttgactcgcagcagacggagcaggtggagaagtcgataggccgggcccacagcgagccagcgagttggttgctttgctctctccatttccaaattttactcatcgttttttattttttatttttattttctagcagtgcagaccatgggtttgagatgaaatgaatatactgtgagtagagccctataagggctaattgagtttacgattttctgttagcacgtttttcaaatactatttctgtctcattttaagtatagttatagtttttatgtccaacgtttgatcgtttatcttatgtgaaaaaattataaaaacaattagtcacacataaagtatcatctaataacaacaaaaatactaatcgtaatttttttttcaaaataaaacggacggtcaaacgttaaacataaatacaaaactacagtctatctaggaaagctaaaaacaaagagtatgagttaggaaagctaagtgccaaaatcagccttattgcacctgctctaatacacttgttgatttcggcaatcaaaatgtctttatttgtgggcgagcatacataacaacttcatgctcctctttaagtggacatttcaaaaagcttttgactctataaagtggaactacatcaacatagttttccacaaagatatgatgactgggttgtggggttgttgacaactttcggttttaagatcccgcaaaatagcatccccgcaaatgtgatacatcatgccatggacctatttcaaggagacccactttctatcatcacagcaatagacctatagcaacgactgctatatatccaaagcaacggaccttgggctgattagtaatccttgaggaaggtcggtgcgtttccgaatcttaatatatgcatatgactggcggtcttcatcgacctaaaaacaagaagatgtccaggcattgcaaaactttgggcaggcaactgggttgtgcgccaacatacaaaagtcacaggttgccctattagatgcagtgacatcggcctcgatgagatcctagaaaacatcctagtgaccagacctttgttcccaatgaaatacctcggtctaccattgtccattggaagactgcagaaaatagaccatcaagctttgttccacaagtcaatagggcggatggcgggatggcaaggcaagaacttcggaatggctggctatcacaacccgccctggcaccacctaatagtgacaccaaagagggtgcgccataggaaattggcgtgaactgaattccatggaaccgcattgccaataccagtttcagtacacaattattggtactcgtggtcaaccaagatatgcatcattgcaacttaggataacataaatagataattccaaattgccttaatcgagttttatctctaattggcaatgacggatattccaatctgggcccatatcgaacccaagtcaggccgtatcggccacttgccatatcggcttagtcaaactccgactctgtttctagctgatacgatgcctagacgatgcgcagtccgactccaaatccaactcaattccgcacaaaatccacttcaatcttgttccttcttttccaattctgatgcaaaattccgttgttaacagatggttaatttaaaaccgataccttccaaaaccgagccgagtcaagtggtggactacaaagtgcacgatgcaataggtcatcgagattctttttctcctcatcctctccgcgatcccctctctctccccctatctcttcttcttcttctcctcctcttacccctctctctctatccactctatctctctggtgatggaggtcggggagtgttgcaggggcggcgtgcttcccacggggaggtggcggcaagcggtggcgccctctcctctgccagatccagcgggaggggaggcggcagcagggtcgccacaggaaggcagcgctgtcgacggtgggtacccgtagaccagatatagagggtattggggtccattggtacgaggatctacatagtacgacaacaagcaaacaaaagacaaggattatactggttcaggctccttggtaagtaatagccataatccagttggtatgggattatatgatgaaaaccacagattataaagggaatagcagaactcgatgataccgacgagaccgtagtcgagttggtcccactagatctcccggtggcttggctcctgcgtgctccggctccgtaggctgtggtggatgtgttggtggtgatattcgatgccttaggtcctacccagggggtatcttatataccgcgggtcacttgatctccaagtaggactcggagatatcggacccctcacgatatggtaaagacccagtcttgtccgagtagaactccttcaatccgtagataccatccaaacaacgtatttaacaaccccacccctcaaacttccattcttttctaactattccagaaaccaaacacacacagagtggaggagaatttttttttaaaattacacagtacaatgcagacacatcgaatctttaacacatacatggagcattaaatataaataaaataaaaaactagttgtacagtttgcatggaaatcacaagacgaatcttttaagcctaattagtccatgattagccataagtgctacataaacccacatgtgctaatgatggattaattaggcttaataaattcgtatcgcggtttctaggcgagttatgaaattagttcttttattcgtatttgaaaatatcttttaatatccggtcaatgacaaaaataaatttcttttcaccaactaaactgttcgtctccccactaaaatccctaaccccatcgatcccagccaacaatcgaagcaccggcgccgccgcctcgtgaccggccggctgacggcggagagcgaagcgggaccagcgacggtggagagcggctggacaacttttcctgcctcaatgcgccgcctctttgccgcctcgtcctctccttatctcctgtctttcgtggcatctccatggtggtggccatcagcgcttgcgcgacgagttcattgctttgattccgcagccaatcgacctacctgtagtgtttcccggtgagcccttctcttctcacggtaatgtttgtgccttttgttgctactatatagattttagggcatgtttggatcaatgccaaaatatatagtattttttagtttaaatagttagtaatgtggtggcttggtttcaagccaaaggttggtaatgcccatgctcaatttgacacaattctagaactttcttcaccataatataaattttggctcctaattgacatcaatccaaacacattcattttcaatgttaccttaccaaaacattgctattgtaaaaaattacctagattttgattattttttttggtatgatagtaaaccaaacaagcctttataaaggatctggattgggaccaagtctgggtttttatttacacttcttgtgttgttgatttcttttataaaaaaaggcaaatgggggaaaaccacgcaattaatccatgatgatttccaaacacagagaaaagaggctcacagatagaaaccagaaaccaatttcaggcttggatatactagtattctatatgacttcattcctgactgataatacttaccatcttatttatgactttgatgctctttgtgatagatttcttcatggatatcgaaatatggctagcagcaatatagtaaatggcgaggagttgggtgaaccagaaagaagacctctcaacccttctgccaagggtttcattatttccttgggcaagcactctgccatttcccaaggcacgaaggatatagagaaaagcaatactgacacaatgaacaagttcattactcattgtagcgggaatggtgcagaagatgggaggacatcaagcgggaatgtcatttctggttacgaaggtgtttgtgggacaacctttggagtcatagacaacaaagctgatacaacaggagaaattgtggatgttactggttgtgaactgagcagtggagacaaaagagagcttggctgcaggggtaccacagctaattgtttacccaattgaggatggtgtaccccctatggagatactcccatatagcagccattgtgacggttctatatacaggggcacagattgctggaaaaaagagtatcatattgctgaccgtaatgaaagtaagtggtcgatctctttttcttatttttattcattattagggcgttttccaagctatagggtcaactgatatattctctccgtaaatctcgacttaatttttctttcctctgtttacttataatttttgattgcggtgcattggcatatataaatggaaatcttctgaaattaacaactcatggtttcattgcttggtgtgtgcaaaagcacgaggcatctaacgatcatacctttagcagattgcagcctgtgctgacatcgccctgggtgtaggacatcatactcaaggttgtgatctcactagacattgtatctcctatctatccaaagttttctgattgtccagataactccctaagccatttttttgcctggaaatttgttcagttaactccagaatgttattgatcttcttgtttcttataaaagcatgttttattttgaaaatttgtgaagtgatagatgtaatcatgccctgtgctatggcttttcattctttttggtgcacacatgtgcatactaagtgttgaacaggtctagctacaccctactatgcagatagtcatggaaatcacgaaaataattataatatagaatgtgttgtctaccatcgggaaaagatcaacataaaagaggatttctagaaaacgaaaaaagaaaatatatttcattacggggtgaaatgacctgtcttgctagttctgggagtatagtgaactgaggaatagtttagggggttataaaataaatgaaccttttcccttctggggtggttagagattactctcgttttagagttccagtacatttgcatggcatcaagatgaaaataacatcatatatgccaggttttccagagcacattccctctgcatcatttgcagaagaaaagctagatacaaccgtgcagtgcagctcagcacagcaaaaccccccttccagctcatcatcctcgcactgctctgattcttcaggctttcgttgctctccagtgagcaggaactcactgaaaggttcttcactgatttaaaactaatgcctacatggactccgatcttgtcaggttagctatatctgcgttctttctacttttctagtggagacaacacactggaagaacagatgttggataggttccttgcctgtacagaaaaaaaaaaacatgatcaatcccggactcctgatatggctctctttatccttgggatttcctagaagaaaaatttttcaagggagcggatagtttttcatttagatgagaggggaactttccaatgggactatggaatcctcaagaagcatgtttacattttgtatcgccagcatttgtttattgtgttattttaattttaacagaacttgtatttttctgtgaagctcggtgggaggcaatgatgttttcaaagcccacggattgcaacatcgacagcaatggaatttgcatgtcacacggaacttgttgtatgttgcaatttttctcattaaggttggctaaagtacctgcggaccatggtttggtggagttgtatggatacatagcagtgcgggataggctggatacatttcttaattattttgtcaattttagcagggatgatcccattgtcgtggagcaggcgtgcacatttatacatgtatgcaattattttatagttaataagtctgttaacatgttatcatcggagcaggctctggtttaacctagtcttctgacagtagttggatagttagtactgggccgaatatttggccccatgcttatcatgccattacaaaatctggcccatgacaataagccactaccttacaaagtcttatatatattgtgaaatgatgatttacaacaaaaacagatctatactatgaaactaagtatcatgtattccaaacaaaatcaaatagaataattctggactcttggttgctagcaagtaaacctcacaaaactgaatcatttgtttataggcatatgaacatgcatagcatgaatactaagtcttataggcacatgaatatattacatgcttatttgatttagtacctgtgattcagaacaaaatcaatttccctctctaacaccgttatgtattttgtacattctgtttgatacaggacaaagttcttggccatcaataataaaacatgtcttagatattccttactttcatttgattctgtagggtataaaaatattgctacaagtgaaacatcataagggaagcattcagctttagatatttcttactcttatttgattctgtagggttctctcatccacatggctggccctaagcgagggatccaattgatcggcactaatctaatcgaatatgacatgaagatcaagactggtgaatatatatatgaaaatgaagatctacagctgatcgatggtgtatcaatcatagatgacatagacaacatggaattatagctcgtttacatgccgcatccatggttattgtggcgcgattgacatacctgcaatatcacaagtgagtcgaccatagaggttgcaatatcacaagtgcaaagcagttttgctatgcgcctgatcggttgtttaccagtgggttacatgaagaaatccggctctttgatggcactataggtgagttccgtacgtggcttgaagtggcgtgtggttgctgtagtgatgggtgctcaaatggatttgaagttcaaggtagccacagactcatgcatccctgctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacagcaatgaaaggcttcgacagcagttcttgcctggttttatgtatcataaaaaaagcgctgcatctgacagcactgatgatggacgtccatcgtttttgccctgattcgtgtaataacccaaaagagaaggtcaaagtggctgcttcaaagctccagtgtggagatccatttgctgcaattttgttgcttgcctcaacaagcgccattgaattctgttactgcctcacttaggaaaggccgtaaaaacttcaatgataaatcgtactagcatatttcaaacacactgcaattaccaacattgtccagagcaccaaacttctcattgaaactaagagaaagtcttgactaagtactacccccatcccatatatttgaaatttttcagaaatatccacccaaagtgcttcagcaaacacaaccagggaaaaaacaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtggagattatgggtaccccatacccacacggcatggttatccgactagttataggagataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttcatcgctgactggtttgttcgtcctcatggccagcctactacgctgctactgatagcaacatcatcttcaccgactggctcgcctccgtcgccgctgccgactggtttctccgcctacacggctggcctattatgccgccgttgttgggcgtttacgacttcaccaccggcctgccttcgtcgccgccgactggtgtcctcgtctatacggttggttggtcacaccaccgttcatgcgtgtccacgtcttcaccgaccggcctgcctccgtcgccgccgactggtgttctcgcctatacggttggttggtcacaccaccgttcatagctgtccacgtcttcaccgaccggcttgcctttgccgtcgccgactggtgtctctgcctacacggctagcctattatgccgccgttagtgggcatcttcgctttcaccgtcgaccgccttcgtcgccgccgactagtgtcttcattgttattgatggacgactttgttcccacattggccacctctgccatcaccaggggaatattacaaagctaagtcatcattaattttttttatatgatatttttttcctctgcctcactacatcaactggttcgccgttgactaatgagtcgggggctacagatgttatatcgtattttttaaacaattttcataatatttatcttgattgcttgcgacataatctgagtacaaaagtacctatcgagttatggagttctatcttcctatgctttccgtttggtttgtcgatggatagttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtttccgcctgcacggttggcctattatgccgccgttgttgggcgtctacgtcttcaccgaccggccgcctcgtccaccgtcgactgatgtttccgcctgcacagctggcttgttatgacgccaactgatgctatcttctttacggctggctacgtcgccgtcaccgctaataggcgtcatcatcttcaacgcaagctgtctacgtctactgccgactagtttcttcacttccatggctgcatgattctgccagtgttgattggccttatcgtcttcatcgccggtcgtctcgtctgctgctgactagtgccctcgcctctacgtctggtttataccgctaccattattgttggtcgccttcatcttcattgctggctgacctgactactgccgattggtttcttcgcctctacggctgtgcaactttgtcaccggcaccgacaaactctattgccgctacttcgctagttttgctacttcaccagccacgacgtctacaagagcttcgttatatcggcatgcgtcaccaaatatgatgccatgttattttactacaacaagtggtattccaatcttcaatatttctactcggatatcttcaacatgcatcttcactcaagcaatgactactcgacgacaagaagctaaagttttcgactctatgttcagttgtttcccaactaactaaagagtcgggggcaacacaaatacacggctcaaaattcgacaggttttatgtcaagatgaagcaatcaactaatcagccaacgagttctatggaatctacttcagcaactcttattatttcaccagtaattttggtttctccacgccgctacaatctactccaaatttctcaattatcaagtttgagatttaatctacatgttcgggagttgtatcagtcttcattatgcacacgctcgcatcaaggaaactacttgagcttcaatatcttctcaatagtttgatggattattgtcactggcatcatcaccagcacctctacttcatcggccctgacgtcttcgccgttgctaaggggtgactacgtcttcaccttcggttgcttctgtcatcactagctttcatcgccgacttgttatttcgttttcacggttggcctactacgcaaccgccgaggggagacctcatcattatcattaactgctacattgctatcaatgggcaacttcatcatcacatttgatcatctctattgctgccaatcgtcattaccatcggttgcatttgtcgtcgtcgactatttcctgcattttcatgattggaggatttcgccattgtatttgatgcacgtctacgtcttcatcgttggcttgttttcatcgccaccgactgatattctcgccttcacggctggcttattatgtcgccactaatgggcattttcatcttcttcaccagctgtctcgtctgtttctgactgattattttgtcaccatggctacaaaattctgtcgctattgctgggtgccttcatcttcactgctagttgatatgactgcttccgactggtttcttcgcttccatgccgattgcatcagctattaccgatggacaattttgactatgacagaaggacaagctatatgctcaggggcttatcagctcaaacacaagcgcgaggattatatcttcaatttggacttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttaggcaaaagtgcacgtgattatgtgcccaataccttaaaatccttttataccgcagttactcaactttttaggagttggtacaatgcatcttaaaaggtgtcaaacagtaaagctttatatagctgctccgctgacttttttatatagtcatgacactgtttgggtttatcaagcaattgattagatacaatatcattgcttttcgccacgtaagtgtgcatttttattgaccaatattatggcttaagctgattatatatcttggtcattttccaggcggttggtaaatcctttatgagtttatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcatatgagacaactagatcgtcagatctatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcaacaacgggttagccactagttttttactaatcacaattgcttagagaggtttaatgacatacttgaaaaaacaaatatatgatgtaggttgagtgtgaattcacttttcattggcaagttttaaatgtttttcctccacgatatttgcggtcagattatattgttatatactccctccattaacctttgttatgatgtttgaatattcatcctatttgctagtatgctaccaagtcctatatagaatcaaatgttatatgtatgacaaaattcctaagtagataagtaaggtgtcccatataagaaagagaagtagagtgtaaaatcaaaggtgtttttgattattattctgtgatgaacgattggcattgcagattattggttttgttatttggaatttattcacaaagtggttttggagatgattggattcacaggtgatcgcagatttatcattttatgtgaccggtcagaccgggctatgtatgccggtcagaccggcggtgatcgagcggtcggaccggccagtccgcggtcagaccggccgacgctgtgtcagtttcggttttgggttatttgtttggatatccgtgattatttcatgattatagcttctagatggatactatacgtatgtaatactgttgtttgctactaatgagtcaagttggagatagcttggtcttggaatatggtttctttgtttaattcatatgtaggtgactcgatgtctcggaagagtatttgcggtgatggaccgggagtcggcttggggataagacgacgtccgtggtaatcagagatcatgcgggatactaaggctagagttgatgcatgtggttgatggagattccatatgtcatacgatggaggtattgtgtgcgtatgggatgcggagtcgaatttggaaggagtccaaatttggtacgattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgtaaacacagagagaatcaataaagtcgtcatccactttaagagttcttcgatttgtgtttcaccgggtttcggcggtgtaatcggcggcacaccagcggtcagaccggcggcatcgcggcggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttgttttcttctttggatttttatcgatctagagtttttgccatggctactcctgctaggttttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgaagcttcttcatctaagtcttcttttgttgctgtttttaatgccacatccgatgatcaactcgaacagatcgaggaggaggatttggctttggttgctgacagaattgctcgagctatagtgccaggaacaggaaaagaggtggtccaaatcgttgctttgaatgtggttcaattcatcatcttcgttcgcattgtcctaaggtagggagaggcaaaagagaagacaaagatggcgagaagaccaacaacaacaagccgaagggttcatcccaagggaggaagctggagaatcttagtaaggcttttcaacaagtttgcgccgccttcgagccactaagtgatgtagatggtgaaagtggagatgatgataagggaaagaacatctccgatgtttgcttcatggcgcgtggtgaatctgacacaaagtatgaagataatgaggtaagtgcttttgaggaagctattaatattttgagtgaaaaaaaataagaagtgtgagaagatgtatagaaaacaggaatttatcattgaatctcttaaacaagaatatcattgaatctcttaaaatctcttattcctaatgatgatgattgttcaaattgtgaggttttaatgaatgagatttcaaaaattagagatgttaatgctgcacatgatttgaaaaatagatcttctcttgcttgtagttttactttgcacacacgcactttggatgagttgtttttaactaaaaagttgttgcaaaaatatcaaattggtttttatgctagtttgatgtttaacatgatttctgctaaaaaagttaaaacaacctcatgatgttttggattgctcaacatgtaatttgaataagttgaaattgaaagattctttaggttgtgttgagtacatggaagatgttgtgaaaaacaatgaagtgctttattgcaccaaatgtcgtaaaagcaaaggtgtcatggtgattgtgaaaattgtgctaatttggaaaaagaggtttcttatttgaaaaattctttgctaagattttctgatggtaaaaagaacctcaacatgattttggatcaatcaaaggttagcacacataaccgtggtttagtttttaatccttatgctcataattctagacatcctcctattgtgttaggtgttggtgctagaagtggtgagattttggttaaacctgattctaacaaaactgtgtttagatctgctggtatcatatctaccttgaatgcatctttttcaaaatccaatgttgtgcattcaaaatctcctgttgttgcttgtgttgctaaatcttctaatgctaccaatctgtctaatcatcgtgaaaaatatacttgttctttttgtggaaaagatgaacatattgttggtttttgtttcagattagctcataaacagaaaaaggagagagagattgcttttgcaaaatcaaagtggcaaaaatcgggttttccctcgaggaaaccggtcagaccgcagtgggtcccgcggtcggaccggtgaccggtcagactggctactgagcgtcggtcagactggcggtacagaggcggtcagaccggccactgtacctcggtcagaccggcctcggaggaaattttccgaaaattctataattgattttgcacgtggatatatgcctattggatcttctagtcatgtgtctcagtactggattcctaaatttttattatcatctaaccccagtactgaggcttcgacttctacttgtgtgtaggctttggtggcaaggaaggagaacgtgtggatcgtggatttcggttgttcgcggcacatgaccggtgataaaaattggttctcctcactcaaaaaggcatccaagactgaatcgattatcattggtgatgcttctacaagtgccgttctcgctataggtttggttaaggtaaatgaaaaatttgaattgaagaatgtaactttggttgaggacttaaagtacaatttgctttcagtttcacaaattgttgatgaaaattttaaggttcactttaagaaaactagaagtaaagtttttgattcttgtggtgattttgtgttgaatatttctcgctatggaagagtgtttaaagctgattttgaaaatcctgtttcacctgtgataacatgtttggttgctaagtttaataaagatgtgatgttttgtcatcgtagacttggacatgttggttttgatcatctcactaggttaagtggtttggatctagttcgtggtttgcctaaacttaagaaagatcttaatttggtttgtacaccgtgtcgtcatgctaaaatggtttctacttcacatgctcctattgtttctgtgatgacggatgcaccgggacagctattacatatggacattgttggtctagctagagtgcaatctgttggaggaaagtagtatgtgttggttattgttgacgattttcctcgatattcttgagttttctttatggcaactaaggacgaaacttttcaaccctttcgtggtttgtttcttcgattggatcttgaatttcctggttctttgaaaagaattcgaagtgataatggtggtgaatttaaaaatacttcatttgaaaaattttgcaatgaaagaggtcttgaacatgaattttcttctcctcgtgtccctcaacaaaacggtgttgttgaaaggaaaaatcgtgttttggttgagatggctagaacgatgttggatgactataaaactcctagaaaattttgggctgaagcttttaacacagcttgttatatttcaactcgggttttcttgagatctaaacttggaaaaacttcttatgaacttcgatttggtcatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttcttttgatgaggctagtccaggtactagacccgatattgcaggtacactatcacaggttcagggggaggatggttgtatttttgaagacgagagcaacgacaacgacgatgacgaggtcggctcggccggtcagaccgggtgccaggccggtcagaccaccggcacaccttcggtcagaccgacggaagacgtgcggtaagaccggccagggccgtcggctgagggttctgttgacgctgttcgagatggtcctccggagattacaacttcgactagtactgatacggaacgtggatcaacttcagaagtcgctgctcctttgcacattcaacaacgacatccgccggaacaaattattggtaatacaggtgagcggactacaaggtctaaggtaacgactcatgatgtttgtgtaaattctgcatttgttgcttcttttgaacccaaagatgtttcacatgcattaactgatgaatcgtggattaacgccatgcatgaagaacatgaaaattttgagagaaacaaagtttggactttagttgaaccaccttctggacataatattattggaaccaagtgggttttcaaaaataaacaaaatgaggatggtttgattgtgagaaataaagctagacttgttgctcaagattttacccaggttgagggtttggattttgttgaaacttttgctcctgttgctagaattgaggcaattagacttttgttggcttttcctgcttcaaaaggttttaaattgtatcaaatggatgtgaaaagtgcttttctaaatggtattatacaggaggaagtttatgtcaaacaaccaccaggttttgaaaatcctgattttcccaaccatgtttttaaattgtctaaagctttgtatggtttgaaacaagctcctagggcatggtatgataggcttaagaactttttgcttgtgaaaagtttttcaatgggaaaggttgacaaaacgctttttgttcttaagcatggtgataatcaactatttattcagatttatgtggatgatatcatctttgtttgttcgactcacgctttggttgtagattttactgagactatgcgcagcgaatttgagatgagcatgatgggtgagttatcgtactttttgggattgcaaattaagcaaacacctcaaggtacttttgtgcatcaaacgaagtatacgaaggatcttttgagaaggttcaagatggagaattgcaagccaatatcaacacctattggttctacagctgtgttggatcctgatgaagatggtgaagctgttgatcaaaaagagtatagaagtatgattggatctttgttgtttctaactgcttctaggccagacatacaatttgttgtgtgtttgtgtgcacgctttcaagcttctaggccagacatacatcgtcaagtggtcaagcgaataatgaggtatttgaatcatacacttgagtttggaatttggtattctacttcatcttctatatgcttaagtagatattcagatgctgattttggaggttgtagaattgataggaaaagtactagtggaatatgtcattttcttggtacatcattgattgcatggtcttctaggaaacaatctagtgttgctcaatcaactactgaatctgaatatgttgctgctgctagttgttgttcacagattctttggcttttatctactttgaaagattatggtcttacttttgagaaagtacctctcttttgtgataatactagtgctatcaatattgctaagaatcctgttcaacactcacgtacaaagcacattgatattcgttttcactttttgagggatcatgttgagaagagagatgttgaattgcagtttttggataccaagttgcaaattgctgatattttccataaacctttggatcataatcgctttgcttttcttcgttgtgaattgggaataattcatccttttggcatggtttgagggggagtttgtatctcatggttttatcaagcaataatatgacaatgagaaaaaattgagaaaagagaactttgtttatacatatggtattttcttgcgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatgtggtttgatttataaatgctctatatatatatgctttattgaattgttattcctcaaatagctttaattgctcattgtgaaaaagagaataaaaaatatgaaaaaaatgaataccgaatccttggaaacagtcttgacgacaaggacgtattcgatgtgagcaaaataatgggtgccgaatccctagaaacagtcttgacgacagggacgtacccggaataaaagagaaaaatatgagaaaaaaggctcaagaaaagaaaaagttaaaaaattctcttggttattttgtgctaaaggttatttgagaaagagtgataaatgtaataggtatatgtgtttagtgtttattcttcaacctatgtgcttgttcagatgttgcattataaatcgtatgaaatcatgaatttcgattgttgattcaagcttaattgtaaaatctttggtttatggttatactttaatacatgcttgttatcttatagataggtttatcttctttttattgcaacaaatgacttgatatattatatgtatgctaagctcttgaacattaatgaacataattcctatgttggatgaaatcattgtcaaaagggggagaagtattgtgaaaatttttggatttttgggagaagcaaggtgaattttcggagttgttgagaagagcatgtttttgttcaattgggaatttctttcttttaaaaagggggagaagttttcttttggatttttgagcacgatgtgtacgtttgtacgacgtgtgctttttaccacttttgtttttatttttccaaacaccaaaacatttttgataggtttgccaatgtgttcatcaaaggggagattgtaaaaccaaatgtgtttttgattattattctatgatgaacaattggcattggagattattggttttgttatttagaatttattcacgaagtggttttggagatgattggattcataggtgatcgcaggtttatcattttatgtgaccggtcagaccgggctgtgtatgccggtcagaccggcggtgatcgagcggtcggaccggccagcccacggtctgattggccgacgctgtgtcggtttcggtttcgagttgtttgtttggatatccgtgattgtttcatgattatggcttctagatggatactatacgtatgcaatactgttgtttgctactaatgagtcaagttggagatagcttggtctcggaatatggtttctttgtttatttcatgtgtaggtgactcgatgtctcgggagagtatttgcggtgatggaccgggagtcggcttggggataagacgacgtccgtggtggtcagagatcatgtgggatactaaggctagagttgatgcacgtggttgatggagattccatatggcataggatggaggtattgtgtgcgtatgggatgtggagtcaaatttggaaggagtccaaatttggtacgattggttatgtaaagtttctttcttgtactagagggtttcctaaggtgtttaggactcttagtatgagtttggttcgtggctttaggctgcctacctcgggtataaatagagggggagcgtgaggcttcccgatatcgctttt

SEQ ID NO: 69179 - DNA, 756 bp, Oryza sativa
tcctgcagcccattcattacgcggtttctaggcaagacatgaaattacttggccattcgtatccaaatacccttctaatatccggtcaaacgcccgatgtgacccccaaaaatgatctgttcgcaaactaaacaaggccgaaatctacacacgacgctccttcaatccgctctgccaaccagctagtctccgcatcccatcgagccttcaaggagaacacgcaaggaaggtgctgtatctaccttgcgcatgaccatcaagtggtgactatcagggcaatagcaatgcgtgccatgtatataccgaatctcagatgccacatgggctaaggaactgtggtagtcacaagattcacaatgtagcaactccaaatggggtccacaaaaataaagatgtccttttttgcctccactgaaccccatctcattctccctttactcgggaccaccgatatccttctactgccccatctatcacgccttaccctctctctcctctcatgctagggtggcagcctgactcagtcttctctccttacaccgtgtcgggtcggccaagcggagcatcaacctgcggaaacggcgccgaggtggccgggcagagtggcagcctctgaggcaactgagctaggcggagacagcgccgatgcggccgggcggagcgcctgcctctgcggcgactgagccggacggagcgccggcctctatggcgacgaagccgggcaaagaggccaccgcaaccgagtagagaggcgac

SEQ ID NO: 69180 - DNA, 8829 bp, Oryza sativa
  unsure (1)..(8829): unsure at all n locations
atgattatactttaatgcatgcttgctatattaatgatgggttcatcttctttttattgcgacacatgacacgatatgctatatgtatgctaagctcttgaatattactgaacataattcctatgcatgatgaaatcattgtcaaaagggggagaagagtttgggaagagcatgttttttgttcaaggggggatttctttatttttaaaagtgagaaaagttttctttttgattttgagcacgatgtgtactttggtacgaagtgtgctttttaccacttttgtgctctctaccacatttgtttttatttttccaaacaacaaaacatttttgatgggtttgccaatgtgttcatcaaggggtagattgtaaaatcaaagtgttttttattcttattctgtgatgaacaattggcatttgagatttttggttttgaaatttggagattattggtgaagtagttttggagatgattggagttacaggtgatatacaggtgttactggtttgtcaggaccggtcagatcgggcatgtgttgccggtcaaaccagcggtgatcgagtggtcagaccggctcagcccacggtctgatcggcccagcccgtggtctgaccggccgactccggtttcgggttgatttgttcggatagttgtgattgtttcatgtttatggcttctagatggatactatgcatatgtaataccgttgtttactaacaataagtcaagttggagatagcttgatctcggaatatggtttctttgtttgattcatgtgttggtgacttgatgcctcgggagagtattgccggtgatggatcgggagtcgacttggggataaggcgatgtccgtgatggtcagatatcatgcaggatacttaggtgtcacaccccgaactagtcctgagcggaattagcccgtgacgctccaatttaacctgttaatcgataccagtcccaggaaacagtgctggtatcacaggaagtcagaatatcagagcaacagaagtctctttattatagagtaggagtacagtcatgttgggctgcggacagatcccgagctcacaactacattacaagagggaagcggaagccaagacttggaccaaacatcacaggcgcgacttgggaactaggccaaaaccctaaaactcatcgtagccgacttgctcctggaagaactcctcgtcagcgggatctacttcatcttcttcagcaactgggggggattatttatatagagcaagggtgagtacaggagtactcagcaagccatgggaaataagtgtttaatgcaggcttcaaggaaaggctgttgtttttgcaattgattttacttaaactcttttctgaaaacaactaagtgagtgcttctcaaacgacacggatgagacagtgcgtctcgtccggtcggagtatgtgcaatgtatcagtcttttgaattgatcaaggttggcacccggccaacagctttcaaacggccacccgagcctggctgatcccatcagccgcagattttccaaacatcaatcccaaacctcatcagcaaatttcacaaagcagtagtcaaacaaaactacgctagaaatcacctcacatccgcccatgaccgtgggcacagctgttcgaacagtttaataacctctgcagagggggtacactttacccacacgacattactaacccggatcatccagcccgtgtagtacggccacgtctagagaccttaaggctttcatgacaaggcatttcgaaagccgacacaggttcaccatatgctgacgagaggggtcccagaccaacaacaggttaggtcccggaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcggatgaaattccaaggaaacggtccttaagtgcaagagcgggtaaccgtacacccggtacgttccccggtctgcgattttggaaattcatttagttcgcaagcaccgacccaggtgtcgggttttccgagtcttttgtaaaacccaagttttactcagaatgtttctcagattttaagtttgatggcgaccgtcgatactcatacagagtgcacgattaccgaggcgcaactaaggggttgcaagggaacatgatataacaattaacaatggaaggatcagatgcaacaagttaggtaggcccaccggtctgccttgcagacggtgcaaacagattaagtgcaatcctttcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaaataaagccctattattgacctctaagcgtgccattagatagatttcgagatttgaggaattttggaagttgaacggagtcaaacggacttacggttgggaagatattgaatttctaagattattggatttttggtctaaaggaaaaggatttatttaaatcctttttaaaaaaaaagaaaagaaaggaaaagaaggagggagggaaattagactttcctcgggcggctagggcgcggcccgagagaaaggggcggctcggccgagcttaatgggccggccggcccaagaaggcggcccaaagcgcgcgcgcgggcggggaggagagagtgagagagccggtgggccaggtccatcccgcgtggtcccgggtgggacccgcttgtcggcgactcggctcaccgtgagcgaggtgcacgcggggcgtgctagggtttttggagggaggcgcggcgcatgcgcgcggttcgcggaggacgcggtgcggcgggcccacgcgtagcctcacggctcaccgcggaccatgcgcacgggggggggggaacggagggagcggctggcgggtcagccgatccggtcgcggccgaggtggcgccgacgtggtgcctacgtggcagccacgcgggccggcgggaggtagacgatgatgccggccggaacggatggcggacggcggtggcgattggctgagcgaaccacggcgatacaggtgaaagcgagcacaccggggggttgcatgggacgaggggagacgagccaacggctcggattcgccggagggaactcaacggcggcggattgcggcggcggcaaccggcggcgagggaaggggaaacggcgacgaggtcacgtggggccgattcccggcggtgagagcatctacgcggctatgggaatccgttgctagcgtcggattgggcggagctacgccgagcgaggccagcgacgagcgggcgctatggagcacgggcggcgacggcggcgagcacacagctagcggcggcaacggtcggggcggcgccagctagctacaggaaggctacacatgctactaccgaaaactaaggggaagagatggatcgaggagggagaacgggggaatgcactaccgagatgaggcggggcgctgtgacgagaggccgacggcacgggagtgatctctccagcctcgggccggggaagaggaagaaggcgagcgcccagagtccccttccgtgtcctcgctcgtgccggctcctccggcacgcacgacggcgaacggcaatagcgaatagagcacgggaggcggcgacactggagtggaggcgaatgggagaggaaaggaaagggggtgaagcttgggtttatatgggcgacaatgtcggtttgggagaggggaaccgactttggacggtcaagccagtgagctggcgctccggctagcggccaaatcggcgacagggaggaggggaatgacgccggcggaggaagaaaaaggaaaaggaaggaagaaagggggcttgccccttgccactttcggaaaaggaggaggggatgggggcgacgcgacagaggggggaggagctctgcctccgtcccttggaggctagcgcgcggagtggcgggggccgggtcgatgacgacggcgatgacggcgggggcggtttggagcggagcaacgacacgggcggcaggcgcggcaggcgctgacggcggcggcgactggccggtcggccaccacggcgcgcgcgcccgggtggcgcggcgatttgggcggcatcggcgggaacggcagcgagagcggagagggaggagggcttggcgcggctcacgggcagagcggggagagagagagagagatggggagggagggagagatgggccgagaggaattcggcccatcgaacccgagggaggcaaagtagacttttgcggagggatttgatttgggaaggatttggattcgggattgaacttgacgatagatcggggattcgagatctgagatggcacggacactagacaacaagcaaagaaacagatttcgcaattaggatttttaagagatagttttcccgctaggcgccacgacagaacgggcgctacattaggctagagttcaatgcacgtggttggtgaatattccataaggcatacgatggacttattgtgtgcgtatgggatgcggagtcgaatttggaaggagtccaaatttggtatgattggagtttgtaaagtttgtttcttgtacgagaaggtttcctaggtggattaggacttctagtaggagttttgttcgtgcctttaggctgcctacctcatgtataaatagagagggagcgtgaggcttcccggtatcggttttgagagcattgagttgagagttgagttagtgtttcaagtttagtcgagattttcgtgaggggtgctgttgttgcaacttgtaaacacagagagaaacaataaagttgttatctactttaagagttcttcgatttgtgttttctcgggttcagcggtctaaccggcgagacaccagcggtcagaccggcggaatcgcggcggtcatactggggggtcagcggctgtcagaccggcggcaacttcaggcgcggcaggtgatctcggcggtccgaccagagttccaatcttggttagaccgacagcttccaggcggccagaccgacgcaactacttcggtcagaccgcgatccgtcgaatttgagggtaacttttaattccgcataaagtttgggtttttgggtatgccaaccattcaaacccccccctccttcggttggcttagttcttgcgtttcaatcctacgtttatatcataatctagaaaagaaaaaggactaaacagactcatctcgttggtcagacacatgttaactgatttgaaagtagttcaaacaaaatttatacaaatttgaagaattcaagtagacgtgaaatttttagcttgtgcagaagatctcgagagtacctgagatagacagatttcgctgagaaactgatccatcgtactacctaaacaatcttggaagtctatactatagagccatagagggctaataataaagaaggaaaaacgattcagtaagccatccatttcttgaattacagtttatgctccttctagtaaattttaaaatgtatttatctacaacctaaatatacagtttaagttcataaaaccctannnnnnnnnnnnnnnnnnnnnnctactaaaaaaggatttttcctgtacgaggagctatttagattgtagacggactgtttttgcgttcgcacggataaattggcgtcccattttcgcatgtggaccctttaaaagcccgcncacgaaaatcgattttcgcatgcgggcctgttaaccatcacgaagatataagggtattttcacatgcagacccttaaaaggcccacaggcgaaaatcgattttcacgtgcgggcctcttaactgaaccgcccgcgaaaatacctctcctccttttccctcctactcacttcaaaattttcaacttctctcctccttttcccttatattaaatccctcaattactctcacccctctctctctgtctacgcacctacttttccactttcctctcctacttttccctttcctctcctctccttccctctcctccccaccgatcgcacaaggaggagtaggaggcagcccgcaggagctagcggcaaaggtggttggtcgcggcgttgccagcagcggcgggctcaatcgggagcggcggtggcgcgatcacggcgacgacgagcggcagtggcggccagcaggcgcgggcgcggatggcagcgaggcaccgtgtggctctaccgtgggcacagacggcggcggcaactggcccctgcccgtatccagcggcggcggccgtcccccacccggatgcgtgcggatccaatggcggtggcagccggcgcgacggtggtggtctcgggcgtagacgacggtcgctgcggcgtcacgacgacagcaacagggtgcggcgacggcgcgatgatggcagccgggagcggcggcaggcgattctagggttaggattttttattttttttattttgtttttcttttacgtgtgggcggtatcccatgcagtccacttaacctgactgcactggaagatgattttcccctgcggttgagctgcccgcacgtgaaaatattgattttcccatacttctagtgcagacaggcaattcctccgcatggaaaaacctattttgatcgcatgaaaaaatgtttttttagtagtgaagaatacaagggttgactaccgggtagtatatatgtaattatttgctaatatactatttttatagcaatttaatactggaaccaactactggcataggcatatccaataaagccagctgccacaaatagtttagcgaaaattgcagagactaagtgttattctcagaagaagcattatacaattattactatatatgtcaatcatcgcaaggttctggttgttgacctcatgtaaactagatgcaagtgtgaaatatatagatgaacttacgttagacattatacacatgatggataaatatatgttgaaatatcatgaaaatagtatggaatgatgatttgacattcttacatgttgagctctagtgtgtactaactacttaactacataaaagttgtagaatgcacgatctacataaaattttgtctgtgtttgagggagaggggattaagaaaattgggaagatacgcaaaacgagataagccattagtgcatgattaattaagtattaactattttaaactttaaaaatggattaatatgattttttaaagtaaatttcatatagaaaatgtttgcaaaaaacgcaccgtttagtagtttgggaagtacgcacgcggaaaacgaaataaacaaactccctttgttctccaaacgaatgcaggtaatcatgaaaattcctcaatgaccaaccgacattttcgtataagagctactatttttctttattattattattattattattctatatatatatataatttgatttttctatgttcttgtagcatcttattgctgtcagcactgaataataaaagtgaaaaatatgattaattttctcaaccaaaggagaatcatttccggagagatgtcgattttgactgtttccgtccatttaactatatattagaaaaatcgacacatcagcatggtttattgttgggtcaaatcaaactaaaaacactaagtttaagccggaaggcagcgatgaatgagcaaagagaagaggatcacactgcaaaccggtttcatcggatgaattcagacgcactggaagggcatccactgggacttaatattgtttcctcttttttttttttatgatttgtattgttcgtgccatacaccctaacacccatacagctggccagccacggagaagcattcattggagccaaccatggtgtgagctagattctgatattcatgatttcattaaacttgaccctattcacaaccatggttgctgacctgtggactgataataaaacctgggatggtgagaaacttaatttaatctttaaaatcaagctgtgaacaaaattttgcaggtccagatcattcataatgataatgaattgctttgttggaacttggaagcattctaagaatggaatttgtaatactaagagtgcatataaggagattatgaaaagtgatcagattcataactttcaacaggtaaatcccctggtgacttctatcatcaaaatcatctggaaggacaagcttactcctcccacggttaaagtttttgcttggagactgctcggagaaagttctgcattcagcgcaaaagttaaatcacagaatttctgatatttcagctaattgctgtaggtgcaatcaacctgaaacatatttccatcttttctttcgttgttcctttagcagaataacgtggagaatttctgaagcaaatctttctactgacattttccctgataatgtttctctggctcacatcattgcttacatttcctcaaatggtcacctcctaaaaggtgtagaggccgggttaatttataatcctttatctaaaaaaaatagtactaataaaattgatatccataaatcttttcattatcttgtggtagctttggaaggccagaaatgatctgaaatttcagggcatcttaaaggagccgacccaagtgtgttttgtgttttgcggcagaagctatgataaatacatatactctacaaatcataatttgcaggtggaatctcaggaggaggaaaacaaaagaagaatggaaaccatttcggagggcaatagatgttatatagat

SEQ ID NO: 69181 - DNA, 806 bp, Oryza sativa
catattaggataacattgtatcttttttgctgcgtaccatttgatacccactttaactgaaaagaagatcatatatgtgtatgctcttactggaaaacctgatcagtagtaacttagtagatagtgacttttttttttaatcaagtgatcttattttcatcgcacttgttggggcgagtttttttttttgggggggggggggtgggggatggtaagatttcgttcttttgaattgttatacaggctcacaactctgtttctctgcaggaaaagaactatgggagtatcaaaataatgaagttgaggaatgcataaaccaatatatttggtttattttggaatatgcaaatatagccaatgacccaaaaagccatcacaaaacttggatggaggcatggtccaaaattttgagaattagttaagtctttctatcgaagatctgagatacttgtatatgatctgatggatatgaaaatgagcaagattgatgatttctcatcgccttttctctttaaaaaggaccatcatgtgcatctaacttaattatttgtttttagagaacttcacatataggcataaattaataacacaaaaccgtaggttttatgattttgttcacaatgcaaaccacatgtcagacccaagatttccttataccccgggccaaatctaattgctactatcccatatcataaatgagacccacactaatgcaaaacaaaaggtacaaattgttattgttagtttcaaaaggaaaaaaaagaaaaacaatcaagaaacaacatctaacctcaaaatgacaacta

SEQ ID NO: 69182 - DNA, 847 bp, Oryza sativa
tatatatatatatatatatatatatatatatatagggagagagagaccgtatatgactccagttaatttacgtgatatcgcttggatggtaattgcaggttagatggaaagcattggctgttacgtcttagagaaattcccaccttgtaccgtaattgattctaattaattgatttaggtgacatgattagaaggtaaattaatatgttttgtttaacatgtcattatatccgattgatggtaaggccccacaacataaaatatagataggatctacggtaatgatagtatcatccatctaatcaatagctagatctttttaattaacgtgggagctcgtagctagaaagtgtctgattagtatgattagtataggtatacatagacagaaaagacagaatagatagatagatagatagattagaaacaaaatgacacgagagagaaaagggcatttttatcatggcagcaagttgcaagtatgacaggtgccttctttcttgcaaatgaagctaattagttaacggaatttatcatggcagcaagttgcaagtatttgacaggtgccttctttcttgcaaatgaagctaattagttaacggaattgctagtttactgtcgacagtaaacggggggaaaactgtcgaatttttgaccgtcggattcgccttaagattagtgctagcgcgttggtggaaaaaatctgcgcgataactgtaatttgtgttctgcgtgggggtggggtttgaacccaggacctcattcccaccagctatatgtggtagccacttcatctcttgcaagtttttgaaaagtttgcaaccctagttatattgtagttacatcg

SEQ ID NO: 69183 - DNA, 7570 bp, Oryza sativa
  unsure (1)..(7570): unsure at all n locations
ggcaacaacaatgaacaccttatccaacctagagtcgtgcaggtggaagagttgcaggtgccacatccctttccccgttatcaccggtcgcctgcgacactttagccatctaggccccttgatggcggtgctacttcttgatgaccacctacttctagcttttcacgacgatggatatgtaaataacaccgtgggactaatatttctgccgccgccaccccaactttagcatgcgcctgcagtaggcagcagccccaacggtggagtagctacccccggcatatggaagagagtccaactatgaacgtgccatagagccactgttgttgccgttgaggatttggacttcaacctgggcaatctgcgatgccagagcttgagggatcagagttcgcaccgattggcctctcgccgctggcggcgcttgtcatttcttctcgtctccgattgtgctctagtcacattgagagtggggagggtagccatggggggtgcaagtttgttcgtgggccggttttcattagcctagtccaagagcgagcatgttctccatcatgctcactcagctccgttcgatggcgaacgaatggagcagataggctgaatgtccctctaacgtagactgcagtacgttagatgatttagttctggaggaagtgggggcacatgtgtcagatcatctcccatgagcgcgtagtgccgtagcagtagcaaaggggttaggtaataaagagtattggaccatagatgctagcctgatgggcctcgggccaaaccaataggggctcattgctagttgggctagaccctgngccatggcctaggatagtaaaaacaaacaatagcttaatttccgtgttatttggtttgaatttatctcctaaacttcaagcataactcaaatttgagaacctgtttagcttgatggttattgttttatttacaaaatatttttatttgccaccaaattaggttttctttttagggggagggggagaggagtgacttaccgtgcatttaattttcttataacaaaaaactttttttttttaaaaaaaacaaacataacaaaaactttaggataccactgttcgagaccttcaagtgttgtgaaaaatcaaaagttaggttgggtttaaaatcaatatttttgaatagaagagcagaggtgtgcccctctcagcatgacaattcaaccaacaaaggacaaacaaaaatctgtaaacctcataaaagttaatatggaaagagcactgctacacgtactctaacacatactatttgcagtcaaatttgttttttctgttaaatttgaacttgcattttttttggggaaaagaagatatattatttagattttttttagataatggattttcattaatccggcctctatatccacgaaggatatacacagccaaatattacttagaattagcttcctctcttacaatatgtgatacggaaggacaaccatcctctagccaaaaattagactcctcctcacatctagctctgtttgctaaaatatatgtgttgagtacatttatcagtactctatttgctacacgtactcacaattttgactacgggggatttttgaataacaatctccctatttctagacataagagcattgatctccctgattatataggccagggtagacaaatccttctctgcatattgcagcatgcgtaccgcttccaagcagtctgattccaccacgatcggttttagagtccattgaatcgccaaagcaattccttccttgtatgctagaagctccatttcccgtgcatcagagcaccttccaaaaaatctgcaggaagaaaagatgacagttcccctctcatctctcaagatcgtgccagtgcctccattctcataattcggatcaaaagagccatctacattaagcttcatccatccaggctgtggtttcctccatttctgaatccaagcctgctgagcacaagcctttttaactgacggccccgggagatagctaaccacatgtttcccttttgccaaattagccattgggtgttgtcggatttctaatagtgaaaagatatagtgatctcttgaaacctcctagatgcctcagttggtggagctggtttcccatgaaggatctcatttcagcagtaccagttctccacaagaccattaagaacatggcatgttcttcttccgggcgtagctctagttgataaaaaaatcttggatgaggctgaacgcctaacaacacaccactctgacaaactcccggtactctacatagcttcccacaaagctttggcaagaggacaccgacacagcgcatgaaagacatcctctgtttccatcccacatacagtatatggatctgaacttgcatatttgtatagtgacatattatatgttgatctatcatatcaaattttcttaacgacatgtaaaaacgagaagttgtctcctcaaaaggtaaataaacttccgcacaatattgcacagcaactagcaagacaatgtacaacaagtcctaatagcaaagcacggctaaagaacatagtaatctagttctagccacaagatgtatgcatagggatttgtattttctttttcaaaaatacaaattggacaggataaagaagaagaaaaaaagtccacacctgcacccttagcgagaagcacgcattacacacgccgaagaatcaaacacgaaaggtataacctacaaatggattatgccattgtggtttagggattcatgaccaaagttaattagctccatgctagctaggtggccacccagccatgtggactacggaataaaatgatcggtgttgtcaaactccggtctccttgatagctaacatgttcatcttgtagcagggagcctacatgattagcagtacgaaggctctagtgctagctctagcatatctacagcttctcacctggttttcagatctgctactccacaatccatatgccgttttagtctacaagaaatttacaccgcaaatcgtcataacctatgagaaacctatgagaagatgttcataggactttgcttttcagaaaacagtacaaacatggaaagaataattaggtataaatacgagtacatatgtcaaatctatgatttgaatactggtggacagattaaaaaaaatatgaccagctgtgcagttagtaatttcataagaaatttgctataacggttttcttcatgatcttaaatgtgtaagaaattgggacttttacgcacaaatcaacctgctgcagcatcgaagttgagcacatacgtgttatctatttttcagtgacttaggctaaaacttccacgtgtccattttggagatttatgtgggcttcaccggaatactagtcaaaactggactataagtgattagatgcatgggctgaaaaatctgataaagttgctgggctacggcgtaggcaactaagctgcgtgaccaaaaactgccatgggcccatggaaaatgttgaaatccaattggcaaccttaaccctgttggtttaggtaataagtccacttggactcccttaactagtggcaaaatctgattcgtatagttgaactgtataataccaggtatctaacccctcaactattaaaatcggtacaatttaactctctaggcggttttgttgatgtggcatctaccggatccattgttttgcttattaggggaataagcgaaatgacatatttccaaacgaaaaataatttgtgaataaaacttttacatacgtgttcttagcgatctaaaagcaaagactgaaaaataaacttcgatgaaaaaaccccaaaatcaactccaaatttaaggttgaaaattcaaattttagttgataagtataagcataagtgaaaagatgaggccctatgtagcagtgttaacctggtctttgtcccacaaatatatatatgtatatatatatatgggacctatttgttattcaccaaaaaatagaatgagcccacatgtcatcctccctttctctccctcctctctctctctctctccccctttctctttctctcccctttctcttcgcctttagccatctatggggtcgggggtctggagtggcgatggcaggagggagggtgggcaggcggcttggcctgcagaagcgtcgccgcctcctcctccgccttcattgccagcaccacccctaatccgctgagagctagcttattatcgtccgcctcgctatccaaggctgtcgcgtggggaggggggaggtagcaccgccgagcttgtgggcgtgctggcgcagggcagagagatggggaggaaggacaaagaggataacatgtgagccccacatgacaggggtcctatattttttttatgacaaataagtcccacttatatgtttttagttcttataccacataagtgccacgccaataccacatgggcaaagatcaagtcaacaccgtcgtgtgccacgtcaacaaaaacatccttcaaaaccgttgaggaagtcaaattgtaccggttttaataggtggggtcgagatatccagtattacggtttaagagtacgaatcaaattcggctactagttaagggagtcacagtggacttattccttggtttagacctggaagtacagtagtacacgtggttgagtataaagtaatggcccagcccacaaaattttgttagaaaacaatatatactgactcgatcatcgatcacgttgcctttttcttctaactcttatttccagccattccttttttactctgtcgatgtaatactctcttcatttcatattataaaacactatttttttaatcaaccttctttaaattttaccaaatatataaaaaagcaaacatgtacaacaccaaattaataatgtttattttgtattaaaaatattgctatggtttttttaaaaacttggtaaaccttaaagaagtttgactcataaaaggttaaaatgtaaaacggagggagtagtaactttgaataagtattttgtttggcaagtatttaagaattgcaaggtcacatgtttgatttaaccaattcagacactacagatgcagattaagagcaacagagttggaaaaatctcatgacaggacttgaagataaatatgttcgcccagtaattcttgtagtgtacaaatttttacccttttaggttgactatttaattacatcaccccctttttttaagcagaattaacatttgatgaacttttgttaggaaaacattttgtggcctgagggaaacatcaggcattcagttggtattttttttctacaggtatttagggatttgtcccaacacatatggcaaaggccagggatataaatcatctccattatatataaaatttgttattgttcagaacatttcatctatacagaaagtccatctaaggatattgaaggcatatacaacacatgaacacatgcaaacatgttatataccttactaatttttgaatattacacagaagaattacacaggagaccccagtcatcagcagacattggattgatcatgcaaatggacactgcaatatgcatccacagaggttaaagtttcagtcacctatgaaacagttttttgccttaacctccgaagccaaccaataccaaagttgtggatggaagtgcctggagctgaggggttcaggtcatagaatctttcttagacaatgtgcagttgttcaagcagggcaacaactgcaggtattacagactcatcactagctgctcaagaaaaaaaaaagaaagattctaaagaagtgattagagattctgaattttctggtagccatgtttgcggttgaaggggattgacagctatactagttgcacgcctctgcgttcatcagttttatccacagcatcagcatcatcatcatcatcaatcagcacagcgcgaccgcgctatcagatgatgcctgcagcatcatgtacatgctagtttgatcagacagttcctgcgcagacggcaccggctcgatcatcgacaaccgctccagcagagcggtgagcgcctcgcgcatccattcgtaccggcagagctggtaggcttcaccgggggagacctgttcattgatcatcaatagtgagtgacagtagcaggtaagtctctgaattctgagattcagagcttccattgacacttgaaaatggtgaaaacttgcaattcattgtgtggtgggacaatggctcacccatcgacggccatgggtcgcctgctccggccacgactcgagctcctcagtgacctccatggcgaagatgtagcccttgcaagctccccttgggctgctgctgttctggctgctcttgctcttgaacacccagtgtcccaaggtagtcctctggtacatgcacacaagaaatggcaaagcagcaccaaatgtcaatgaaccgaaaaatttcgcatatctgccggattcaaaggagacactgaattgttctaacttctgtcacaatttcgcagttgcatgttgcatttgcatttccactgcaatttcagcaactgttcctatcagcattgcaagttgccttagaattgaatggtttgaaatgatgaaccaagcgaacaagagtcttgtcctatacatggtactaacagcaacatgctgacatgaatgcatcacctacgtaggagtactactaatcaggctggtgatggcagtgtgggggagcaagtaggaaacacaccacatgcatagttgttggggacatggttgcaattcacactagataaaaataaaatatcagcctattgactccgatctgaaggagaaaaactagttttctgatgtcgaacaggccggtcgacgaagtatggaagaaataggggggaaacaataattcatctggcttaattataccgagatcttctcccccaactagaaaatcacaatgatttcagagtatcaccttataaaatggtgggtaatgatatgtttatccccaacccaattgtgctctgcagtactgattaggttggttagtcaaaaaccatttcgttgctgcttttttttttctatcttgtgtgagtctcaaaccaccaactgattgctagtacagtgctagagtgcagttctagccaatgccaatgcctatagagaaacttccatgtcgctttcaccattgaggccttcctctacattcctacatgtttacttagagccatctgaccatagttgcaaacccatcagcctagtttaaccattgctgagctttcagtgacagggcaactggacaaatggctccaaatatcggctgctaaattactcccactatcaagatttgcgccgcaacacgacaccgaaaaaggcgtcgcgccgtgatcccgaacagcagacttttcaggacgcaggcagcattttctctggacgctaatcagcattcaccaccaacagtccaacaccagtgatccacacgtcatcatcgtttgttgttgttaagcatgcgggggaatcaatatagtatgaaatctactggcaaagcaaagaacagtgaagtgttaagcgagagaggaaatggtgaagctgctgggc

SEQ ID NO: 69184 - DNA, 611 bp, Oryza sativa
ttgacacagtttcttcactatatgaaggtaaagtcagggaaaaggactggaagactaacctgaacagcatgcagcatcgttgcacctttcgctaattcggaagctatacatgaagctaaagtgcaaccagttccatgtgtgttatgggtctttatgcgatgcgcatggagctcaatgaactccttacctgatgaaaacagttcagaatttatatgaggccgctaaaagggcaggatgtagatgtgataatggacagtattgtattgaattatggaatttgtaccatcaaaaaatacatcagttgcatctgaggattctagcatatccccacctttcacaagtacatgtctgcaaatggtaaattatttgcatcagaaaataatacattagtctagacacaatttaatgggaatctaaatatcgcattcttgcatatgccattaatactgcaaatagcaacgcctaggcacatagttttggcacttatcgaataaaggcctaagaatataaaatgcagcattcactctcatgcaaaacagtaagactgaggcccaaaggtaggtacaaattaattctccttattctggaaataagacatttatatatccata

SEQ ID NO: 69185 - DNA, 594 bp, Oryza sativa
gtcttgccgatccagcggcgccgccgccgcagcggccgcgccgacgaaggagtcggtcatgagatcgttcatcttgggcgcaattgggggagattgctgagatcgatctcgcaaatctggggcaacaaaaaacgctgacttttttttccatttcttttcgattaaagacgacggcgacggcgaggtcgagttgtttggttggaattttgattttataagataaccgcacattcaagtttgaatatccatagaatttttgaggttttattttctacgtatagtgcgttatttgagactagtaatatgtccgtactaacgttacggcaaaatttggtaatacacgtgcaaagcatatggtaaaaatataagttaaactgagagcataaagctttactggtaatgcagccggaaaagtttacctggcacatgaaattcatgttaccaagtaataaataaataagcatgttttaaaccacgttgtataaaaatacaagtgcgtttaaggatacaataatacacaaataatacacagctccaccattgtacatggtataaaataaatgcaaaaaaaaaatcacccctcaaagatgaagg

SEQ ID NO: 69186 - DNA, 2645 bp, Oryza sativa
atcgatcaatcatttcgcttcaagaaactctgaaccattctggtttcaggaaatcaactctgaaccatttcgtttcaagaaactctgaaccatttggtctcaagaaagtctgaaccatttcggtttcaggaaaattaactctgaacaatttggtttcaggaaattgggtcggaaccattccgattgaagaaatcagcaccgagcaaatttcatttcgaagagagatggtggtgcagttggtaccttggggaagaccatgtcggcgcggttgggggtggagaccatgagcacctccacctggcccggaacgtcgccgaggatgcgagggttggcctcgtctttcttcacccggtacggcacgcagctgcaatacgaacggaacaaaagatcgcaaggaaagaattgatcagcaaaaagattagcaagaaatcgatcaagaacgcagcggggggatggatcgatggatatgcagcaagacgacccaccctgcgacgaggcggtactcgttgtcgtagcgctgcctgaggcggcccgtcctggccaccaccttgtccggcgacgacattgcaatctgccgatcctaacgcacgtgagcagatcaccaacatatacaagaagaagcaaacagaaagtaggggaaatcttggtcaccttataaaggaagcagaagaagggtcaagaagacgaacagaaaatgcctcctctgcctctggatgaggagaggtgatgatgggattggtgatggcggcaatgatgccacggccttatctctccaagggggggaagaaaattgaagacgataaaatagcaacggaagcggaggcaatctctcacaattcacagaaccgagagacgcgcacgcgcctataatggcgcgaggcctcttggttcccgccagatttatgggcgacgacgcgcgagtaggagagagaaagagagagagagagagagagaagaggggtcaaccaacgtgacccgcctggcagtctgccattgctgccactgccaccaccgacccgcccaaagaaagctacggcagacagatttcgcgccatttctatttatgttcctcgatggctaaaatacgctaatttaagctgtcagggaagcaacgagggaaaaatgcagagattgcagcaggggtgatcacgttctcgtgtgttagcgagacaatgtggtgtcaactgttaaaattataataccttcgtctcaaaataaactaagttagctaacgatgtgataaaatccagtacaacgaatttagacaaatgtttatctagatttattatattaggttgtgtcatatcctaatttattttaggattaagggagtgtactttcaggacaagctgaaaaatatattcccttcgtttgatttattttaggataaaggaaatatacttgtagaagaagctgaaaattatattttgttcattcggagatagatgtgggtaagaaattggctaatggcccgtggcatccctacttctaaagatttagccatatctatttaggtttattatttaggtttatgatttggtcaaatttttaaaatttgactttgattttatcttaaatagatatatatttttctaaaaaaatgatatttgttagttagtgtacacggtatgtccatgcaaaaatataactatatatgtatatatgattccacgagagtttaacttagtgctatgattaaatcaatgtgtacgctaaattttattgtgccatatagtattatatctgttgacttctaaaatgccatattgttatacggagtatactctatgcggtttcataattttttatattatgaatgatgttgcggtcttcaaaatatatcttcgactatatttttcattacatattgaaaaaagtaagtaaacatttaattatgttcaattagttttaagaagatatatctatcgttttctagtgtttttaaactaaatattaacttgttgatagtctaggttttaattgttttatcttaacctatctgaaacgtcaagagctatggaatgcatcatcaaagatgtgtcaccatcaccgaacaacaagtactatcatttccccgaaaaaaaaaacaagtgctatcattcaggggttgctatgcaaatcaaacctacatattattgtaaactctttatgaataacattgagaagcttcgtgagatcacgaacatgcatgctagtaccacaattgtcaagttaaaaatagtgatcatgtacttggattcttaggttgctactcaatacaattaatcaattatcaagaatctcatctgctactcagtagagggaatcttttcatgattaaaaggcggtgatatatggagtaattaactaggttcctagttgaaagtacgtatattcttttaaaagtttgagcaatccctattggttttaggatgatctaaacttttgagaaattcaataacacaacaaatataaggactatacagataaactatgccaagtcataaaagtttctcagtctgcctacttctgtgcatccatctattgccgtatatgatcttacagcccatataatttatacgtaaatagtggaaacaaggaataaataattatattgtagtcagcattgtaatgccctggctagttaattagcagggcgcaggaat

SEQ ID NO: 69187 - DNA, 826 bp, Oryza sativa
acatgcaacaatattttgggaccgtaaacagttttaattcaaaaacgtttcaactacaaagttgtaggtcgcgtcgagggctacaattttgatataaagtttttcttcattagagttcacatgaaaaagttataaattattttttatataaagtttttagaccgtcctgtttagggaccggggtgacacaactgaacaagttgaacgacctaaacgagtgatctgcaagtttagggaccgggatgacacagtcgaacaagtttgaggacctgaacggtcgatttgcgagtttagggaccgggatgatacaacggtacaagtttagggaccggtgatggacttttttagaggctgtagttccgggggggcattttcctttgtttgctgtgaaaacaatcataaaaaggagagaaaaggtattttagcatagtgaccctattttgatatgatagtactacctccgtttcaggttaaaaaatgttttgactttagtcaaagtcaaaccgtttcaagtttgactaagtttatagaaaaaaataataacattttcaacccaagacaaatttattatgaaaatatattcaattattgatttaatgaaaataatttgatattagaaatattactatattttactataaatttagttaaatttgaagtagtttggctttgatcaaaatcaaagcatctcataacctgaaacggagggaggaacaatgtaccgaacggttttgctaaaaaactggcaacagttttatgtggtttcccgcaaaaaaaaaagttttatgtggttgaaacttttgaattttcaaccgttcgatggact

SEQ ID NO: 69188 - DNA, 17399 bp, Oryza sativa
tatgggttgcagggttggttatgtgtccatttgtttgagttaaccaatttttttatgtgtgtaaacaacatctagcactagataattcgctagctaggtattatttgctttattttattttgataacacaagcatgttaatatatgttagtaccaaatatatgaacgtatcatagatcgtgggttggtagtacactaataagtaataacttcataattttgttcaaatgttagttagaatgagatctcaagccttgcattgagtcaaaccattttgtaacatagtacccacatctaaataactaaatgtatcattgatactccctcgtcccattttaaatgcagccatgagtttccgtgttcaactttaatcttttttcttatttaatttttttttaaaaaattaaaaacataagtcctgcataaagtactttatcatctaataacaataaaaaataggacgaagggaaacttatggttgtgcttaaaataggacgaagggagtgccaatgttccatatatagctgcagagagcagaaatttattctctgacaaacttcccattttcacatggctataaatgcattttaatcagctcgtcacatgcatgcccattgaatctccatcttgatcctgaccatatatactagtgtaattaaattattctcaacatgttaattaactgtttctttctagtactgttgaattgatgtttcccatttgatttatctattgtactaattaattaatgttcaaattgaggatgatgcattctgtttggagctctacaattcctggggtattctcattgaccagggatgatgagatctactctgctgaatcaataaccctgttccatttttctttgccaaaagaaagttgaacataggtggttttacaaaacatggcgatgataaacgaagactacatctataaccatgaagaagattaacgcaaaaaaggaggcacacattttatggtgtcggtcatgaatatcaaattactccctatttatccttgaaagcttactaaatccctctcgtatccctgaaatttacccaatctcttctttaccctctcatgcccctgaaatttaagaaattaaattaatcttcctatatgatctaatttaatttcagaactttttcgaaagagcagccacatgtatgcgtattacaagcatactgacatgctttcatatttcagttatatgtgttggtgtatatgagcacgatatctctaggtttggtagtttagcttttgtatcaggctctgccttatttgttatatggtctattacctctaaatataataaattaagctcttatcctccaagccatgtacaaatttaatcggtctctccatatatatgaaatcaataaatttgtacaccaaatatctccaaaatagatcatcactcaaagaactgttcccttgtcccaattgcatcatccttgtgctctaaccttttttatatttggcctttcaactgtactgaattttacaatagatttgaaagcgatgttggggccttaggggagaaacaatattcaatatggtgttaatattgttatggcctttgatatatatagcgacatgcttatgccatatgggctgcggtactgtgtttttattgaaacttttctttcctaaacacgtggagctatgctcagcagttgcgtcagtgcttctcttaatttatcgatgaaagtatagtcatatatagtgagtaggttatgatttttctctattagaaaattgtttcagagatttaccctcttactcttgtctttgtctatcccaccaaaccctactaccagataaaagggaccttcaactcttcaaacaaagaaattaacttaattatccctataaggctataattaacccaatcaatagtggtactagttcctcgtaatatgttgtagagtttgtactcccaccatgtaaaagtctctactgttataaaaattatatatatttttgccggtattttggtaagtcatcgtgtttgagttggtttttaagtcatttttgaaaatataaatccgtatttgagtcagtttttaagttcgttcacttttaaaaaatacagaatgagttgtataagaaatctctttaaacaaactcacaggctaacttaagacaatcgaactcctaattacaacttatgattttgtaagaaaaatatctaagcgaatttccatagggaatttgaccttagctaaacagtacaacaataataagattaaaatagccttcacctgttgcaatgcacgggcattgtgtgtgtgtgtatatatatatatatttgatatttaaattttataaaaatcataacttttaagtactaatttttcctccaaaaacctctcattcaaatttcttttcatcttacccctaatcacgttattcaataaggtactctatatgtttcagtttattaaagttctagcaaattttacactaaactaaggggtgtggcaaattgctaccctcattattaattgtatcctaatctccttcggtttcagtttatttaaagttctagcaaattttacactaaattaagaggtgtattaataaattgctacgaccctcattaattgtattataatcattttttttctaagcaagcatcaaaattccttgtaaggagtataggaagaaaaaagacatctctaaaaatattttggaatatgaagacgacaagtattttggcaaaattttgacttctagaacaacatgtaaactgaaactgagggaatagctcatttctcttccatactagtttattgaatgccataattttttttttggactgagggaccagtggtttggtcatacggggttcaatcgatattggataaaaactaagcgtatatgagagggttaaaccggaaaataatccgactacgagacatgacatatgcatgtttacatacgcaattcaatttttatagctaagatgtattttgagatgggtctacttacgcaattcaaaggctggatctcagagattagtttttaggttaaattcaccggtagaaaaaccatctttgctcggtcgtccaaaatccacaatagtcccggttcgaataggaaccgggactaaagattatttttagtcccggttaaaaaatttttgatcaccaaccggggctaacgatcatttttagtcccggttcaaaaagttatcggaccgagttagaccccaattcttttttagtcccggttggtataaacaaccgggacggacaaaaaaaaaatcaaccgagctggcgccactgccacgcccggccacctcggtctctccccctttttttccctctcctcacattaatcccttctccatccttatccatccctcctccatccttatccatccctcctccatcccttctcctctcccattcctctcccttctcttctcttcctcctcctcctcctaccacgtgaggccgggcggcgcgcggcggtagggagggcgtggagcggcgggcggccgagcaggcggccagcgaggcggcggtgctccccgggcgggcggtggagcccgaggcggcggcgctccccgggcgggcggcggagcccgaggcggcagcgggcgggcaccggccgccgaggcggcgggcggcgacgctccccaggcggcgacggagcccgaggcggccgagctggaggccggcgaggcggcggatggccggcacccgatctctgcgatgtggttttttcctgatctgtgcgatgtgtgcggccgatctgtgcgatgtggatttctttttctgatctgtgcagccaatctgtgtgatgtgatttctttttctgatctgtgtgatgtgtgatgtgtgaatgaatttgtggggatgattttgtaattttgtgaatgatttgtgatgtaggctatgtttagttcagcgtaaagtttggattttggttgaagttggagatgatgtgactaaaaatttgtgtgtgtatgacaggttgatgtgatggaaaaggactgaagtttggatccaaactttggatctaaacacaaccgtatttggagatagaaaatgcagcttgatgtatttggggattttgtgaatgatatgtggtgttagaatgatttgtggataatatgaatgatttgtagggctcgaaatcatgcaagcagcagtaaaagaaaaagaaaaaaaagaacattagtcccggttggtaactctaaccgggattagatctttagtcccggttagtaactccaaccgggactaaagatccttttttagtcccggttatttcaaccgggctaaaaatgagtatttttagtcccggattcgttagtcccggttacataaccgggactatagggggttgtgaaccgggactaaaaagggtttgttcaccagtaattggatcaacacacaagagttaatcgggtaactatatcgtattatcttgggcataacttgataccatcttttttgtggataccagataccagtgtcgtgatcgagccagcttggctcattttgaaaggactcacctttaatctttctataccttctatcatcgttcgctagcaataattatatatcaaaatttatacaaccatgcaatatcatttacaatatatttaattctacaaattaacacaaattaacatgaaagcatttccaatcatgatccctcacattatttttataatatttaaacatatatattcatcatgcattgaagtgcgggatactagtatcatttactctctccatcccaaaatataaaggatttgagagagtccaaattcgtagtgctagaatattcacattccttcaaatcgatgaagagagtagtttgtttcatgattagtaatttagtattacataacttgattaatatttcatttacaatctcccacagagtctactaaatctatttctttctaaacattgtttggaaaaaccaattttagttgtcactaataacgaatatcctttttacgtactcctagtatgattgttgaaaaaaaaccatatcaaagattacttaacaattctcctagcaaagcatgaagaatcaactactattcttcccgtctctaaatatttaaccccattgacttttttaaacatgtttgactattcgtcttattaaaaaaatttaagtaattattaattttttcctatcatttgattcattgttaaatatacttatatatatatatagttttatatatttcacaaaagtttttaaataagacgaacggtcaaacatgtttaaaaaaatcaacggcaccaaatattaaaggacggagggagtagttctgatctgatcaattgagtactcaattgtgatcttatgtacgcatgacaatttttcgctaaatttcagtcacacttattatatttcaaatttcgaaattttacttggaatatgcataaattacgtcccgcatcaaaacctcaaaattaatttcgtgacatttcaatcggttttcgagctatatatgtagaaatatttggagttaatatgcctccgatccggccggccggccggccatctgcacgtagaacgcacgcacgcgtgccgacatgccgcaaatcggccgcgtcagctacgttactccctagctagctagccgtcaaaaaatggaaacaatccgtgcttgcccaacgatacatcatatggtccatccggccgaaccgacgaccacgacgaggtcagtttcgacctgctgcatgccaaagtcgatcgtctacaaatcaaatgtaatggcaattaataggagtagtaattaagctatatatagcttacattgtgtaattagctgctaggaattaatcgcataccggtggcttacaggctggctggctcaaagctatgcatacaatatttatgtactcccttcgtaaaaaaaataccaatcctaactttaaatatgaatatacactatatccaaatttaaatttaaaattagatttagcattaggcttttcttaatagcagagtgagtagtcgtaaaagaaattgttttggacagtgacagtctaaaaaaacacaactttgacttcttatttctaataaaatattattgaaaagtgatatatgtatatttttatgaaagtatttttgaagacaaatctatttatataatttttatatttttaaactcaacaacttgagagttattcataatttaaattctcaagatttgacttaaatattgttctcaacgattttctttatgagtacggaggaattaagtaggaagtcggttgcgagatggaagcgtcgtcgtggcggctgactgggtcaggtctctagtctgcaggcaaggtcaggtgcttttgcttgtcggcaactcggcatcgatcgttactttcttgtctactcctactcattattattaattaatgggggtagtaggtcaatttaagtaggcacacgcacgcgtccaaactcgacccccaagctgcatctgcatgccgaccgcgaggagttgttataagccatacacggagtatgtaattaacccctcggacacgcccccgcgttccacagcgatcgccgacgtcgatcgagatcatgggcgcgttgctatatcatgttcgatggaaaaaaaaacagaaacaaaacctcgcaaatttcaaaccttaatttatatccacttaacgattcgtgcttaatttaggatgtcttcggaacctgttcccaacactaggtgcctgcacggaaaatggaggagcgattagcgggtaattaattaagtatttgctatttattttaaaaaatggattcatttaattttttatgcaactttcttatagaaactttttgcaaaaaaatgcaccgcttagcagtttgaaaagcgtgcgcgtaaaaaacgagagtgatgggtagggaagaggggctgccgaacacagtctttgcaactgcgtgcaagcccctgtgacctccatcgccatggcgccgcgcagattcatgttcctccatcgattcgaatacctcattcacttcaacaaccaaacacagtctgaccggttgatgttctcctggatcgatcatcagtcaatccacaccgttgatctcattcacttcatccgctatgcctaccaagggcatttatatttgcacatcatcttattgaagctagcaagcctgcaaccaattcctgctcagtactatcgatcctccatccctatctccctgcagtcgtaccgctagcggcgccgccgccgaccaacaaggcaaaggacgacggagcctcgatctccacgtctatatgtttatgattcgtaagtctgcgatgcgcctgctcaatctgtttggtagtattttctcgtgttgtgtctttggttcatgtttgcccagcaaattcctgattaatatgtatgcttgtgtcctgtacgctttcactcgcactgcagactaacgaatattggctatagccgactgggggtgcctgacgagatatggccgttgcactgccatcacacattcacaccagcttcgacatgaacaaagctgcagagtattgaaagctgattctgtgattcgtttaatttgtactactaatttattatatgagctaggcaaaatcacatagcatttacatacatggttttttttattcgtttacgtgctatttgccattttgtaattaaatctgttaagcgaagaaccacttacatggacaacactcaatctcacatgttttagcactaattataaattattcgtacataattttaccacatatacatggtttaattagtacataatataaggttttttgcttgcctgctttgaaattgttatccaaacgagcaagtagtttccatcttgcaagatatcagaattatattggcaatttaacgtacaaatgtctcggctagattgcatatatgaactcatctattgagcaatagtttttatttagtcaagaaagcttatttttcttacaaagtcttgccgcaacgcgtggggtatccactagttatataatgtttctaatcccatgaaaactttagaatccctgaacaaagttggttatttgttgttagagtctactggcttacgtctctttgacaacatatatattagagggtccactcgaggatatatgtacatgcgctttttgtgtaatcacaaaaatgaaaagaacattattatggctcgaatgtcattagatggtcaaatgtttcattggatgctcgcatacaacatttacaaaatagaggtggatcattactttaaaaaacagtaagataccgacatatatacatgtttaattagatgtttgatacaacaatataatctacatgtataaggtgtgaaacatcacttaaaataattattacaatatttcataaagattgtgccatgtccaaaaatcagtgcaacatttctagaaacaactggtataccattcgaatgaaaagagtgaaacacttgaatgcaaaattacaacaaataaaagaaagaccacaacaagttgtaaagagtatgcagaaggagcctatcagtctaaatgtacatatatacttgctcccttttatcggtcggatctagtctctatcaatgttaccaaagtggaccaatgttgagctttgttaggatccaacaagtggtacctctaggtaatagtaccactaggtaccaaataaaatccagccgttgaattagcagggtacgattggaaacgaaccgaagcggggcggagagaagacccgcgacgcgagcagttgcgtatagatgccataatctcctcgtcgtcctcaagcgcccgcgccgacaccatgatctccaagtcctcatccgccgcagtctctgccatcgctggaccgccgcaaaaatctcgatacgatgccggcggcttgcctgctcctgctgggctgcatgcaggctgctcccatccgcgatatcccaaacaaaatgttatgcaagggctcctaagctcctctagaaaaatgttttatccgttgatattagcatttggcttatggagagataatcggcagttaacatcgcataatctcgtacagaggaatcaaattagtgccggggaggagagaggatgctggaaagtagtcgagcagtcgtcccaacatatcagcccacgtcctccgatgtcgccgccgcgtcaccgtggccgcctcttcgtcatcgtgctcgtagccagcctgcccacgagctcaaggagatcttcccgttcccgtcgccgccctgagctatatctggcgccccgaagtcggcggcgaccggatctggcccggaagccggaaggggggagttgagttgggatggggtagggtggtgacggcaggttgcggcgagggaggcggaggtgtccaccgatctggccggcgagattggtcgcgccgccgccatggaggacgtgctggagggggatcgggaggagcggcgttgggaaggagcctgcggtacaggagtcagggaatacggaccatgcgaaatcctaattttgcccttccgcttcttcaatgcatgcggatgggatttctgtacctggcggtaccgaggatcgatagccgttggatttacctatatggatggttcagattacaggtaccgggaggtaccaaaagtttggatggacggtaaaaaaactctagaaggagaaaaggaaaaaaaatagagaagctttgaagggctcggtagtctaatgtacacatgcacttcctatatagtgtgtaattgatttggattttaaatcagaatgaaagaggaaaaatgcaagtaaaaaagaactgttggatatcttagatgaccgattggatccaaatgccaaatgccatagagagacagaaaacaaaacatggacaccacatacgtgaaaaccacaaacaagcataagggtaaattcgacaaacttgcttcaagagttgagaagcaagttttatacgtccggttttgaattttggagaccaaagttaaaacatttgaaatgttgaaggaaaataaatacttcttttagcacaaaaatgattagctatatcacacctatatcttatataccacattcaaggtaaaaaatcaagcatatgattgggccacgtggctccctaagattttagggtttgctcctttgaaaatcagccacatgtcccgtgagattcagctagagcgtcgatcgtgcaatgtctcatctcttctattaatctaaagctaacggctagccattcttctagcgtttcattggtccacatggcatgtttcattcgtccagccctctcgattagtccagacactggaccgtgaaaaagaaaaagaaaaataaaagaaaagccattgattcattcactgtctgtcatgggctgtacagcccagtcacgcactcatgcatgactgcactaggcctggtcatctagcgttgttgctacagtatttgcatgttgcactttaccttctcgggctaattaattagtaataacacaaacaggaccaaacagaaataggaaaaaggaaggtagaaaaaagtataaataattttgtaaaaaaaatcttcaaaacataaaatattgatatcatgtatttatataaaataaataataatcgggaaaaactaaatatcaaatataaagtgaaagagattggatgagaatttgtaatactaagaaccgttttttcaaatatgcactttatcattgatactatatgtacgattttttggttaatgaaatcacaacaattttgaggaaacataactttaaattttctaatagagtctctagctatttgccaaattattgatcatcattaattacaatcttactttggtttttctcataattctaagacaaacataaaattaaattccattaatatgtccatttgaaagaattttttcagagttaaacttactcatgaaacaatatattactctgcatgtttaatattacttgtcattctcacatttcaaattattatttttacatcgtggtcttctatcttcaccttttaaatgccatgtataactattaatcagttaatattgcttttgaaaacgattataatgtagttaataagcatatagcagtgtaatttgccacatctccttgtttgatgtgaaattttgctagagttacaaataatataaaatgagaggtagtcaaatatattacagatgagccatattacaggctaaattaggtggcacgccaacaggcgtgcagatcttctagtataattctattctacgattcacgaaagacaatcttataataactttccctgattaacatgcaagcaacttcaattttgttgttcgtacgattcaactagggatgtcattctctattttttttataggaataagttcactttaggttccttaatttatcgttcagtctgattttcatcattcaacaaaaataccaaatacaatctgtgtcccaacttacaaaaccaatgcaaacgaggtccctcgatagtattgtcctcggttttaactgacgtgacgtccatgtgactcctttgactaaggtcttcatctcacgtagcattgacgtggtacttatgtgacagtttgatccaaaataaatagaaggagcaaaattaaaaactaaaaaaattaaaacaaatatgtggggccccatgttagccaaacaagaagataaaaaatagcgggaccaacatatcatggctcccactttctccacctcacccctttacccctttatctctgtcacctctctccaccggtgagcgcgcatagaaagagacgaggctaggagggagggggtaggaatggaggagatgaggaggacgagagggactgagaggccggcgagtctcctctctctccaccacccttgccgcttggtgcaacagtagccgagggggcgaagatctaggagggaaaggagagcgaccgctactctcccccatccgccacgtgcccatcacctatcttgccgcgtgctgacttggaaagatggggaagatagagctgaaataggttgggaggagaaggaaaaagtacatcgaaggtccctcaacttgtcatcaaattacaaaatcgtccttaaaccacaaaaccggatacaacgtgtcccccaacttacaaaaccagggtagaataggtccctcggcagttttgactccagttttatccgacgtggcagctgactcagcgtgggacccatgtgggtcccacgtgtcagccccttcttcccctcccctctcttcctctctcctcttcttttctctctccctttgctccagttcggcaggcgggagtccgacggccggcgacgggcgatgaggcggcggcggcggctgcgacgagcgacgaggccgcccgctccgcctccacatcgcctccgcctactcggagcgggaggcggccgcggccgacgacgacctcgccgtgggacgcgctcatcgcctacgcccgcgccctctccctcatcgagcccccagatccgacgacgacgacaaccgccgcgttcaactcctcgcccccccacccccgccgccgcccagctcctccccggcggctgccggccgcgcccatctccggttcgattgatcgaccatgcctcccctcgtggcgccggtggagcacaaggacgggccctgcaggcagcggcacgcggcggtggcggcgatgacagcggcaacggtggctaagccgcagcagtggtcggcgtcgttccacggcgcggcgcggcggagcagcggtcgctgacgcagcctgacttgctcgccgagcatgtggccgctgcacgtgatggcgcgcttcgagtgtcgcgtggctgacctggtcgccgccgccgtggagctctacctccgggaggggcgccggctgctgctgctgtccgccgaccccgccgccttcggactctgcttcttcctctccccaaaggccgcaacgattgccgcaatcaccgccgccgccgctcctcccccaccagtttagggatgagagaggaagagaggaagagagaggaggagaagaaggggctgacatgtgggacccacgtgggtcccacgctgagtcagctgccacgttggacaaaaccggagtcaaaaccgccgagggacctagtctacattggttttgtaagttgggggacgcgttgtatccggttttgtgttttaaggatgattttgtaattcgatgacaagttgagggaccttcggtgtactttttccgaaggagaatgttccgccccattataagcccactgttgaatgtagtctatacatgtacaaattgtgagctaggatgacgttttactttttcctgggagcaaaaaggagggggaaatcataagaactaagaagcactaggtgaaaccccgcgcattactgcgggaatttagtatgataacaataaaaaaataacgtttaagatagctagataacatcagattaagtaaattaatgtggtttatgataatttaaatttaaatagtatgtagaatggtgattcaaacgtaaaaagtaaggtggtatgactttatggaagaagaaaagtaggaagatagtttggaccgtagattaatcatctaaaggctaaatacaattgatgtgatatgacttaattagaggaaaaaatgataatttggaccatagattaatcatttaagcactaattgaggatgaactatatataagtatataggatatcataaaacataaaacataataaagatatacattgaaacattatgtgaattatgttggatgataatttaacatgtttgtatttcaaaagctcttaaattataaaaactataaagatataacatgtttgcatgatgtttaaatgtgatgattgttagtggatgatgatgtgtcatcttgttaattagtggataatgatgtgtcatcttgttagtggatgatgatatgtcatctttgcatgttaagcttaaggagttaattagaggaaaaaaagagaaagataatttggaccatagattaatcatttaagcactaattaagtgaggatgaactatttaagtatgtatgatattataaaacatagtaaagatatacattgaaatattatgtgaattatgtgggatgataatttaacatacttgtattttaaaaactcttaaattataaaaactataaaatcatagataatataacatgtttacatgatgtttaaatgtgatgattattagtggatgatgatgtggcatcttgttagtggatgatgatgtggcatctttgcatgttaagcttaaggagttagtggggataactgtaaggattagttaatcagtattcatcagtaaccactatacatttttctttactaattactcctttaaataaaattttaaaaattaaataaaattctgtaaatacaaaacatattgttttaaataaaattttaaaaataaaaaaaattatttaaatacaaaacatattgttaattactcctttaaataaaattttaaaaataaaataatgttctttaaatacaaaaacatattgttgagagtgggatttgaacccacgccctttcggaccagaaccttaatctggcgccttagaccaactcggccatctcaacttcttggtcaaccagttattatattctaattgaaacagtttgtattacagatcacacatcttccgtgtaccaaattcgctaatcacccggatcgcgtgtgcccgtgcgcggaaaagcaacaccagcatgcacacacacacaccaaaaacgcaaatccaagcatcgcacgctacatcagcaacaacggcactatataaacccatcttaacgacacctgattagcagctccagtacactaattaacccaaactccctccacacacattaaccactgcacaaacgcagccagcgacagcgaggatggccggccgagccagctgcgtactcatcctcctcctcgccattgccggcttcgccgacgtcctcgccgccggcggcgcgacgccatcgtcgtcgtcgtcgcaggtgagcacgacgacggcagcggagttgaaggaggtgaacgggatgcttgcgtgcatgatcgggtgcttcacgcagatgttcgggtgcgccttcgggtgcatggcgaagggccccgacacgacgctctgcgtcgtcagctgcaaccagaacagcatcgtctgcatggtgcgttgcgccctcacgccgccgccgcccaagcccaagcccacgccgccgccgcccgcgcccacgcccaagcctcccgcgccctcgccgtcgccgccgccgcccaaagccgccggccacggcgtcgctggcgaccccttggcctagacatgtacagctcagctcactctactatacccctacaagtgctagctcctgatacgacattataaatgtgcctagctacgtgatatataatcaagaatcaagaaaatacaaactgataaaagaaaaaaaaatcaagaaatacgtatctatgtagatctcatagttttcatatatgcatttatgtggctgaacatgtgtttgtgccagccatatgtaacaaatgaaaatgggtcgtcagtcatactgagtgtatgtatttagtatgacctgagaaatgtactcaattgtgtaatgttccataattatgttctggaaatgaaaattttagattatatttttgtctgtgcaagcatctgctcttgcctaatagcacttccttaattaccacaggttagtatggtccttcctacatgccaaaatcacaccaacaacggctgcaaaatgtgtgtattcatcaagtcactttgctgactgtcagatgggtttctaagaattaacaagcaaattgtagtataaaatgtgagacttgagcaatgtgttaagatacggaagtgtaacttaatttacagtaaactgttaatacaacttacagcctgtagttcacctgcaagagttgcatctctccctttactccactttgagacagtatgtacaccttttttttttagtacataatcaatctttagtcctgcaacacagagtaataacataatggcaagccaacattacatctgcactaatctattatattattaaaacagccttgaaaggaggcaccatgttcgctgttgagactagaaattctcacattaatcggagaaaaagagaaaaaagctacacctttagattatacagtgcatatagattaaagggtgtagatttattgggcaatatttctattggtatgaaacaaactctatttatataataaataaataggaaaggttaaagtacttctaacgagcatgcatgtcagagtcctaatagtatttaggcaggtatgtccgattgggtgtggaaaaaaaaggaaaaaaaaacacaatccacggaaggaaaggggaaaaaaagatgcacagtccacggaagagtattttgtagctaccaaaagttcacttgcccagataatcttgatgccactctaaaatcacgtgcattcatccatcttgctatcaacacctacacgatagatcactggaaataattttgtagcctaccaaaagtttttttttctacttaaatacatatttgaggagtctgttcactatattggaactagaaaaaatatgcataattatatttgacgtttaattatgcgtttaattatgagggctttatatttaccccattaatcatatttaaaaaagtttagaccattaatatggttgatttaatttaaataagttataacaaaacatatacagtatataagttaatcgtataaaaaaataaattggcgtcatggatcactttaataaataataattataaacacacgggttcagacaagaaggacaaaaaaaacatccatgtcttcgtaatatttaccactttgtgaaccctttacttgagaaaataaagaacaagttattatgccatatgtcatatgttatactccctctgtttcatattataagttatttgattttttttcttatcaaagtcgttaggtttgaccaagtttatagaaaaatacattaacattttaatacaaaacaaacatattattaaaatatattcaatattaaatttaatggagctactttggtattgtaaatattactaattttttctataaatttggtcaaacctaaagaaatttgactaagaaaaaagtcaaatgacttataatatgaaatggagggagtagcacctaaaacataatttcatagacatccaacgtcacccacctacacgatcacaagcggtccatgagaaggcctggttgcgataattttggtctatggtgggaggcttggggtcgcctatgtaaaagaattatcataggcagcccactacgctggccacctctagaaatacatttattttttaggactacaaataacgggtgtaagtgggtaagccgttaactcacttataagttaaaataagtaggttcataacttattttgacatgggctgcagga

SEQ ID NO: 69189 - DNA, 16427 bp, Oryza sativa
actatagggcgaattcgagctcggtacccatttgaccacctcgttttcaatgattgcacagtgtcaattttcttgtggactcactgctttagtccattaagaagatgacacgtgtcctcagcatttgaaaaaaagtgtggtctctgtgcagggagaccagacggaggagtgccctctccctccctcccctcccttgccaagaacggcaaataaagtcatgtctcccagagtctccctttctaaaagcagcaaacatagtcacgagcggaggagacgcagaaggggagcaaacagctcgcccccaacaagttcatccccagtccagagagagagaggcagccaccaccaagttctttccaggccaccctcctcctcttccccccaccgcacgcctcactcaacaccggcgaactcgggagcgcgcggcccgagtgtgtcggcggcatgaaacgcaaggcaacaactgcagcctcagccgaccccgcacaggtgaaagacctagttcttcattgctcctcatataaagccggccccctcggcgtccgcctcggctgccgcgacgccattgttggctggttgcgctcatgcgcgcgatctctgtgcttcgcgagcgcttaacggcgagaggaagttccctctagggacctggggcatggccgtgcaggttcaccatggcccatgccgactacatgcataggaatcggctgctagctaggtggcagtcacggtggcagcctggacggggacgccagggccacgcggggtggtggcggccggcgatggggctcgagccgcgaggcattagccggcgatgagcaaaagagccacctttttattattgttattattattattattctcagatttgtgaattgtgaacatggtagccataaagggtttgacttctcgatctcccaccccgataggtaaagatttcggatgaaagttttcattttttttaatttagaaaaaaaatcttcaaatttggccaaaaaatgttcaggtttttttttctagaattaatagaatcatgttgtcatccctatatatgctcacaaatgccaccaattttctcactgggaatattattgatcatgtctcataattaatcttgtaattagccgatttatctggtcttttctcaggggggcagcgaagctgaaaaaagacaaaagatggagaatgagatcaagaccttacaggtcgttaagttcagtggtgtttactacactctgcctcttcatctcgtcgcacccgctgtccagcacgtgttgggaagaaagaccaccatattaaggatgaggggagctactctagatgagaacaacatgttacatctagagatagaatttttgtcccgtcatgctgccatgaaggctatggaacactgcaacgacatagacccgcgccacaaacgctatattcaagtaaaatggaatgatacaaatttggatgtgtctgctaacaatgaggaaccggtacttcaagaactatcatacctagagcctcagccggattccacagaagaggtaacttctcttttacatgattctaactagaaccggcttgaatatttaagttgatttgaacttgatagtgtttatgttggttaaaccgccctctgactatatataaatttagtgttttttctagagcatggaataaaactacaattaaaattggttctttcttttacagaaaaaggtaacgtcaactatttttcaaggatttaaccgatacctcccgtggcagtgagtgtactgattgttgcagatgaccctttcatgcccccgtacaagaattgttgcagatggccggcttgtcttttgatattagctatgtagtttccttttagaaatttagtggttagcgagaagaaacagatagtaacattttttggtgtaaattttggtactttctatcaagaggtaccaaattttacataaaaaaaagtaacacctcctggtagctcttaggaccattataaaagcactcttcctcttcaattagtctgcaaacaatctaaggtagtgatattttttggcttaccagtgtgccactttcgacaaacacactgtgacaatgttatttatgatcacaggcctatggttggctttggttgtttatacagatgatttgtaccagattgatgaggtacacagaaattcccagatcagatttgatgtttttgttgttctttctccccaatgaagccagaaggccacttttgcttcttggatttgttcatcagtttttgtagtactggccatttctttgttcacgttggtggggacatctttcatcctaagacaaactaatgtgtagaaaagctgtgagagaggcagcatatatgtctagatatgccctctcctccatgggattgagacacaaaacagttgtagatcacagagaaaacatgaatgcagaccctagaacaattggctaatttgtaaaaaaaaataaaaatagctccacgaaaaccaatcaattgggcttgtttggatccggagggctaataaattagccctccaaatcttactatttaggagtattaaacatagattatcggcaaaacccattccataacccccagttaatttgcgagacgaatctaacgagatatattaatccacgattagctgatgattactgcagcaaatcatggattaattaggtttattagattcgtttcgcaaattagctcagatgttatggaatgagttttgtcagtaatgtatatttaatactactaagtaggtacatgatggcccggacgtcatgggtggtgactggtgagcagctccgatccccgcagcttgtccatgataggagagagcaaatgagacgggtactgcgctgtcatggtctgcaccagtttatccggcgcggggtggtctgcttggacggcggcgatcctgagtgcgatcttcatcctgccatcgtcgggaagcaaggatggtcggggaagacagcggcggcggtcatggtggacgagctcgatggcgaggagaaggtcgtaggaggcgaggtagaggtaatgcctggcctggctgtccgtgaggtagcggaattacaccttcatgaacgcgaggaggccacagaaggagttcaatgagatgtacccccagccacggctgtacgtcctgcgtgtcctcttcttgggcggcggcggcaggtcctccgctccgccggcggcgaggtgggcgacggcgttgaggatgatgttggtgacggggtcggcgaggccaaagcagtatccgaccgcgccgacgcagtcgacgatctccgggatctcctcgaggggtagccgtcgcgccgcctcggcgacgtactcccttatggactcggatgatttgtcggccggtggcagccatggcttctcctcctcctcctcctcctcgccgtggtaacacgtccatctgcccaatccgggttcatcggaagacgacgacgctgctcgatttagggtttttcgccgcttcatcctgctacgccggagcgtagtcggacagttgtgggggaggaattagttcacattgactcccttaactactgatgcgaatcagattcggtcactagttaagggggtccatgtgaacttacttctggatcagcccagcccaaccaaacgatcagcccggcccaaacaaacgagaggaggcttttgccgtgtcgtgtccttttttctctcgggtgtaggacagcacgctgtgcactcggttcacgcacgccaaaatattgccgcacccaaagccgcctccgctcctccgcgtgcgccgccgccgactcgatcgaattcgatcgcttccgcctcctccaccacctcgacgcccgtctccgtcggcggcggcggcgagctcccaaatcctaggctagctcaggccccccaacatcaccacagaaaccacgggggtctcccttccctcaactccaccgcctctcatcggccgcgggagaaatcggtcgaatcccctccgcccgcgctgccgccgggaggtatgggacgcgagccccctcctttgctgctctcccttatcgcgccggcgccccgattgtgattgctggttgttggagttgcctatcattcgatctggggggggggggggggggagtagattggtcgctagaattggtggggtggacatgattgcccgatgagtggattgcgccgccggctagcttctaactagtttgattggtagcttctaactagtttgcacactactttcatggcatgggctcggaaaacaagcaaggaagaagaaattctgaaaaatcagttgctggcacctgtaattctatactaccgaacaagtaaacctacatattataaatgtaaattggccggcatacaagtaaacctacatatgtaaatgtaaattggccagcatacatagttctatactgaacaagttaaattacatgaaaaaaaagaaagccaagtctagttgcatgatcagttgcatatcgatgttcggagggaaaaatggatccaatggatacggcatcagataatacaacaattccttgccataggaattcctagtatagtttcacggaactgacaatgtggtttggctcccattttttacctgataagcgtttggcaatttgatgatcaacaacctgatagctgctcatcaagtatataaaaccccatttgatctgtctcctaccagtattgtatagaaacagatgtgaatcatccttgatatggtttgattctgcagttcactgcaaatcttccatagataagaacacatagagaatttggaacttccaaatcaacctcaatcaagattaggacaggaagctttggagtaactttaacaagggtcaactttactgcaatgaattggaattttaatcatcttgcccatttttctctgtaacataatttttttttctctgaaagcacaagaattatattgctcagtcattcttttaattaatccttaatacactgccctaatttttgtgtgacttatctgagtgtctctgtaacacaagtgatatttctctgttagcacaagatggtattttctcattcaatctttagttattcctttaataaactgtcctaattttagtgtgccttatctgagtgtctggattgtattgtactcatcaagtgcagctgaagtcactctactatttggaagtgaagctgcttattcgtaattacactgatgtaagatgccttttcttcccctctgttattaggtcttagctttaaaggtctagctggagtatcctgaatggatttgaatgcttcaccatcgcctgaggaagatgaccagtcttatgaagagcatgctgatttttcacagagtgaacatgctgagtctgctgttgagataatgcgaagggtaaataaaatactttcttgttttaaaccatgcaactgttttgcagcattagaagagcattccccttgagatgagaccatggagtttttggactttgtattatgggttgtggtgaaggcgatatcataagaagtatattagaatataatactctgcaatagacagacctggcaaaccacgttttaacttaacatttttcttctagttactcaatctacatctctattatctggaccaactggtcatttggtgcgatcttcttttgtttcatatagccagcggcatttggttttcatatgttctgtttattttattactaattaagtagttgatgctttttaaaaacagcaatggtgcaaagcgagcttaattattattttaaccaatttcttttgagttatgatccatcattgctacctgtttatatctttcattaatcactaccatgtttcataggaacgcgaagagagacggagaaagttaaagagggagcaacatgatgatggaccaaggctgaatcgacaaccgattaggaatgatcatatgaatcaaaataaaatcattagacatggacgaattaaagagccacctcagggtatgtatcgtgtgctacggatttctttatcatgttgaattcccccatgtaattcttaattgatcaacctatgctaagtagactttaagttatgtattattacatttaaattatcattttttaattattatcaggctggttggattgccctggatctggtgagccaatagataggattgtaccttctaaagttcccctggatgaaacattcaatgagtctgtgcctgctgggaaaagatattcttccaagcaagttgttaataaacaaagaaaagctggaagagatgtaagtactgcatgctacctaatatggccgtgataataatgcacatgatattcgttttgtcctgccttctgtttttttccttacgcatggtcacagatttgaagcaatttttgttagaaaaaacattcgtatttctcagttcaattcttacgaattgttatttgtacagtgatgcagaggcttctaatagtcacaagagggacataaatctagttaaattttagaatattattattatttattgaataatatgatttacagtgcaaatatcatgaattaacaagcagaagttgcttgtaatagatatctgaaataacatttattctgctaagtgctaatgcacttctctcattctttaatatcttgttcctatttattgttgaagggagcatcacaaactccaggacactttattcaatttaaattattttaaagagattgcagctaattacctgtgttgacatatttttttcctccacttattttatcagataggtttagtgattgacttgacaaataccactcggtactattcaccaactgaatggacaagacaaggtactaaatatgtcaaggtgagaaagtgagatgcactccggtagtttaggattaatctaagataaagtccttttcactcttaaagtgtattttcatttagattgcctgcaagggaagagatgctgttccagacaatgaatctgttaacacatttgtgtatgaggtaattcaaattatttggattcatgattttgacataatcttttttgtcagctatgttgtttttcccactttcttttagatatgaatattcagtgtcccttcattgttttacaattgaagcaatttgcttttgtttgagattgaaaaaaaactttatgatgaaaatgtatttgctcctaatgtaacttcatttgacaatgcaactggagttagtttttgattttaggtaactttacaggttatccatttgctttgcttgaagtttgacttatagttgttgatatatttcatcttgttagctgtttgttattaattctaacctcgaatgtgttgggtatttattttccaacatggaagaattactccctaaggtttatggtaattactaatattctttccaaatcaatgacactacatgagagatgctttgctgttataccttttatatcatcaaactacaaagaattaactttcaacattcaaatgcatgtctgctgtagttatcagttctcttaggagttcattaggatcagtgataattctcaacctgtccccatgaaaagtatcaactgtttaaaatgctgcatttatctagtgttcttctggtttatgtgcgtaataatcacctattggcttacacaaagtttcgaaaactagcattgaccgtgtgttccgtatatttaatcaggactggttaaacacagtggactttagaaattacatgtctagatttgagtttgagcttcaaaactatgaactagttggcattgattaaagctatgcgttgtctatgttatgccttctaaatagaaggcctgcatatgtttccttctaacctgaaaatgttgcatatatgtcactagaagtgaattggcacacatacgactgtgaacagagttattacataggtagcttatggcctcgtgtgtcttatttaccaatagaagtaccctgcttatcaaccgttccagattaactccattcttgcctctgctggctgtcaatactatgggttgctggatgataaatttgttctagattgacataggttagttagcctctgaattctggagtaaatattttttttgcaattcagctatcttcaagttattgtggtagttatttttgttgattccaattattttgttgttatgtttgcctgtttggtgcaaatgttgtaaatgtatatgaaatgcaatgagtaggtagtcttgccctatgtttcacctttcactggaaaagctctttattttagggcgtgacaattgtatgtaataagtctgttgatcaaacttgacattgtaacttttaggtgatggcgtttcttgaccgtcaaaaacaatcaaggaatcccaagtatattcttgttcactgtacccatgggcataatcgtacaggttttatgattgttcattacctaatgcgcacacaactctctagcgttactgaggtaagaaaaaaacatgtttcaatttgtatttgttgaaaataatttgacattttcctgagctaatgtttttatttgctaggcactgaacatatttgctcaacggcgacctcctggaatatataaaaatgactatattcaagctatctattcattttaccatgaaattcctgaaaatatcgtatgccctccaacaccagaatggaagaggccctctgatcttgatttgaatggtgaagctaagcaagatgatgatgatgatggcaatgtagatcgtgcaccatcacctgtaggttttcatatagtactatttatgactccctttgttgattttacctggatgtataagtatctgattcctattcaataccgcaatatgatttgacaacactaacaattaatttgaaaaataagtgactatagggaggtatatctagtgtaaactagaatatttttgtaccatgtaatgttagtaaaactgtccttaaagattgcccaaaattctcaacgcaatggatgatatagaggaacagatatttgatgcccctactttttttatgatcaaatttaaattttttgggagaaataaaaattatgtttttccatatacatgcgagtttggccataaaagttttgcagtgtcatttaacacatttcttttgcagacccacatccaccaaagtttgaatatttcatgggaaccgtatgcacagaattaacttgaattgcactggatttagtcttacagctgcacctaacatttaactctgcatatgctgctccaatacagaccaatagtaaaaatgccactgtgatgcattagtgaattacctacccttagctctttcattatagctcttgtgcataaaaatgcacaagaaagatcatgttactctgtttgccactgttgtttctctcactaaccacttaaagaatatggtcacctcataataagagtaaatacagggcaatattggaatttactgcacattaggacttggtatttgctaagagcaatcttaggcaagaaacacaattggatgattgtaaatagggaaaagaagatgaggacatcttggaggtgttacataactatcacttcttcatccctatcatagttgggtgagacaggaaccataatcatgattggtaatttccattgtacatgccaaatcataacccaattcatgtgccatgaaattggtttaaataaatcaaaagttacagggtgttagtttgaaagtggcttataggattctctcttgtctgagatgattgccaaattggaaagtatgatccacttcagttcagacaggttgtacaacctaggtaggccttttttaaggaactgttgtgcttttgtttgaggaccaaaagccctgatgatattcatccaacctcatcctctatttgagcacgtgcctattagaaaagggtataaagtataaacctaattcattgtttataaaatgatgaatctaattcataacgaggctaagcatctcctagacgatagccagatggctttggcttgctagtagggaaggaactagtgagtgagaggggtcaaaaggggacttatgcagttcattgttagctttcaatggatgatctgaatgtatttcctataatctcatcatactaaaggatattttgttcataaataacatgtgcctaacaatgtgtctaataatttagagcgttacagggtgttttatcattctctgttcaaaattgtagatcataaaaaaaaaatcctgaaaagattatatacatatttttatgttctttaatttcactcaaaggatcccttcttattgcagaatcacgaagatgataaagtcattactaatgatgatatcttaggggatgctgtaccttatgaccagcaagatttcctgcgcagtatatgttttaggttacttgaattagtgcccagtgtaagtttacaacgcgttgttggttactttgctatattgttgttgagtcacattgttttccccttcttgattacaaacatcttaatttgcagtactgtctgaaagatatattttgaaagctttgtttctatgttcactgtagtatgaacttgtagcttgctttcttgattatataatactgctgtttcatttttttcttactagtttagaaagttgtttttatcttgcttcaaatgatttcaggaatccttttgttttatcacaactactacttagattaactgtggcacaattttgatgcaaacttatttcaaataattgtaagctgatgcaactgcatgcaacatgatatgatgttactaaatgcaaattcagagtataatttttgaaccttctattttcttgaaaatagcaatagacatatgaattgattagtatcacaatctcagctaaccctttcactcaccagggtagagctaatgctcagtttcccggatctcatccagtttctcttaacaggtatggatttatgtccaattttgattcttttggcaaagtgacaaataaattagtgactgcaacagctgatttaataattaatacttgacggtttatatcaaaggtcatgccaagtaccttatttcaggcatgtgaaaaacataaaatatagatgtatatcacatgcaactatgcaatccttatgtaaccgtagttgagcaactatgcacatggtttactttttaaggcattaatgttctagcaagcaaagcatctgaaggatgaaaataaaccacataagtttgagggtaaagtaatacatactgaagactaagaaatcaacttcaactctttgcaggagtttgagcactaaccttgtatatgtggctggaatttgcttagatttccaaccttccatcaaagatgtacacagtactcaacttcgatacctacccatcccataatgctgtcataattcacttcctcactttattttgcgccacccttgttttatactggcctcctttgtcttaaatatcccactctgcaccaaattcctttgacagttaggcaccccttcagtccctttgctacacggtgctttctgtgtggcatttgggtcattcggagggattctacttttgcctttttttgtgcctggcgcatataattcattctgtaacagttgatgctacattttctggtgagatcatgagagggcatacataatgttttgtctttcttattctagaatctatgggacttaagaacatcattcacacattagtaatttccccctagtccatactttgtattgcaattgtctcctttccctcacctcacccccctatcttgtagtttcttttgttggccttctggtcctttcctcctaactcatttcatttatattttgtatatacagcgagaatctgcaaattctgagacagcgatattattatgctacgtggaaagctgatggaacgcgatacatgatgcttataacacgtgatggttgctttctaattgatcggaacttctgctttagaagagttcagatgcgttttccccttagaaattcgaatgaagtaagattcccattgtgatgcatagtgcattttattctctttttcaccatcaaattgtaaacttcaaacttccttttgctgtctgaagggttttcaccactatacgttaattgacggagaaatgattgttgacactgtaccggatttgggattgaagaggagatacttggcatatgatctaatgtcaattaattcccaatctgtagtcaaggtagatatgcttcatatgttatcattaattggtgatgcaattttgtggtcttctcagttgacactattaatctaagatgttgatttttttatgtacaatatttcgtataaatatttcccaagcactcccattcgaatagtgattacaaagcagtatggatattgttagaggttgctctgaagatttatatgctacttattaataagtcaaaattctcatgtctggtttagatgcttgctgattgaatcgatttttataatgatcccaatatacatcttactctctaaaagagtgagtgattttataatgttctacacccacccactccatacctctctggttttaaatatgtaggaatgtgtgcgttatttgtaagattttaatagaaatatattgtatcttttcatacaagtataggttggtggtcaattagtctatattatcatgtatgtgtgttttaaacttaaattagtatttatttactgcattttgtattttttacttatagtatacagtatatttatttgggatctgttgcatgcacgggtatggtgccactaattttaagttagaatgacattgctgaagaattgattagcttaaggccacataatttcattacttgccatgtttgttattttgtgctccatatgtacatacttattatagtttgatttctggatgcagttgcctttttctgagaggtggaaattacttgatgatgagataatacgcccacgctatcatgataaaggacgcagtccatcatacaaatatgacatggaactattttcggtaccgacatggaatatggaagtttggacttatttgttttttcatactatgttggtgcactaaaattgaaatatatctggcttttattaggtaaggagaaaggatttctggcaactttctgcagtgaacaagatactgaaggagtttattccaaagctttgtcatgaatctgatgggcttatattacaggtaggattcttgtgtcttgtttgtacctttcaaaactagaaaagctattacaaagaagttatcccttcaacttttttcctgattctgatgggtttatatcataggtatggttgtcatatgtcttgtttgccactttgcactctaactgtgatgattttgcattcttctagtttctcttatgcaacattggaactactgccatgttgccttgtacaatcaactagatatttagtgatgtttatgccctctgttcttaaatctagtgtgttgatcctgccacaaatgcgtgttttggaaactgacagtccacaaaacataacttataccatgtttatctatttttatatatttgtaaatccttattcaattttatggtaaaatacttttgattggagagtttaatggcatgtatttctgactgtagggagtaataagcattgtttagctcaactatgactgttaggcccatggtcatatcctccagatgctcttgccgtgtattcggagtagatgtactaatttctgttttcacatgggtggattcttactgttgaactggttctggaagtggtttgctctatgttataagtctcatatctaataattacaatgaatcaagcttaactagggacaagaatcctttgtcagccaaatacttgctgtcctcaagtatttgttgtgaagctaggaatgtttgtgctaggaatttcaggattatgcttcactctagtgcatgtctcatttatgctgagacttctcttttgatcaatttgtatcttgtggcaaaatcccatcaagttgattctgtgataatttcatctcttcagaacgccttgttaaccgccagaatagctgcttccatgcagctgattttcatccctccatgcatgtcaccgtcatatcccaacttacacaaaatgggaacttctctgtttttcttttcttcatgtgtttctgttgttttttatgtagggctgggatgatccttacgtgactcgtacccatgaaggtcttttgaagtggaaatatccagagatgaattcagtagactttctgttcgaggtctgctttcttccatgcaaagttttcagatggatttacttagttatttattgaagttttctttccattgttcaatcgttgtagattggcagtgagaatcgtcagttcattttcctctatgagagaggtagaaagaaacttatggacggtgcccgggtggtgttccctggtaagcatccatttaatttaattacttgtacatttgtctttattttctggataatttacaacgcatagatggtgcctggttggtggtccccagcaagcatatatttttcattttcaaatcgtgcatctatttgactttatcaaacaacttgtttttttgggaattataatcatgtcctatgctaatattctcatgagcacacatatattatgttccgaaattttgaatataacccagcaacttttactaagcagaacatacactggattttgtcctttaaatagaacatacactggttcaatgctttgtcgtgcacttgtgttatgttccttgttaaaattttcattgggatttccatgagttatatagtgttcctatggctcttgatacgcctgattgtttcctttttgcaacatgtcatgattcttgaagtaggctaattgttatactgtgttgttttattttttcctaattattgctgatgcactggaatttaacgcagatgaagttgacccgccttcaatatcagggaaaattgttgagtgctcttggaataaagaagaggactgttggtcctgcatgcgcattcgaacagataaatcaactcctaatgatatcaatacttacagaaaggcacgtcttcctctcctctctcacacatgtactatatcaaattgttgaatactaccgtcagttgcactggttacaaggttaacagttttgtttgcttctgtagaactttacatttatgttctattcttctttcatgaaattgttctgtgatcaagaccagatcctgacagtgttcactgttgatgggctgtaactgcttgctttgaatgcaatatacctttatcttttacaactctgcgtgaagtttgcagctagggagtttatatgtgctgcaaatactgattcctccctattaatttgagttcgtgatgataattcagttgtgctgaggcgctccaagatacagttgtgacatttattggttggatttagttttcaaatgctgtggtttgatgaattgacttgggatttaggacttggggcgcatctcatttcacttgcttgctgtcgtgccttgctgttctggttgtgtcatgaatcaagatgtgtagaaatctaagatttctgttgggcatgagaaagcataaagacaatcctaacctaacatttttcctctggtaaatggacaggtaatgaggagcatcactgataacattactgaagacaagctcctggaggaaatatatgagatcatgacctttctatgtatgctgataggaaagcaaaggctcacgcgcgaagtatggctcaacaacgaaggagatgattaggattggttatatgcattcgtcttacttcttagaattatagagagttgtaaccctacaaccaacagatggcaaaggctagctggcccaggctgtagcatgcatagataatgttactatatcttcatagcgagccttatgcaggccgagaatttttttttcaatatgatctttctgttggtcattcacatgtgtcatttcagaatgctgtaaatcttcaattaatcctgtattctgtatatccctctttttttgggctataccttcctttggttcaaaatcgctccaacatacaaccagggtttccccaaccggcagggccggggttaccacgtggtaaccgtgaaaaactgtataaaaccgggtaaaatttatcaaaaattcaaattatttttaaaatttatttgaatttaagaaggataccgcggtatttatattaccggacccttgtggtaagcccgataaccgcggttaccggcggtaaggtaaaccttgcatacaaatgggggttgtacaaataggatgtgtcacttattagtgatggtgggaagatgtcgacaaccacaatgcacacatgtaatgtgcatgtaatgaaaaagtgaagagtaaattttacaaaactatagatattctagttaaattattataaaaccacagatttaaagcgatgtatcacaaaactccatatttaactaaatttatcacaaaactacaaagattt

SEQ ID NO: 69190 - DNA, 11173 bp, Oryza sativa
ctagaaatacaatttaaaagtaactgaaattcagaattaaaaataagcaaaattgaaagaagagtccatataaaaacccaatacgagattattaaaattaggaataaaaaataaaataaaatccgaaattagcaaaaaaacaaaaagaagagttcgaatacaaatactgtcagggttacgggttaggtataccctttacccttcgatatacgtcgcatatcggtatggcatacccacgcgcatacggataccctctgcatatattaaggaaatccttcacggagtttacggacgaaaagagtcctactcggacaagactgggtcgtcaatgtatcgtgtagggtctgatgtctccaagttcgacttggaaaccgcctgacctgtgatataaaagggacccccggggaggacctaaggcatcgaatctcagagccaacacaacccccacagcatacgaagccggagcctgcaggagccaaaccgctagggatctagtcgaaccaactcgactacgatctcgccggatccctcgagttccaccgttccctttgtaatctgtgtttttccatcatataatcccgcatcaactggattagggctattacctatcaaggggcctgaaccagtataatctttgtcttttgtttgcttgatgtcgtactacgtagatccttataccaacataccccaataccctctatatccggtctacgggtatcacccatcgacagtggcgcgctaggtagggggacttggtgctcaaggttctactactatgtcatccagcttcgtcgacaacaacttcaacaccaacctcaaccagggattccctgcttcaacaatgctggtgtggactcaagtcggagaaatcgtcttcccagtttacaccacaatgctgatctcagccggtccatcaatgaccggaaacgagaatgcagtggctacaaaccaaaacgactccatgtcgaaagatcctcccgctgaggcggagaacggaacatcaatgacatccgagctcgagaaggattccaaggcggccaaaccttgtcactccgacaagaaccacgagccgacaaggataacttctgaagcgacaaggtcctggtgtcctatccacaaaaccaggaaacatactttgcaagcctgctgggttttctcaacgtctgcgccgaaattcgcgcctgcaaagagcgtggaattcagcgtatttctccaactcgtgatgtctattgtcctatccacaagacaaaaaatcacgacctctcaagctgcaaggtttttctcagcgccatgaaggtgtcatctcctaaggtccaatagtcacacatccccatcagggataaagacaaggaacgaggagcgacaccaacttcagatcgatttgttggggtaatcgacatcggtccccatgaaccatcagtattgcacctcctcgaagactatggatcatcgacagcgagcgcgccgcgggaagtattggctatcaacgatgtcggcacgtcagcgcgcaccaatgcagaagcggagaatcaagtggccaccccagcccagcacatcagagccgtcgacgctatactgagggaaaccccctacgatcccgttctgaacgacgatctcgcgcgttggacagaacgactacgggaatcagtgaccaacctcagcaatgcgttcgaagaggccgctgccgcagcgcacccagagcagccaccaactggcgatgccaatggtgaaaaccctgaacggagggaatcgcctcatcgggccacccctccacctcgcggcaccggcgatctccgcgatcacctgaacggccaccaagaggcacgacgcacacgagacaacgagaaccgttcccggcgccatgtctcttcacggcatcatgataaccaagatcgaggagactattcaaacgaagaccgagaccgtgataaccgccacaactgccacgatcacaacgatcgcgaacggcgggcgccaagcgatactggtcgaggacgtcaccataatgacgacgatgatggagaccggcgccgagacaacagcggaagactacaataagattctcgagagccaggccgacatcctcgtaatcgtacgccggaaccaagcgacccatcgtcatcgtcatcatcctcgtcttcctaatcatcagacagacatccacgaaggacacacgatcgccgacaacccaccgcccctagtgctgggtgtagagctttcagtcgttccctgcgtgatgtccgatggcctgagagattccgacccggagcaatagagaagtacgatgggagcaccgacccaaaagagttccttcaagtctactccacagtactctacgccgccggagcagacgacaacgcattagctaattatttgccaactgcgttaaaaggctctgcacgttcatggctgatgcatctcccgccctactcaatctcttcgtgggcagacctgcggcaacagttcgtcgccaacttccaaggaacctacaagcgccacgcgatcgaagacgacctacacgcgttgacacagaactcgggtgaatccttgagggaatatgtttggcgcttcaacgagtgcagaaatacaatctccgaaatcaccgacgcttctgtaattcacgccttcaagtccggtgtcagagattgctatactacccaggagttggcaacaagacgcatcacaactactcagagattgttcaagattgttgagcgatgcgcccacgcagatgatgcgctaagacgcaagaacgataagccgaagaccgggggagagaagaaaccagccacggacacacctgagtcaagcaagaagaaaaatcgcaagaatgggaaaaggaaagctcaagcggaagtcctcgcagcagaatacacgaaccctcccaagcgcccagacccacaaagtagcgacgcaaagaaaacatggtgccccatacacaagacggacaaacattctttggaagattgcctttctttcaaaaagtcgctcgagaagcacattgcatttgaaaaaggcaagtgagtacgcgtggtcgaaaaggatgcggaagtggctccccaggaatcggactcagcatatccagactctgacctccacgtttcacacatcttcggaggttacacaacgtactcctcaaagcgagaatacaagaaagtggaacgcgaagtctattcgacatggcagggggctgcaccgaagatgaagtggtctgaacagaagatagaattctcggaagaagaccaccccaagactgccgtcatcccaggacgatatccgatcgtggtcgaacccactattcggaacggagcagatcacctttgatgtcgctaaattcgatacagcttataatgccatcatcgggagaactgcacttgcgaagtttatggctgcatctcactacgcatatcaagtgctcaagatgccgggaccgaagggaacaatcactattcaagggaacgcaaagctggcggtgcaatgcgacaaacggagcctcgacatggtcgagcaaacccccagcccacccgccacgactgagccacccaagaaagtgagcaagacaaacaagacgctgaaatcggacgacacaatcaagatcgttccactctccagtgccaaccccgacaagaccgtcaagatcggggcgacactaagcgagaaataggaactcgcgctcgtcaccttcctccgcgacaatgctgacgtgttcgcttggcagccgtccgacatgccgggggtccccagggaggtgattgagcacaaactcatggtgagacccgatgccaagccagtaaagcaaagactgcggagatttgcatcagaccgaaaacaagccatacgagaagagctcgacaaacttctcaaagctggcttcatcagagaagtacttcatccagagtggctagccaatccagtcatggtgcggaaggccaacgggaaatggagaatgtgcgtcgacttcactgacctcaacaaggcgtgtcccaaggatcacttctctcttcctcgaatagatcaactgctggactcaacagccggctgtgagctgttgagctttctcgacgcttactctggctaccaccaaatcaacatggcaaaagagaacaaagagaagacagcattcatcacgccattcggggtattttgctatgttaagatgccgttcggactcataaccgtagggaatactttccagggcacggtccagggcgcacttagcgaccagctcggcaacaatgtcgaggcatacgtcgacgacatcgttgtcaagaccaagacaagcgactcattgattgacgatctgcgggaaacgttcgacaacctccgacgatatcgcctcatgctcaatccagagaagtgcacgttcggagtaccgtcgggcaagctgctcggattccttgtctccggcagaggaatagaagcaaatcccgagaagatcaaggcaatcgagaacatgaagtcgcccacaagactcaaggaagtacaaaagctaaccggatacatggcagcactgagcaggttcgtcgctaggatgggaaaacgagggcaacctttcttcgctctactaaagaaacaagacaaatttgtatggacacaggaagccgaagaggcattcgttgtactcaagcgctacctatcaaacccccctgtacttgttactccccaacctaatgaagaattattcctctatattgccgccatgccatattccgtgagcactgtcattgttgtcgagagagagaaagtacaacgaccagtctattacgtcagcgaagctctccacgacgcaaagacaagatatccacatatccaaaagctgctttacgcggtcatcatgacatcaaggaagctacgccactactttcaagcccatagagtcacagttgtctcctccttcccgctcggtgaagttgtgagaaataaagacgttgttggccgtattgcgaaatgggtagtcgagctgagccaatttgatgtccactttgtgccatgaacagccatcaagtcccaggtactcgccgacttcgtagccgattggactatgcctgataacaaatcagacaaccaagtcgacaccgaaacgtggacaatggcgttcgatggtgcactcaacagccaaggagcaggggcaggatttatcttaacgtctcctttcggagatcaattcaagcacgcaatccacctcaacttcagggtgaccaataacacagccgaatacgagggactacttgccgggataagagctgcagccgcccttggggtaaagcgactaatcgtgaaaggggactccgagctagtcgcgaaccaggtgcacaaagattataaatgctctaaccccgagttatccaagtatctcgcagaagtcaggaagctagagaaaaggttcgatgggatcgaggtccaacacgtctaccgcaaggacaacatcgagccagatgacctagcacgacgtgcgtccagacgagaaccgctcgagcccggaatttttctggacatcctgacaaagccatcagtaaaagtggttagcggcgaagttagcccggccgcccccgacattagctcggaggccacaaaggcagaacgtgccgttgccgatatcgagaccacagatgactggcgcatcccactaatcaaattcatcgacagcgaggagttgcccgaggacgataccgaagccgagaaaataacccttaaagcaaaaatctactgtatggtcggcaacgatctatacaagaaagcgccaaacggggtacttctcaaatgcgtctcatctgacgacggcagacacctcctccttgatatacatgaaggcatctgtgggtcacacgccgccggtcggacattggtcgggaaagcttttcgacaatggtttttctggccaaccgcccttaaagatgcatgcgacatggtccaacaatgtgaagcctgtcaattgcacagtaaacacacaaagctacccgagcaagcgctccagactatccctcttacttggccattctcgtgctgggggctagatatacttgggccattcccacgtggacagggcggctacaggttcctattcgtggcgatcgacaaattcactaagtggatcgaagcagtacccacgggggaaatcaaggccgacaacgccatcaaattcatcaaggggatattttgcagatacggacttccgcaccgcatcataaccgacaacggctcccagttcatcagcaccgatttccaggattactgcatcgggcttggagtcaagatatgcttcgcctcggtctctcatcctcaaagcaacggacaagtcgagagggcaaacggcatagtactacaagggatcaaaacccgagtctacgacaggctcatgtcacacgacaaaaaatgggtcgaagaactctcatcagtactatgggctgtacgcaccacaccgacaatgtctaacaaggaaacacccttcttcctcgtgtacggctccgaggccatgctccccagcgagctacgacatcagagtacacgagtatagaagtattccgacgaggatcaggagaagcagcgaaacgtcgatgtgaaactactcgacgaacatcgcgaacgagttgccgtccgagcagccaattaccaacaggccctccgtcgttaccacgagaagcgcatccgagcacgcatactttcgaacggcaactacgtcctccgatgggttcaaagccaagcagggcgaaacaagctctcacccaaatgggaaggaccttacacgatcacacaagtcttacggctaggcgcattcaaaattgcagacggtgatggtcgcgagttggcaaattcttggaacattgaccaattacataaattctatgtatgagtcaatatcatccatatctgtaagacaccttacagcatcaataaagcctattcttaggcgcatattacaatcaaagtgttcctgcccgatgatcccttacccagatgacacctagcgttgaaaccaatccttatgtccctttatgtcgtctcgacaagacctccgaggaacctaagggatattcggctggggacacccagagtcgataaggacttgtcagatcctgtagagacgaaagaccatgtaagacctggtcgtgtaagagttctcgccgtgcgtattaaccaagccgtgtaatcggaaattaacttattcaaccaaggcaggtcaaaggtccaagatccttatcctccgagaaaatttctctgacgacaaggctaggggctagggagaatgtacgactcaaacgaccgactaaagtcgtgaactgagaacacactctgacacacgatatccggagtaagaaagatctgttaagatagatttcttttccatttcacaaaatactccttataatttttacaagtctaaggctatattacacttttccctaagatgtctatcacagggtacaaagactaccaagaaggccaacgccagtccatagattggaagaccttctccgccaatggcgccatcgacttcgccagttggtctatctccgtcggagtcctccgggaacgagcaaaaccttcacggagaaaatcgaggtccaggcgcgggcgatgatctcgtaggcaagccaacacgtgccctccggcatatcggctcgatcgacgacactcctgcttcaaggcctcgtcgatgcgtttgccgacgccatcgagctgagcacaggccccgttcagccacgagatgtatccggctgccgactccttgggatccccacggggtactcggagctctctacaaaccttggccatggatgtgcagcaactcttcaagtacgagttgaaccacacctcacgacctcggagcgtttccacagccttctttttcttcactgcaagcatggttctctcgagttcccgctacttcaaattttgtcttccaatattggatacgacgatcttggccagcaagagcactctcgagatctgcccaatgtgggaacaactaagtcaagctgcacgcctctttcgagaacatagctgatctagtcggaggagcaataagggatgaatggaccactaacctaaggaagtcgtcgccatccccgtccccgtagctaggatctggtctacattgtctggcgacgcatgtggttcaaacgcgagagccgaaatgatcgccggtgactcaggctgcccgcgctgctggacatcctcatcatcaacatctctacaagggacaaaaagtactcaagatcaacatgcaagagtaagctaggataatagctgcacgcacaaaggcggttgaggtccatcaaagttttacacagcatgtctgaggagtacaagagatcctactcttcaaaaagagggagaacagattcccccagatcgccgacttcttccatcacctccttacgcgcatcgctagccgccccctgatccaagatctcgcggagatcgagttcaggatgcgccagcttcacacacgcaaggacgtggcatgtcccggtatagattccgttggacgtctcctccccgatcctggccgcatgcttggaggggatctcctccatcgccgccgccagcttcgcaagagaagatgtcagtgaaaactcatcgggattcgccgggatggtagacttgatgccgcactccccggcgagctggtgcataccagtataggtgacccgcaacgagccacggattttcgacagattgttcccgagctccgacatgcggtgctcgagcccctgccgttgtcgctcgttgccagccaccaactccctcatcttcttgaggtcttcacgagcctccgccaactcgtgtaccagccagttggcgcgctcgttcgccgacgccgccgccgacctcgcctccgcaatctcgcgaccaatgccacgagcaccagcctcgaggaggcgccccatttcgacctggagctcctcccaggtgaggacggcagccggtggaccacgaccagccgcgggatcgctggctgggccgcttggtgttgcctcgcggctcccgggcgcaagcacgacatccgtcgaggccacagcgggagacgcgccggaagtccctccggactcatcttgcgccgccttcacccacgccgccctatgagacagccatggttcagacaacgctcgaacaagatcacggaaacttaagttcatccacttacttctcgccaagtgtcacaagtcgttgtcgtcgtggaggcgggggagacgcgtccgaggcctggaaaacggttgatgcgaagtaaggcgaaattcttctggctgtatgatcagacaacaggatagcttaccgagggggtagatgccttgcgacgatgtccgcttacagaggagaacttcctcccctttgtcggaacattgccaccacttgtggtagcagcagcagcagcagcatcggacgcctccttggcgaccttctccttcagtgacgccaccacctgatggtcagcgagcggcccgatgatgtcagtcagaggaagagcctacgcttaatcaagtcacaaagcgatctcggaagaaaaacgcagaatgcctattgagtacacttacattgatggcagtgtcacgttcggctgcctccttctcacaaaggggaacatggatgttactcgccgttgtcgggccactgatcatcacctggccgacacgacgtcccacggtttcgctgttcagacctgtgaatcgagaaccaaattttgataaatcaggaggaacgtgaacacgatcatgtcaggataaatacaagaaagataccccgaggagaaacccgggtcgcgtcctccggtccagaatagtcaaaagctggatggactcgagcctggagcggctggatccgtctaccaacgaagtcggcagcgacttcatacccagaacaacctcgtactcggagatcgtcgacaatatcgatgaacgactggagagaaggggtcaaggggggctttgcggtccaagacgaaatcttatccggttgttcctctggaacaacgaagacagggtccgaatcttcgatctgaaggtagaaccacctcgttcgccatttgctgtgagaggaagggcactggaaggggatataacgcgacttcaggcaatcccgaagtcggaacccgacgcatccagacaccctgttggactccatccaacacagctcgtagtagaagcgaaagagatcgagaaagggctctaccccaatataggcctcacaaagatgagaaaagatgctaagaaaggcgatagaattgcggttcagtacctcctacttccctctccatggttccacgaccgggaagggcgccgtcttcctgaagcttcttcagcgacgcgctggtggaggatgatttgccaagatccatcaccgatcggagatcgccggagaaagaccatagaagttcaataccaagagaagaaattcggaaggtgtagggagaaaaccgcagagaatgtagtcctcgatcgtaaccatgcgacctaagacgagctagggtttcttgtgggagcggagaagacgaagaacgcttgcaggcgggatgttttcttcacaataggcggacttcaaaatggatccccaaaattcctttaaatagacacactaccgacggtgtgaattccaaggaaaggagagagatgcccgccggaaatttctgggtctgttacgcgcggcagttttttagacttcagtttaaattcaatcgtgaccattgggcttcacatggtgttctcgactacgtcatgtctctacggtcctcacactgggaacgacaacagtctcgacacaagaagtcgcgaatggttacacgagttcatttaagcagaagtcgggggctactgtcagggttacgggttaggtataccctttacccttcgatatacgtcgcatatcggtatggcatacccacgcgcatacggataccctctgcatatattaaggaaatccttcacggagtttacggacgaaaagagtcctactcgaacaagactaggtcgtcaatgtatcgtgtagggtctgatgtctccaagttcgacttggaaaccgcctgacctgtgatataaaagggacccctggggaggacctaaggcatcgaatctcagagccaacacaacccccacagcctacgaagccagagcctgcaggagccaaaccgccagggatctagtcgaaccaactcgactacgatctcgccggatccctt

SEQ ID NO: 69191 - DNA, 10009 bp, Oryza sativa
ctcgtaaaggaagtcgttttgggcagcaacacggtctccaaaacacaacttttacttttttgtttctacaaaaatatttattgaaaagtgatatatgtatacttttataaaagtatttttcaagacaaatcttttcatatattgaaaagtgacagacttcctttaggagtacaggagtacggagagagtatatctaggcaattagagacagattagcaacaaacataatttaccataatgatctagtcctgatatagtacactactagctatagtaaatacttccattatattgtattgtaaaagttctctaagtgtatgtgcatgcacttaatttttggaaagctagcaactcaagagatataattaactaataataagaattaaaatgaccataagttgtaatccacgtgttcaattttataacatccatagtgaccaaaatcaatttataagaaataaatatctatataaggaatattatctccgttctcaaatagatatatcgttttcggttttctaggtgaaaatttccagttggcacacagctaaacgcatggttctttgtagcaatccaagacgaaaagtaggtgattggagctaataataatgcttaattaggggcaaactggcaatttttgctgcatctaacacaatttcattggtctgcgcaataacatctttttccgaacggaggtagcatgcatgtcatttgagcacatacccctctcgttcgcatggcatccgaataactaaatactgtacaaactatatattggcaacgtatattatgtcgtcatacatcattctataaacatgcatagctaaattagatcatatgtaaataaaaattacaaattcaattgtgccaacgttttcatgtaaaagaatattttttttgagggaaatgtaaaagaatatttatctagggaccacactattaccttttttttgaaagaaaattggaaattttaataataagttgttgttcatctccagcttcagtcacagcataatcacgttgtgtcacctcacttaaaatagttctcagaattctcatcatgtctggatttcgtgatactgatacgaaaaccgaacaggaaaaatttcccttgagctgttggtatacttggtatgcaagagtagttttaccaagtcctccaaaaccaacaaccgagacaacctttggatgttgttgctttgactcacagccatcatcatcggacaataatttgattacttcatttttcggcccttcaatacctacaagatttgaagcatgctcaaagatagagagagccctgtggtcaatgattgtattgctggtcctgcagatggtcttctctgatctataccttgcatgcctttctccgacaatgttgatttggctcttgaaatcttctattgccttggcaattcgacgtttagtcttcatatttgcgagcgatttcttacacttactgatgaacccatctggagtggcagattcatcatcaacatggaccatgaactcgtcaataatgtcctccatgtcgtaggatagctcccttacttccgtcatccaagcctggtcttgggcatcaggattctcctcctctgacatattgagaaggaacgcatggatggccatgagttcggtagagagagacttgatctccttgtgcagccccttgaagatcgtgtacttatcaccaagcagagcggctagcttcgcaaggacgggcttcaaagccccggttgctgtgctcactagagctccctccatctcttaaaactctgtctgttttgagggcaacaacaaacccgaaaattattttccattaggaacagaaacatgaatctgttgctagctgatacagaatacatgtacgaatcatatacagggacataattaagcttgcttaagccacaagcacgcaagacagagccttaagccggagggatatagtaggcatatagcacacaaacctgaaagtgatctgtataaagaggagatgacagatcagggtcagaagtcaccacagagcagaagaaaactcaacaaaagctgcagatatatcggtatatatgctgtactatgctattagccttctagagaatggtgtcgctggaaccgatcgaatttgccagggcatatatataccgctgagcagcgagacttgacgcgccttgccggtacgacacggccgggcaggaatgagtttttgctggggacagaacttgttgattcaggtgtgtcaggtttccctaagtgatcgacaaacaagctgtggaaaaacacacgcgaacacgaggaaacacgctgagttttgtggtgcgatgaagcttcaccttttcggttttttttcttctccttttattatgcaaataacagacttaggattcgatcccacgtcccggttctttcgcgtccatccccgcgatccgagagacgcgttcacgtcccgttgtccaggccagtcgcgagttaatctcgttgacagccactacgtgcacggcatccacaacccggagctcgcgcatgcaacaacagaaaaactaacatgcatgggcatccacaacccggagctcgcgcatgcaacaacagaaaaactaacatgcatgcagcaacagaaaggaacgtaaaactagctactactagatacatcgtgtaaggtttatttccaacaaatctccccctaaaccttgcacgtccctttaacttcgacgaggccaatccttgtgcacagtttattgaaccgatcacgcccaagtgacttcgtcagaatgtccgccagttgatcgtttgtactgacgaactcgatcttcaccctgtcctcctcaatgcattctctgatgtagtgatatctggtctctatatgctagctgcgatcgtggaaaacagggtttttgctgagttgaattgccgactgattgtcgacattgagtgtgacggcgtcggcttcttctcccttgagctcggcaagaagacgcgccagccacacaccctggcaagcagctgttgtcgccgcaatgtactccgcttcacaggacgataaggcaacaaccttctgcttctgagattgccaggtaatcaagttgtcaccgaggaagaagaagacaccggtggtgcttttccgcgtgtcgacgtcgccggcgagatcgctgtcactgaatccaacaagatgaacagctcctttcttcctccggtagctgcagccgcgattgatggtgccggcgacatagcgcagcacacgtttcacggctgccagatgctcggtagtgggtttctccatgaatctactcacataacccactgagaacgccaagtccggtctcgagttcaccaaatagcgcagcgacccaacaattttcctgtaatcagttgcatccacgcaaggagatgtgctcaacttactgagtttgaggcgtggctccattggagtctggctcgggttgcatccaaccatgcctgctgcctcaagtatcttctttgcgcacgcaccctggctcagggtgatgccctcgtcggtctgactcacctccaggccaagatagtaccgaagtagcccgaggtcgctcatctggaacgtctcccgcatctccttcttgaattgatcaagctcggagtggttgccgccggtgatgacaaggtcgtcgacgtacaccccgaccaccagtcgacgtgcgttagctccgcgcatgtacacagcgtgctctgaggcactgcgatggaacccaagtgacagcagcgacgcgtcgagcttggtgtaccacgcacgcggggcttgacgaagtccatacaacgccttcaccaggcgcagcaccttctgttccttgccgtcgacgacgaaaccgggcggctgcgcgacgtagacttcctccttgagctcgccgttgaggaacgctgatttcacgtccatatgatggacggcccaaccttcgctcgccgcgtacgccagcagcaaacgaaccgactcgagccgtgcaactggggcgaacacttcgtcgtagtcgattccctgccgctgcacgtatccttttgcgacgagccgcgctttgtgcttggtgatgttgccggcggcgtctttcttcgtcttgaagacccacttgagtcctatgggccgctggcgaggtgggggatcgacgagcagccaggttccgttttcttcaattgatttcatctcatccagcatagcttgacgccaacagtcttgctgttgcgcctcggcgagagacgctggctcttcagcacttgccatcatgagttcgtcatcgaactcgcgcacagccagtcccggcggggtcgccggtcctaatatctcgtcgacgcggcggaaccgaagcggagcatcatcatgatcggcgtcgaggtcgtccgcggcgatggttggtggagtcgcgaattccgccgatgtcgcagttgtgcccgccgtggcggcaggtgtgcatggacttgtcgatgtcgcgggcggagtcggtagctccggctgctccgagtcagctcgtggcacgttcgccacagctgggtggtacacagtggtgtactcgatggtgaagtccagctcactcgccgtctcgccgtcccacctccattgcgcctcttcgtcgaatgcgacgtcacgtgagatgtgcacgcgccgagaggcagggtcgtagcagcgatacgccttcgaccccggctcataacccacaaagatcatgggcttactcctgtcgtcgagcttcttgacattcggcgtggtggtcttgacgtgtgccaaacacccgaacgtccgcaggtggtggacggccggcggcgatctgttccacagctcgtatggtgtcttcccaccaatacttttggatgacgacctgttcaggagataaacagctgtggtgactgcctccccccaaaacatacctggcagccctttggctttgagcatgctccgcgccgtcccgaccaccgattggttgcgacattccatgacgccgttttgttgcggcgagtagggcgccgtcgtctcgcgtcggactcccagctcggcgcagtaatccgcgaagtggtggaccaggaactctcccccctatccgtgcgaagagcatgtagcttcttgccgctcttgcgttcagccgcggcttggatgcgcttgatggctgccgccaccccatccttggaggggagcagcgacaaccacatgaaacggctgtaatcatcgacgagaaggagaaagtaccggttgccggtcggagttggtggcgagatcgggccgcagaggtcgccgtggagtagttggagcggctccagggagcgctgttgagcctgctgtgggaacggcgtccgacggtgcttgccggcgaggcaagcctcgcaaagctggtcaacttgcgacacagccggaagaccgcgcaccagctgctctctggccattttccgcagcgcagtgaagttaatgtggccgaaccgtgcatgccacttccatgcttcgtcgccgatgcgtgccgtaaggcagaccgggcgcgcgagctcgacgtcgaggacgtagagacgtccaggattgcggtgaatacgggcaagcaggcgccgctgctcatcccatatccgcataacgccatcctcggcctccaccttgaaaccggtctcgtctagctgcccgacactaatgatgttagcagcgaggcgtggaatgaggtaggtgttggcgagggttcgatgctccccattcttacaggagaagagcacggtgcctcgcccttcgattcggacgacggagccgtctcctagtcggacgttgccggtgatgcctgtgtcaatgtcggagaaggccgtccggcagccggtcatgtggttggaggcgccggagtccacaatccagctgcccggatcacgctccgcggcgtcgtcgagcgccgcgaacagcttcttttcctccaggtagatgggatcggatgacggagttggcgcagacggcgctggtgcatgctcctgttcacgtgcatgtgtgattactcctcctgtgaggagaagcaaggtgggctcgtcgtcttgggccacgtggacctgttcatcccgcttgggcttgctcctgcaatccttggcccagtggccgtatttgccacagttgcggcatttgtcttcacgacgggccgctccggagttcgtattctccgcgccgccgactccagcgccgccgccgttgcggcctttgccgcctcgccgcttgccacggttgcttgggctgcctgagttcttctttgcctcctgctcctttttcttgtggcgctctagccattcttcctcggtgaggtagagcttgccggcgttgtctgaggacgaagatggcaatggcatggcgtcctcacctgccttgagtctgccggtcacctcctccagggacagtgtagagatatcaaggagagtttcaatggaaaggacgagttgggtgaacctgggacgggcgacgcgcaggtacttctcgacgaccttgtctgccggctcgggatcgccgagcgtcgcgagttgattgacggtggaggtcaggcgcatggcgaagtcctccacggtctcaccgtcgcgaaggacgagcgactcgtactccatgcgcaccttctgtgcgcttgctttgcgaattcggtcgtcgccgattcgcaggatcctgatgcaatcccatgcctccttggccgaggccttggtggccaaggtcgagatcatctcggggggcaccgcgctgcaaatggcgtcaagcgccatcctatcctcatgaagctcgacaccgcctggatcgatggcgccccacaggcaccgggcttgcagtttgatcttcatcagcaaagaccaatcgttgtagttggttcttgtcaacagcgggtagttcgccgcacctcctgcttccttgaccacgcggtggatcaccagcccgcggtcgctcccgccgctgcccgaggcgcggccgccggaacctgaaacatgcacggacggtgacgccgaccgccggcgcggggagtgcgtgcgtcctcgaggcatgaagacaccctcaagagcgcgatctcgcgtccacgctctgaaccgagctctgataccacttgtcaggtttccctaagtgatcgacaaacaagctgtggaaaaacacacgcgaacacgaggaaacacgctgagttttgtggtgcgatgaagcttcaccttttcggttttttttcttctccttttattatgcaaataacagacttaggattcgatcccacgtcccggttctttcgcgtccatccccgcgatccgagagacgcgttcacgtcccgttgtccaggccagtcgcgagttaatctcgttgacagccactacgtgcacggcatccacaacccggagctcgcgcatgcaacaacagaaaaactaacatgcatgcatcaacagaaaggaacgtaaaactagctactactagatacatcgtgtaaggtttatttccaacaaggtgggcaacatgcggggagcagtgggatgatgacgaaagctgatcaatgagcttaattgtgggacaagggatagaatgcatcttcgacctctcagatatatatactccctccttactcataaaggaagtcgttttgcacagcgacacggtctccaaaacacaactttgacttcttgtttctataataatatttattgaaaagtgatatatgtatatttttatgaaagtatttttcaaggcaaatctattcatataattttaaattttcaaactcaacaacttaagagttattcatgatttaatgttctcaaggtttgacttaaatattgtcctaaacggcttactttacgagtacggagggagtatatatctaggatggctctgtacatccattttagatgtaaaggcctgggttttaatttattatctaaaaactataatagacgtagaacgacagctacaggttgcatccaacaaaccctagcgtccaccgccgaacacctccctttagggtcagaagtgatgtgtctaggaaaagcttaactttaatcctaacgcaatacttcaggcactggcaacccgttgttctcagatttcgctctactacgtacccggacagggaggacttaagtgctcttgagggctgtcaccacctctagacccacctcaaacgtactgtgggatatgcatcaaccactggagattaattacccaggcaccgcatctacgcaattaataactactttagtgccgatcaaacactaaagcaatcactataaataaatggactatagtgaacaatgatcccgtatgctaattaggaactaaccaagaagtaattctcactaagtaaatcttaattactcagaatgatatttctattaaatcagagtaataaataaagtacaagagataagagaggattaccgacaactccagaattctttatatagctaccccactgacttttttatataagtcaaggcactgtgtgggtttttaaagcaattgattggatacaatatcgttgctttttgccacgtaagtgaacatttttattggtttaggctgattatatattgtggtcatttttctaggtggttggtaaatcctttatgagtttatttactcggattttataccacatatgccatatatttccaagtgtggtgaaatcatgtgtcttttagggacttaagcacatctgttaaagcagtgtgcgcatggtgtatgcccaatactttagaaatttctttattcacaatatacaagcttctttatagctgttttgctatgtaaattttcaatgatgtagtcaactttagattgcacgcatcatattttacaaagcagtcggtatatcactcggatcatgttattcgggaattcacaccgcatatgctatatattaatatcaagtcacttgattgactacagttatcaaaaccactcggttggttggattatttactccttgactatatgtttagcttgttcaactaatcacatagtcgggggctacacctattaggtgaatctaattgatgcacctaagtttacattcagttatttttcagctctccacagtctttagatttggtaaaagtactcgggaaaccatggcgaagatgagaagatgattgaagcactcggctttggagtaatctagttcgaaagaagattatcttttcgactgtgaaggtctcaggggctactgtgaagattatgggtaccccatacccacacggcatagttatccgactagttataggggataacttatatctatgaaatatgtaacggatcatgacttgggtattacgtttccttatatattatggaatggcctaaagtcctgatttgataatattgtaaagtacatataggaaaccgatatcgtatcggttaagatttctatcttgtaatcctgcccctcatcctatataaggtgggcaggaggccctctagggggcatgatacacaactagatcgtcagatctataatacacacggcgaattcaaatccctaaacaggagtaaggtattacctctcatcgagaggtcctgacctgtctaaatctttgtctccgcatccatccacttttaggtctcatgcgctaccccctttatattgctgaattattgtttcgacaaaagctggttttgaaaatcctgtttcacctgtgataacatatttggttgctaagtttaataaggatgtgatgttttagcatcgtagacttggacatgttggttttgatcatctcacgaggttaagtggtttggatcttgttcatggtttgcctaaacttaagaaagatcttgatttggtttgtacacagtttcgtcatgctaagatggttacttcttcacatgctcctattatttttgtgatgacggatgcaccgggacaactattacacatggatactgttggtccagctagagtgcaatctgttggaggacagtggtatgtgttggttatggttgatgattttttcttaaaattcttgggtttttttcaaggccaataaagaataaggcttttcacccctttgggggttggtttcttcgatgggatct

SEQ ID NO: 69192 - DNA, 1308 bp, Oryza sativa
ctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaacccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacaccctgacatctctggaatcttgagaattattctcagtgaagttagcgccgaaccttatggcaacactgaatcaggggacatacaacaactcattagaaaaatcactacttcccttaagaacaaaaggtatgcaaaattctaaccttcaatcatatattcttatctccaaaatatatggtgtgtgtattataaggccagaccttcaagattttaagcctttagttcattctttgccggtccaacttgctaagtagtccgtgttttcttttacttgcattcagctctcttatgtgcat

SEQ ID NO: 69193 - DNA, 2864 bp, Oryza sativa
  unsure (1)..(2864): unsure at all n locations
cgtttcaaccacaatcacaatataattctcatgatttaatttttacacaatgaaaatttgatttgcgaattaacttcagcaaagaactgcaaaaatactcannnccaaaacggaatcgtcatggcggatataatagatttccgtgaaaatactcgagttggtttatttattcgttggagttttttttattcacaggtcagagaacacgtgcactatagagcattgaaaggctttgacagcaattcttgccagggtttaaatacaatacataaatcataaataaagcaccgactatttacgtccattgtgtttgtgtgcaccctgaatttcttataataacccaaaaagaaaaggtcaaattggctgcttttaaagctccagggtggagatccatttgctgcaattctgttgcttggctcaacaggcgccattgaattctgtactgccttcttagggaaagctgtaaaaagtacagatgataaaaacatattagtgtagttttaaacacactgtgcataccaacactttccagatcaccaaacttcccattgttttatcagaggcaagaaaccaaaagatagtcttgactaattattatccgaaatttttcagaaatatccaccaaaagtgcttcagcaaacacaatcagggtgaataaacaaagaaagattgaccagtccaatgataaaaacaatgaaattgcaggagccagttccctgcttaaattcatgcacaaaaagaggaggaaaaaacatcaagagagatgatgtgagtgaatgcaagagggaactatcaggtcaacactgcttttgcaacaatcttaacggaaataaaactgcttctgcaacttcactttgctagctccaaggtctcgtttgccccatcgctctcgtaatagcgttgttcataatcttgcccagctaggtgtgagttgggacccaggtcactctttgggtagaccccctcacagattttgtaaatgttttggtgattcgtgatctcactgaatctacccagtaataagaatgtgtggttgaagctaaaaaaaaactgatttgtttgagaataagaattggtcctgaagcttgcttggatgatgcatatgggcacatgggatacctccagagccctcttataactttgttgatcatcgtcataacctcctcctgaacaaagttctctacaccaataaatcagatactaatcctccagaccctataccatgtgagtgaacctaaagagagcatctccaagggccgcgacaagcctcgtgaacctttggtaagaaagagtactagaacatctgtaaacaagggaattacctatgcaaatgataatattttattggactattgagccatccaaatcaggaaaagagcttctagctagcaaccatttggtcagcaagaactagaaaacatctataaacaggggaagttgcctacgtcaatggtaatcttttattggacttttgtgcaacccagattaggataagagtttcccagtgatcgacttcaaatatgtggctcgagaccacgacttgcaaacaaatgctgggcttccttacacagcaatgcataatagaccacaaatggagccaatttgtatacttgtataataactgtgacaaaatagcaatccttttctataagaacagcattattacaataaagcctaactgaccaacataaattagaacattctgtacctgtttaaaacatgcatgattgagccttctgttgagcttctgcatcgaattccaaatatgttactgacagtattgactattgaaggtagaaaaattagaaaaaatgtaaagggaccgccatagaaaaagaagggcagtgaaacaaataatgtattgcctcatccatattgcaaaaaatcacattacctaccaactttccattttgctgtaacatgattatccttagcaagagctacgcctttgaactgatccacattaaaaattttgccttcaacaggactcatctacaaaatcaccatattcctcctttgtaaatgtgggttggttgggatggctgatgattgatctctccaatgcagccagcatagccaccttggccagtctggtttcatacttgtaatgaatacagcaatatatggttgtgaggcgggacagatgctctatgccaaacacaacattactgctgctggtgtggttttcttctgctaccatgcattcgaggttcagttgttgtagcttcggcaagcacccaatttcaaaagtcaactcaagcctgcaactttccccaccgattcggatacgttccaaggatgggaatccataactgctgctgatcctaagccttcctccctcctctgtaattacttcttccacatagagaatgagagagagcagggctggcagtcctcccagtgtactgacatcttcttgcgagagttccttcagatataaacctaatcgttggaggttgacaagtgagccaatccatcttggaaccctagacattggcgcctgattgatgacaagttcttgaagactcaatggaggagggcaccatggttcctggatgaagtcatctgctgatacggatgaaatatgaattgttagacaatgaaggttgtctctgcctagcttacatatggaagagatcattgctttcatatgacccttgtatctttctgccgcatcagcgtgatggccaggcataaatatactaagcttcctcaggtttgttaatttaccaagtccttgcagcgtgttcagtgactgcgcaagcacattcacaactttgagctcttgcaatgcttgcatgttcccaattttatccggcagttgacatctcatatcaacaagtagataagtcagttgtcgaagt

SEQ ID NO: 69194 - DNA, 1718 bp, Oryza sativa
aatatttgaaatcaaagtcaaatttgaatcgggtatgtaaacttttaacttataaactttgggtctacaaactttaggtgtataaactttatatgtatagaaatactatatataaaaaatatttgaattcaaattcaaatttgaatcggatataattcaaattcaaatttgaatcgggtataaaaacttttgacttattgtcagggttatggataccacatacctaatagtagtcgactacatctcggcaggacccaccacataccatgtcctacacggaaaccgacttcagatatggagggagttccggataaggaaagacaaccagagttctacatggaaacgacaaggactattcggactgtattcatattggtttccctagttctacttggataaggggacacatatgggtataaatacaagaccccctaggaggagtggggacacaagacaatcgacagacgatcgacacgatcaacatgatcgacacgatcaacacgatcaccacgatcgagacccacctcaatcaacaaccaccacaatatacggaacaacagaagccaatacaagccaacatacgccaagacacgccgccggatatcgacttcagggataggcatggctattcccctacggtgtctccggataccgtcaggagagacgaaagcgctatctctgatctcaccggacacggattcgaggagcaagactaccttgttgtcgactacgagtcagaccttcagaccgacatgtcgacaacagttagataggttacccacatattgtactggtgttattatggtgaataaaagcaactccggctccggccaacaggatgtagggttattacctgacaactcagggtcccgaacctgtataaaaatccttgtctccatctcttttacctcagtctcgcatatatcctagtaccgacgatccccatactatgcaaataccataattgcgacatcaaacgtcgacagtggcgcgccaggtaggggtattttggtgctctaggaattcgacgagatgggttcaaaagatggattcttcgacaacaagctactcgacgacttcggctgtggagatctaacccgatcggagcatgccttccgacgagatcggaaccatcatcgtcattgacaacttggtctatcgagatcacccaagcctcaagatacgtggcataccaaaagatgtcagatcatatgatgtcgaacgagtatgcaataaggtaattggtagattggtttttcaaattgatctactaatttcgtagatacatccggcatatatctacacaggtacgcaatatttgatatgcaatttatcatacctattcagatcatacagcattgtcagatctacaatttattatgtttacctagagcatgtcttttatacaatatccgttgtgcgagtactttcgacgataggccaactacggtataacgctggggctcactctgttttcttctatataaatcatgcttgtttacggtttacataatgcctgataattacatctgctcgttatatcctgataatgctagaagatccatgcagttttttgagtacatactcgatattctctgctatatattttgccttctagaaaatatttttcaggaacaattgagcactcgattaggttatggtcgagtacactccattatcgagaacattctcgacaaatgcggagttatcgcacccaa

SEQ ID NO: 69195 - DNA, 510 bp, Oryza sativa
cgtccccgcccgcggcgacgagggctacctcgagaggcgccgggaactcctcggacgttaccgcctcacgtaggccgccggcgcgctgagaaggcggcgcggcggacagtcgccgatgagatcatgagatcggccgccggcaagacagcaagatgcatgtgcgcggagcggcggaggacgatggaggcctcggcgtcagatcaaccatggcgcggcgcggcagactgagaaggcggagacgacgatgctggtttatcatagaataagatcaaaatcctctcttcatatttattacctgcaaagcacctctttgaaatgtttatcatagaataagatcaatattgtcactacttgccctgagaaaaaagattaattaatactgtcatatttaaaatagatacatccatcttgtgaaaatcaaatatttttcttttacaaaatccacgtaattctaggtacattgaattaaccatcagttttacagggtaccgagctcgaattcgccctata

SEQ ID NO: 69196 - DNA, 4526 bp, Oryza sativa
aaaaaataaaataaaatccaaaattagacaaattaaaaagagagttcaagtaggaatacaattttgaaacaactgacattgaaaataaaaaataacacaatgcaatattagttaaaattcaaaacaaaaaatataataaattctgaaattagaaaaagaaaaataagatttcaagtaggaacacaatttataaataactaaatttggtaataaaaaaataaatactactgaaagaaaaggccatttaaaacacatgacgaaattaattaagtaacagggctataatggagtagaatggtggtggttgatgggacatctaaatactattaataaaacacaaaatagaataataatgacaattaaaaggaatgacgacgggcagatagtcaagcaatcggttatggcggtcggcgggacttctagaaagcaaaaaaaaaaatccaatgataatcatatttgatttttaaaatctcaatgacaataaaaatgagaggcaatgggcgagtcatacatgagtacaatggcagagccgccgatggttggtgggacttttagaaagtaaaaaaataaattcaaacaatagttatattcgatttttacaatcttaatggcaataaagagtaagcggcggacgggtcgtagaggagtatagtgcagcgtttgacaggatttgtaaaagttataaaaaatgaaatccaacgagacaataaactctaaaaactataggtccaatttttagaggtaaaagtaaaaaaaaccaataatactcatgtttgattttaaaatctcaatgataataaagaagggaggcatcaagcgagtcgtagagaagtacagtgacaaagtcgctgacgttttgacggaacttctagaaagttaaaaaatgaacctaaatgataattatattcaatttttataatgccaatgacaatcaataggagaggcagtggacggccgtaaaggaatataatggcaacgtttgacagaacttctagaaattataaaaacgaaacccaatgggacattaaactataaaatctataagatccaatttttaaaagtcccaagaagaatgaatagaaatagtgctaggtcgaacaagcaaataaagaaagatatgacagaagtaaggggtacggtgtgacttttaaaaactataaaattagaaacacaaggattataaggtttggtatttcaaagtcttaaaacaacgagataactatttaataaactttaagtaaaatcatattaaaatatatataactttctatgggtgctagccgcgcaattgcgcgggtcacccagctagtttagtgaacacaagaacaaattctgacattcattgctttaattttttttatacaattacaaagctacaaactgttccactcacttccacagagtaggcatttagctcagcgacattggagatatacaactttgataaatatcatctagctatgtgaaactagaaactcctcagtggaaaaggacataacttaaaacttcacaataacatcaaagccgagtttttcatgtgagcttttctatttccaaggtttcagatctgctacaggccccgcagtccagttgagatgcttctcgcctggctttaatatacactgtctgggtgtgggagcttccgagcaaggccgttgaggatctgatggaatgcatctctaggttgtgctggctgcggaaacaacatggcctgtttcattgatggattggcgagtaatctttgcttccttaggatatcatcaattgggatggatgtgaggattgagtctagccttggaacatcctcctcgtcaacaaaaacaccgatttcgtcccatgggattgcgtcagcaaacggaagcacaatatcatcagctatgatgactggaatgcaaccgaaaactacagcctccaccaatctagggctccatggtgcccatcccaaggggcacaagcagaagactgagcgctgcatatcttcatagtaagtagctgggtgttccgtagaaatgtcgaagaggggattgttcttgaaattctcccacagtgaagctcgggcacctctgtataacaagttcaacagagtcaataaagcaggaccaagtaccacaggagatgtatctttcaaggttctgcaaacattcttaccttgcataatacccaccctcagggtcattcccattgtcatagaacaggcctctgaagtaaacaaagattgaacggggagtatcaggaggaatcaagtgagcttgcattttctgaggaggcgcatatggtggtatagtgatagaaccctccttaagcacacatggttcttctgtccaaaagtttgaaccaatgtggcacggcggagcaatggaagtatcccacgctcaatagctttctcttcctgtaaagacatataaccattgcatatgcagtttcagaatagatagggactaaaggtaggatctatcctgagctacctatttcttaaaactattgtggaactaaaatcatgactagctacaacagtgacaaggacttggcaggtaagaagacaaataaaccaatatatcattacctgatagtgaaagcatgccccaaaatcatgtggaacaacaaagaaatgatctgctccatcagttctattccagaatggccattttcttgaaagaaactggattgcgctccgcatcatcctaggagacttgaatggcaatggaagtccagcatgagtcaaatcacaagtagtgtaaacaggggcatagaaccaatcagcctgttcagggttgagcgttcgaacagcactagagagcaagaaacgatgcataaatatctcagcagcaaacatgtggttgaggcatcggggatccttggcgactatcctcttgttatacttgcttggcaagtcataaacaaaaaccttcaaccgcccaactggattgtcttctagcacatcaccagcacttcctgcaggtcaatgatcttggttgagtagaagcacatagtactatcttcataaaactgataagcagattccaagaaaaccagtcatgaagttataatataataaggggacatatccagcgaaaaccatcaaataagtgaaaacccatgaaacctaacctaaaagtttcataaattcatgaaaaaaaatacttgagatggatgtaggcatgaaatacattcccaccaaatatcaagttcaaactcaactttatttaggagtaacagaaaagacattttgggtgaatggtaacatgacactattcacctagaatttctcttttttgtttctctcaaatgaagctaagtttggacttgagatttggtatgaatgtatttcatgtctatagctatatctagtatttttttcatgaatttagaaaagttttaggtatggttttcacgggtttccgcttatttgatggttttcattggatattccccatataattaataagtaatatttaaggtggaaataaatgttaacaagaagaaagaatgtaaaactcaatacaagcttaggggaattcattttcaataaatcatgaataattgaacgaaaattctgttgttctctgaaacataaactcagaatgcaccactctcctaaaaaactcaggtagattctcctctcttttatttggcacaattgcatttatggggtaactgtttatcctggaattattgtattaaatagaaacaataattggatccaattccattatcggaaaagttatatgcacaattggattggctccaagcagatcacagtatcttgacaataactaacgttagttggataggactttgtcaatgagacaatgacataacaagtgtaggtctgcaggtagcacaagcatatatgattgtcttaaaactatcaaatgttaactatgtaacaagtaaaagaaacggaagaggaggagaaataggtgctaaatggtaattcaacatttctatatgttcacacaaccctttgctggcgcggagagattacattccttcgataagcacgagaatcagcgatccattgcagtcagtactgaatttacatcaaactagtattggacatccggatttccttttttatagggggaaaaaagcatatcagtgcgaatgtgcgattctaagagcacgggtgttgttgtacaatgcacattatcaggtcgaacttgcaattgcatatgaatatccatggttgaagtactactactagattagaggagaatttcggcctaagaactgagtggtgttaggctgacacgtcctcgcctagcaacagcatcccaactttgaatcaggtaaagggaaaaatatttacaaacaagctgagccagttgagcgattcccctagccaagttcgtgaacaaatccaacacaagaggctacaactgaatcactcgcatcacaaattcacaatccacaagctaacattctaacaacccagcaagtcgaacgaatcgggtgcagaagtacagctcgctcacctgagatgcgctcggtgttcccctgagccgctcccccgaccacctcggcgg

SEQ ID NO: 69197 - DNA, 3003 bp, Oryza sativa
tgctggtgggtttcatgctagctaattggtgtctctcacgatcctttgggtgagcaacccatggtgacatacaagcggctaaaagagcgctaggtaagaaaccctctctataaaactgggaagcgcacaagttacgatggtgaattgaaaagagagagaataagagctactccatatgtgcagatgggccatgcggcaccataatccaacaatgcgtgatcaaaccagtgcaaacacctaaaagaagagggaagaaaatttaaaaaaagggaaaaaatactttttctaaaattatttgcaaattattcggggcaagcatcatgaccacatatcttatatttcaataaactaaaaatggtaaatagaaaaataaatgataggaacaatttgctcttttttaagattgaatcgatctctataaccctgataacaattttctaaatatatgtattttttttataatataaaataaataatatgtagattctaaatatatgtatttttatttgtactataaaataaataatatttagatatttcaacttttgaaaaacattacaattctgataaaatcaataaacaatactggtgttggatccatacatagagtcttatctaagcactctgatgctaaaaatcacaaaaaaaactaaaatattagtatattaacaatatatggtttttaaaggttatacacatagattaatcagtggaagcgccaaccggcatgttgattttctaatgaaattctattgctggatgttggatcggcatcccggtccacgtgagccatacacttactgaacatgtgcacacggttatgaggagtaggcgtgccgtgcgagtagtgaccttggcttgggcatttgttcatttattattttttattaaaattaaaacaaatgcaaatactgatgaaaaatggctggagaaattattggtgaaaagttggaagaaaaagagagaagagaacagagaaaatgagaataatattaagattatggccttatcgtaatataatatagtttgctactatgcttgaaaatattcaaatagatatgagctgtaataggttacatctgaataaggaataaccttttttaattaaaaaaaatgagttaataagccctcgaccttttatcttatcccctctctacacattcctttagtttacaatgttttaaccattatttttttcttttcaatataactatattgaactactctcgtacttaacttatgtgctattttactgataaaaaatatattttctcattgtgaaaaaaatagaatcagatgtaaaataaggagatataattatttgaccaaattttgtaaaatcaaaattttaattttttagataaaatttcaagtcaaatatgtgaaacccgtattatattttctccaaatttcaaacctaaacagacaatcattttggtgttcaacatcttgatggaactcttgtttggagtcaataaatttatttataaactttttaaaataattatttttattttttcagtttttgatggaaaataattttgtccatttagttttattttaaagtactttatttatattgagatttatgtttttgatgtaagtagcgcataatgaagtaatttttttttaaaaaatccaacggtcaactcacaactgttacccccatcccaaatttgtggtcgttttgactttttttgcttgcaacttttgaccattcgtctatttaaaaaattattgtaattataaaatagggcaagtcatacttaaagtacttttggtaataaagcaagtcacaaacaaaataaataataatttcataatttttaataagacgaataattaaaatttacaaacaaaaactcaatgtgacaagtactttgggacggaggaagtacatatatacatataggagatcaaaatgataacccaagggtttggaattttctcataagatgagataatcaggggtaaaaaactcatagggtaaatatggagttttcttctagtttataaattattgatcgtttggtatatgcatgcatatgaatatctatctaacaaaaaggtgtgtgcaggagggtcttctcgtggtattacgttgtatcatcatatactgcctatgcatgtattaatttatggaccgaaatcaatattattatatgaaaaattttagtagtattatattatcaagtataaattaattcaattaatggatcaacacatgaattgatttaaatggtttaattaattcctcccatgatcttttttgagttctttttggtacatatatgtgctaaccaaatgtgaaagcatatagtaccggttagtcacttggtctacacaccacatggctcggtggctgggtttgttttttgaacgttggtgtgtacgattaaagtgaatgcgcacgcaccagtgcaccatggcaccagcaccagcagcagcgagctagctaggttttccaagatgatcgctccgtgggaaaagcagggagtacgaatgccatgctaatttaatgcaagttttgctcacctcaggtgtcacatgctatgatgctaatgcatggaggaagataagcaaactgtactatctagcacatccagagatgaatgtagtatacaagtagtataatataatacacacccacagttccacaccagcttcttaattattgcaatttccaactaattaattagggcacacaagaaatatatatataattgagaaaattatatatatatatatatatatatatatatatatatatatatatatatatatatatatatatatatatatatatagggagagagagaccgtatatgactccagttaatttacgtgatatcgcttggatggtaattgcaggttagatgggaaagcattggctgttacgtcttagagaaattcccaccttgtaccgtaattgattctaattaattgatttaggtgacatgattagaaggtaaattaatatgttttgtttaacatgtcattata

SEQ ID NO: 69198 - DNA, 16128 bp, Oryza sativa
cgtggaagcttctagaagtcgcgagagcttgatcgctggaggaggaagcaaagggaggcagcaaaaaaagggggaagagagaagggaaaatgcaaagtggtgggggggattttgttgcttgtgaatgcaacaaaaaagagagagagagagagggggaaaagaaattgtcaagtcaaggtggcaagcgtaggtgagagcagcgcctccattgaccaaatgaccagctgcatcaggacatcaggaggcactaatcaagatttatgatgttgctaattcgtcattagcatttacttaattactacattattaggaatttagggttagaagatactactcctatttaagaagcctcaaaactaggtgggagcaaccactaactgcttgttgagttggaaggggattactagattagatctgaccacttcagtctgttaggtaccttaggtaggtagaactgaaatctctgctagtacgacggcattaggatctagcaaatcagatccatttacggtgttactgttgcgttttttcatattagccgggaagtaaggttttgcttgtactatccgagtacaaaattcagggatgaacatgtatgtactcgtgtagaggacaatttcgtcttaattaaactgatttattgcatgtttgggcattaattaccatacccaaaaacagatcgttgttccggcacaagggaatattattatgttttccgtcatttcaggttcttgtttaagtacagctactacagtttctccgacggcgagggttcagaaactaatactctcccgtctaaatataaattattttggagggatatgatacgtaggtggtgtttgaatcttctaaagataaagataaaaattaaatgtttcacgtaaaacgaggtaataacatgtgactaattggattttaattactacaaacttaaaaaaatggattaatatgatattttagaataacctttatataaaaagttttcgcacgaaacacatagtttagcagtttaaaaagcgtgccacgagtatttaaattttcatccacctgttacagaggaaacgaacgagaccatactattcactccttcccaaattgatcatcgtataatagaatttaaaatttctcaaattagtcatcatataaccgcatggacacgaatttcatcataatacaattaatacagcatgagagaatgtgtgcatgctaagatataattggcacggtgttttaatcgatgcatgtattatgggagaatgtgtgcatggtgtcttgattaatatgatttaaattattcttagtcttggtgcataaatttatatgatgatcaatttaaaaagtagtgagtataaatctggacagagaacatatcccttcaaaattgcttatagtttgtgatggaaggaatactactaccttgtacactgttgtgccagaaagctatagatcgccaaagtgcaatgaccaaactgccatcggatgcaagtgtggttgagggtccttgtcggcgtggatcgcacgacactacgacagggccatctgattccaacgtgtgtccgctttcaagtatactccacgttgacaccgacggaaacggaagagaggtctcataataagtttaatttttcatctcttttaatttgtctcgaaataagttaatttttgaagtaattactataacgaaattataaaaataagatataattatattgggaatagagaaaatttttgaagtaattactataacgaaattataaaaataagatataattatattgggaatagagaaagtaaaaaataattgtattgggatttaataacgtaagggttattgtagtttttttttgtttatattaatatgtgtgagatggataaacaaatttagagtgaactgcaacggcggttctcaaacttgccgcggtgtgtcatctagatccatgtactctcaaattacactttaacctctctaaacttgattatgcgtccattagtggtctaaaccagcctcgggatgactttttagccgacgtgccatcgtgatgtgaagggtgctagacaactatggggtaatgttgcaaaggggcccttcatttaatccaatcgtcacacacatctccctagagtcccctcgagttcttcgcgtcagagaggaggggcggcgaggcaggctacacaagacggtgatcgccggactagattgttcataatatcatcccagttaatacctccaacttttccctcatgattgaaatagacaaccaaattcatgcacttttcaaccactgaggccatcacatttgtatcagtgttacatgtaatcactctgagaccatcagaaatacccttgcttgataataaccagtaatacttcaagctgggagtccttaggtaccctaaatcctcaactaattgatccaaccacagtggagaccaagtgtctatcttaatatgatcaaaccaactgactttgccatccacgtaagaccgcaaattaccatgaccaacgaaaaaaccccatggtgaaccttgactgaaaactcatccgaatccatacgtacagtccaacaatgcaccaccccatcaattatctaccatctacaaacaggattacccgtgcaagaaaaaaacctaactttacacagaaatagacaaatgcatctacctagcagccaaatcctggaatttctaccagaacacacgtacgtgactgtataccgttgctctaaaggtataaacaaacacagattgctctaaaggtacaaacaaacacagattgaggatcgatggactcaccataaacaggcgcagcttcatcttgccaccatcgtcactccacagtgtcgtcgtctggtccaaattgagaacctcccccaccctctctacccttcatctgaatgaatcgccaccaatcgccggcgatcaccgccttgcgtcacctaccttgccgcacttcatctctgacgtgaagaactcaaggggactctggggagatgagtgtgacgattggacaaaataaagggcccatttgcaatattaccctcgcagttgtctagcaccctccacgtcacgatgccacgtcggctaaaatatcatcccaaggctggtttggaccactaatgggtgcataatcgagtttagggaggttaaagtgtaatttgagagtacagagacctagatgacacacctcgataaatttgaggaccgccggtgcacttcactcaaaaatttattttacgatataggtagttgtagaactggacggattgatccaaggtatgtgctatactgccacatatgctagggtaacacgtgtaagtggaagcaagtatttattccgtttctaaatattttttaaaaatatattataaatgcagacgcttacaatacacacaaattcatccttatgagattgacaaagccaccataagcgtctctctgtcgacggtacgtcgcccaccactgaagaataaatagccgtaaacgcaagaaactgtatcaactctaatatttgaacacgggtagattggttccaccataaaaatacctaaccagttaagttagactcacttcatcgtttctaaaatctaaataattaatacaattgaccattagtcttttttcttgaaaagcctacatggatactaagaaaaaaacaccatattatcgaagtgtgcgaagtaacaaagatcttattttctctatcatattatggaagtgcgttacgtcaaaaaaaaaagattcaccgtagtctcatttgagaggttttagtgatcaaagcttaaacaactaaagtctaacataaatacattacgtaataccatttttacacgatcagttacgtagttttctttcttttctattctttatttcgatagcgagagaatatctagagtcaccttgtttccttggcagagaaactgccagtattatatgggggagtcgtgtgcgactacgggcaccacgctgtccttgtgctgtgcacgtccaaagaaccattttcctaaacataatgaaggaccagggccattcgattggcatacatgaattcgactcgaattttgtacagcatcttaaatatttagaagatccattgactaagcctggcagtagtaggtgagattgtaaagagtatccatggaacattggtacgcattcatcgcctgcgtgctcacaatcagatgccacacttgcttggaacatacccctccgtaccaaaaaaaaaaaaaaatccattcctagccatgaatctgaacacatgtatgtccagatttgtagctacaatttgatttttttgggacagagtatgtccagatttgtagctagagtttgatttttttaggacagagtagtacctcaccagaagtcttcagttcaaaaactgtcccagatgtcttcagaattccataaaatgagtcttcacaccagaacgctaaattggaactcattctacagccattgcatgcaaatgaagcgttcatgaagagccactttacggcttcacatcgatacgtgtcatcacaacatatataaggacacagataaaattaaaatagtgccaagcctacaacagcctatgaagaattgaacagctgagggcaattctatcatcatgatgtcacaaatagtattggcaaaaagtttctcataacaaacaaatcaactacattcaatcacatacacgaagattgaagagaagggatgtcagttgacaacatataagcttcactgtgccagcttgtaagacaattacaagataactcctattgatttcaggtaacagaaccaaacttggaaattaattaacagtagccaagtagcagctcattattctttactagaaggtgtccaacaaagtagagcaacaaaaaggtgaaacgtcaaaccaacagagaatagaagtgccataagattttaaaccctgtggtcaatgtaatctcagccgatgagcaatttgttctcttccagaaatgagtaggtcgggacttcgaggttgtatggtgcagggcccttacggattctacctgatatatcataatgtgatccatggcatggacagaaccagccaccaaagtcaccagcgttgggaagtggaatgcagcccagatgagtacacaccccaatcacaaccagccactcagggttcttgactcgttccgcatcctgctgtgggtcacgaagagatccaatgtcaacgctgttcgccaagttgatgtcttcctctgtcctgcgcctgataaaaactggcttgccccgccacttcacggtcacagtggtgccaggctcaatactagagagatccacctcaagggaagcaagagcaagaacatccttgctagcagacatgcttagaacaaacttcaaaacgagcaagcgcagaagcgaagcataaataaaccttccaccactcaacacaaagtatgcaaacgctcttttacttgggtcacctggctggtatctttcatggttatattcatcatatacaatctttgcactgggattcttcacagctgacactgttgctggaagctcagtcaagcttacatcctggttccttggaacaagagtttctgaggaaaagcctgcaaaagggaactactgttacatgacatcatcaaatatcaacgtaacacaaaaggtgatatgaagataacagagcattattttatcttaacacggtatcaccaataaatttcacacttgaaaatcatctctatatattactatgcatagagactgccattgtgataaaaaatcaaatttattttagtggtaagtgttcaaactccctgatctcagaattgcatgcttgattaatgtatggttacgaactcatgatagcttatgttctgatcaatctgagttgttccaaacaaggaagaacattcaatgttttctacccaggtttctattatcaaatgttagtacatccaaccagaagtcagacttcaacagtaacataagacggtgcacattgtgatctgtaaaacatctaattgcaaaatgtttgatgagcgcacaagcaaaaggtaaaaatggaagtgctgactgctgaacaaccaaactacaatactggatatttgtaaagcattctagaaatggtcacatctaaatatataatgcagcatactaatgcgataagaattatgaggttcctttcaaagtaagtaaaaaactaaagcatgcgtaatctttaccagtcaaaactaataaagaaagcagatcaaaggatataaaatccaaacaaaataaattcatgggggaaatataagttccactgcgtaaaacaaggtatctgaagacaggattcatatttttaacagattctaagcaaacatgtttgcgatagttagaaatgcatactaaccatataggaaaatagcatcaacatctaaacaatcaagagcgctgatcttcataggttgtacggaattggaaatggaagcataacaaacttatagttcacataatgttggccaaggaaaatgccagaacaatgtgagacaagatttatgcgcattttagggtaacagcaaatccatgctgacagcattaggaacatagattatcaatgagcaaagaggagtgatcaaaagtggtttgcataaactaaatgaaccatgtggaatgtgctttcttgggactgtgttaatgaaaataaaacagactggacagcacaaaccaaaatgatattagcattaatcatgttaaatgaagaaactcaattctggcacatctttcccaaagcacaaaagaacaggagcattagcagtccgcaactccacaaatgtggtaattaaaccagaaagaaattttactgaagtatcaaaaagaggcacaaatctaactatggatttcaacaactacctaatgcctggctagattaattactaataaaaaccataatactgaacactatagcaagctttcaaacttgcattttcaatattatcataccaagcttatctttgctcagaacagtgatcatgtagagaatcatctaatatttctgtgctgtggtatgaacaaggagatctcacacatgagtatacataacaattctaagatagcattcacaaggacttacctaaaagttgctctatctgagtgtgggtcatcaggaaagtttgcgcgtgaagaaaaattgcacataattatatgatccagctatccactaaccaagcccacacgtgttcagatgaagcatctcatatgccacatagacattacgcatgactatttacgtatctggagtgagcacaaatcaatcaaaagagcgttcacaacgaattcgactcagttgaataaacggaaacacaccaaagcataagcataacatcaatcgtggaaaacttctaatatccaatcatccctctagccgctaaactaaaatacaaatccaatcatgcgctcgcaggctaggaacaaacaaggtatgaacagagaacgcatcaagcatgcatggattacatagagatcaacgagctccggaagcaggaaagcatccaaaaaaaactaatatcaaatcaccgatcaggaaccaaacaaccgcgactaccgggatccccctccgaaaccctgggagagcaggaagaaaagctggatcccccccccccaccccgaacccacgcagatcagagggcgggaggcatgcgggccgcgtacatacccctcgaagcggcgaagaacggggaatccacggcgaagcgcggcctctggggctcacgcgagaattcgtcgtcgccggggagggagcccccggcgagcgggcccctggcgccggccgccgcggcggggcgccaggcgagggcggtggtgaggcgcctcccggcgaccctgagcatggcggcggcggcggccttcctctccggcgggtggatcgggtgggtggagaggagatcgggtcgaggcgaggcggcgtggtggcgtcacggagtggacgagaattgcaggaggagagagagaaaaaaaaaacaagaagggaaggggagcacggaaggatgctggcccaggcccagtactcgctgggccttgggctacttgcttacgtcggcctgattaaccctcgtgatttttcttttttttttctttttttactggttctatctaactagttgttgacttgtttccttggaatttaatgggttcagatcggaatggctcaagtgatcggtttgcgttggcgtggtaaggaacgtgccacgtgtgtctgttgcagcacacgacttggccacgtgcatacggtgctgtttttctgtcaaacgaagcatctttttcttatggttgaaaaatgggcatatataacgtgcaaaagtaaagttgactgagcacaatctacatgaaaagtctgtaggtgatcacacaatattatttttataatggatcttttcttccattaaatacatgcattcattatcactactacataaaagagattggtaccgattaaaaattgatcacaggtaccgggtttccaaaccaacacccaacaagtgacacctttaaggaccaaaggtgctagtttaggaaccaatacttttaaggttctagtaatggaaaaaagaaaaaaaaaagctaactcaatgcatcggctcgattcgagaaactctccatcatcactgagatcaatatcatccccatctaccaaacacaatcaaaatcatcattgagatcattatcatcccataaccaaacacaatcacaaaatcaacaaaatcgcaaacacaacacatggagaacgccaccgtcacggcagcggatctggccccgtggtcgcagcaatgtcggccggttggagaagaggaggaaggaggggtagcggcggcggctaagaaggaggaggggcggcagatccagaaagaggagaagggaggaagaaggaggggcagtggcgggtgcttaggaggaggaagtaggagtggcagcaatggataagaaggagcaagaaagggcggatacggttccgatggggtttcacgagtagataacataagccggctcaatgggcagatttttttaaaaaaattaattataggtgtcggttttttaaagaatcgatacatataaaattagtataggtgtcagttttgttttttgaaaacacaagtacttataggtaccgagttttatttagagtcgacacctataagtttttggaggtgtcggtattttttatctcgtgaaggtgggaaacggttaataggtgtcagttttaaatgaaccgacacatatgagccatcacctattaaggtttttaagtagtgtataaggttttggctcaatagaaccactatataaccaacctgacaataagtttggactcatatgcgctcacacatatataacacgcgataaccctacatgtttgataggcatttttcatccaaacaacaatgggttgtgtgctctcgacgggatgaggcttccatgactttatgcagtttgtagatgtgccactgatatatacatctcacatataagtcagaggatccacttccgcttttgacacacattgttatccttggcctatttccaatgccctcatgatgaatcatgcaggataaggaaaaccatgtagtggaaatatccggtagcacaaatgttatctttggtagtcttggtagcacaaaggcttgggaaggagaagatacttaatttcactggtgaacataacattggatgatcaattgatcccttttctctcctctattcatagaagtgaatatgttttcattggtaagaagaggggctacaaatcaatcgatgaagatcaattgatgaagagtagtccatgtataatggttgtcaatttaatcaagtgaactaattttactaattttgtgggctgatctatgcccatctcttacactacgcaccacgactatatgatcataatattgaaggtcaaagcagagagaattagattccctccgtcccaaaatataaacatttttagcataatgtaaagtcaaacatttttaactttgactattaatagcaaaaaaaaatcaattatatcctataaccaaaattattacgtgttaagtataaaaaatacattactacgtatgaataagtctacaatttttagtgatacgtaaagttagaaaatattcattgaacaactatttatctctgaaataaagggttttgttttaatatggggtgaggttgatgataagatccagtggctacaatttcagactaatgaaaaaagaaacccatgacaatatgcaaagatttcaatcacctgtaagctagtctctccaacataagaaaaatatatatgtccaaattcatctctgaagttgatttttattttggtcaactagaaatctccacaaccttgaaaatccctaaatcatttaaacaactattctcattccttgaatacaaatctaattgatctcactggtaataccttttctcaacagtccctttcctccttagttaacatgttaaacattttcacatagacataaaatatttacaaaaattttgatatgaaaatattcataagtgataaaaaataaagcaaaaccatacacatcaacaaaaaaaaatagtaaatactgtaaaaaatgcacaaaagttatatcttacctaggactacaatttttagaattagtagtgtgttaccttaggtgacaagaaatcaaaagttttaagcgtaaaatcgagcaaataccttctgaaagacaaaggcacaaaccaaattaaactaccccgttgcaaggacatgcacacgcacacagcacagatgctgaaaaaaacaaaaaatatggccgccacccatgcatgcccacgatgacacgagcgtattcgatctctctcgcgcgcgctagctcccgtggccgccgccgtgaggccacgcgctcggcgacgacgccgcggtcgtcgtcgtcggcagcgtcgacggcgggcgcggcgccatcgccggagagaccccgacgagccgctgcgccgcgaagtccaggatctgcgccgccggcgccgcggtggccgcaatgccggccacggcggcggcggcggcggcgtcctccccgctccgcagcagccgcgcgtactggatcaggtcggggaacggcgccggcgccacggcgggcgcgggagcgggaacaccatgcggcggcgggcggggcacagcgggggagacgaggaagccgccctggccggtgcggccgcggacgcgctcggggaagttgagcttggccttggcgcccttgaagcggagcgcggcgtcgtcgtaggcggcggcggcggcctcggcggtgtcgaaggtgcccagccagacgcgcgccgccttgttggggtcccggatctccgccgcccacttgccccacggccgccgccgcacgccacggtagtgccgctccgccgccgccgcacctgcagtcaggcacacgcgcacgttcagaattgcgttcttcccccttttgctttcaagaagaaaatttgctttaacacgagtagaaatcactcgcaagctactctatttttcaagaatcatacagcaagttaatcactctaagttattatcaaattatgtgggattattaaacagccgatacgtgattatagttgctctatccgttttatattataagtcgtttaatttttttctatacttttagatttaataagtttatagaaaaaaatattaacatctataacaccaaactagcttcattaaatttaacattaaatatattttgatataatgtttattttgtattaaaaatgttacattattttactacaaacttaattaaattttttagtagtttgattaagaaaaaaatcatacgacgtattggaggtctggaacactaatttaaccatcttaatctacacgaaataggtaaatttgattgcccgaagtttctaataaatagataaaccgatggatctatactcttgtagatagcttacggttaatcatagcgatcatggcagcttaattacgtacttggatagttggattacgtgtgtgcaactgtaacacgtacgtaccttgcgcctccacggcctgcagggcagcggcggcggcggcggctgaaggccccaccggccgccaccgccggtcagctgattccgacgacagcgtcgccccggccggcgcggcgaggtaggctgcggcggcggccacggtgaccacgtcgtccaccggctgccactgcggctcgacgtcgtgccaatccgggggcgcgccgccgcctccggatcctatcggctgccgcgacgacatggctgagctgccgctgccggcccaagcttgcggcggcggcggcgattggtccggccgaggccgacgaggctgcggatggtcgtcaggtagaggccgcttcccatgcctccgatgctccaccttaattagtttgctgctttggagatcttggtcagcttcgcgctagctctctgaatcgatcgctttcttgattgattgagctaattatcaagctaaaaaatacgtagtactagataattagtggagccacaggagaaatataatcgctcgagattaattcgaagttggatactgggaatggatatgatcgatatgggtctcgtcgggagaatactatctttttgctttgatatggaggaagaaaagaagcaaactgaagcggagaaagtctttgagtttgccttggcatccctcttacgtgtatacctcaaacgtggttgttaatttccctacgtgcacatgccttccggcgcgcgcacacacactcttctttttacaccacagacgcacgcaccgctacacacacaacaccacactctcacccccgtgaatacttaacacaaactctaaaactctaaaagacgagaaccagcggcacatcctagatcccacctacatgattagattgtgatttgtgagctattatatgtacgacttgcaaggtataggatcatttaaaaaaaaacaagggtatgaatgttttttcatgttattaattcctcatggatttagctgttcagagttgctctgagataacatgcgctgctatatagtggaacggtataatacatatctattattaattaggatataattgaagaatattcaaatgaaatttggaggattttgatcattagaaattttttcttcatttctcctagctcgtcagctcgtgcgctctcttgatttccctctcgagcatctctcttgcatgaaattaaataacttccttcaaaatttctataaatgttttatgtccttcttccagtgcacaaacccaaaatttatgtgttctaaaaccctataggaatccaaagcttgtgacattcaatttagattaaatttctatttacaaataaataaacacaataagggaaccatgcaccaaattctaaacccaagctagatcaaggcgaactcaggtaggtacttcattgataccctttaatttggaatatgaaagtagctctgggccatttggaggactccgtgtgattttcttttcacgcaagacggcctgtcacgattgagaggggaaactcttttaattacctggtggatgttcacccgtttattgcatgccatctaaacaattataaaaaaaattgacaatataaatcaatatgtaatatatcactccacaaacattaaaattcaacttctacaaattgtaacaaaaataaaaaataaaactcaaattagtaaggtatatttgcaattatattttttatttttgttacaacctgtaaatgttgaatctgaacttgcatgtttacagagtgaatattacatattgatctatcttgtcaaaatttttttaaaaaaaatcataaccatttagttgacatgcaataaacaggtggatctccacccaagtgattagaattcatcttccgatttagaggtttaaattaaggcttttcgccgtaagtttgatatttcataacatcaacttgatcttgtaaggtgatctagatatatattttttataggccgggcaagcttaaaaacagatgatgattaaagtagatataaaataaaattcattctactctatacaccatttaccaagcaagggtggaagttctgaattaggagagaggaaaaccagtagaaggtattatcaatgaatagtcgtacacttgtgtattattgacaggctacatttatatacggagcagtcaataatacacaaatttacaactatttatataagtgtagtctgccaataatatacaagtatatttagtcggatataaaacggatggttgggtcatatgcatcaatttccatagattgctatgcctatgacacggtgaggacggacaacatctcatcatgggaccaagtagatgaaatcatgaaagcatgtatctgcggcgaccctaaatcatagcttgggtgtgttcttttggaggggttgggaatctctcccctccgcacgtaaaacggagcgataaattaaagcatgattaattaagtgttagcagaaaaacttgaaaaatggattaatatgattttttaaagcaactttcgtatagaaactttttacaaagcacacaccgtttagtagtttgaaaagcgtgttcgcggaaaacgatgaagataaattgggaactaggggttaagagtccagcaactttaatttctaagtggtgtatgatagtgtatataatcgtttagagtcaattgcaacttaatttgcaaaaaaacaagttgcccgacaggatggtgcctagacagatactgagggggttgcgttcactgaaagaatggccggcgccggccaaccggaagccgatgatccatcacgctcagcaccacgcaagagatatcgtgtggtccacacgattacatacgatcgatctatgcagcggccgggccactagtcaaagatacgcagtaaggagtacaattggtcgtccatctccatgatcatgcacttacgtgcagtgtaccaaacgggtcatactggctatggctgtctagagatgggccggacgacggacgtgacggctcgatcgatgccatacggtgcgaggggagctagcttttgcacgcgtcgcacgtttccatgcagattaattgtcacagagaggaatgcgagcaacacacggttaatttagctagctcacaattatataatactacatattaatttgtttttacgactatgtattactactattatactttgaccgtcaatttatcaatagctataaaaaaatacttttagatgcaaatctgatataagataccacatgtggtatgcttaacatatgcattattaattagttaaatgatataaatattatttttttcatcttatattttcagacatagggaatttataatgttattgataaataattatatcagaagatatatggtctcttgaaatggaagattttcagagaaaaaattacaagaattaaactagtttatatggagccttgtaaattcgtgtgttctaaataaaccctaaggctgagttcaggtaactccacctccccgcacgaaaaatggtgttccccatcaacatgtgattaactaagtattcgtctaaaaaaccttgaaaatttgattaatataattttttaaggcagctttcctatagaaaactgaaaaaaaaacatcatttagtagttagaaaagtgtgtgcagggaaaacaagggaggtcagttgggaaaaaaggggaagaaaacaacctaaggctcctttgaagctcacggttttgaaagcatgggaataggaaaaatcaggaataaagtgtcctttggaactccaaaaacaactctttatttgaataagcctttcagctcctttcggaacaaagtaaaaatatcaaaattatagatttgtattctgggaaaaaaatctttatagttttttagaacaaagtactacaaattcctttgaagttactatggaatgggctattctaaagtaattttagagtaaaataagcataagatctcaactaatgttttcttcttgtatcttgagctatgcgtttctcctctgtcattgaatcgataattacattttccccctattttttgtgttttggcaatctttaatctagcataattctatgctcattaatcccttcatctcatagttcttttattacacaagacacaacaagtgtgccccgaacaca

SEQ ID NO: 69199 - DNA, 1951 bp, Oryza sativa
tagttatataaagaacatccttagggtcaacacgaaaataactttgaatcttaaggcgtgggactggagttgttgtaacatcagaagctccaatcaatatagcaatcccatcactttttagaacttccatgacaattggacaattatcataagtctcatataacttatcttgaggttcatttcctagtttaaaaccagtccttttgttatatgtctcaaccatctcatttatatcaaatggagcagaaaacacaaatcccttttgtgctccttccagtctacgggtacaatcaattaccgcagtaattgcatatagagtacaatgtgctgaaatgaaaatacagggaaaattttaaaaggtattcgtgttaaagagacaggaaatgtagtaggataagtgtatccaaaagaaaagtaaaaataaatgaaataatgataataaaaattagatgaaacaaataaaaatggtttcagatgataaaaggagcaccaaaaactgtgttgaattctaagttctctaacacaaataagaaataaaatcacatctacaatcaatgtacaatgtgtaatttgtgaaatccagtccaaagtgcaaatgatggtaactatatatggtgttacgggaaaagataagtaaccttggtcaatgaaagtttaccaaaataaaatttactcaaaataaataatagggatcggaatagtatacttacgttcaagtttttgatcataggtcttaaaatccaaagaaataccattgagtgtacattgagttatcttccactcgtaagctgcatcgttctgagagagagagagagaggaaaatggtagtaaagaatggccatgtacaaatatcttatatttaaaacttctttacgaagtaaaaaagcattaaagatgtgaaaaagatgaatggagctagtttagaagagagagaagtaaaaaaacattaaagatgtgaaagagatgaatggagctagtttaaaaaagagagaggaaaatgcaagtaaaaaatggccatgtacaaatatcttgtatttaaaacttcttcacgaagtaaaaaagcattaaagatgtgaaaaagatgaaatggagctagtttaccttcaaaccacagtcaacacacccgaatggaggcaagtctacaagcatattcttgataggctcgtactccttcctacacccggggcaaatccaattcctgacgtaatccatggccttcctcttatcacggtacatggcagcccgctcatctagctcagaaatctccggagcaggcccgatgacccaactacccatctgaatctgatgccagcaaacaagtaaatgaaatggctaagaatgtgcatagcagagaagaagaagggagggtctagagcccttcaggaagagagaagatagcgtacccggcagatcggaggcggtgcgtgccccggcagcgtagataggcgagcggcggcagatggataaacaaggaggagaaaccctacataatgggggggattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatatcgacaattccaaaaaactgctcatactatcattatagtataatgaggagcggttgtatatggccctatcgtctagtggttcaggacatcgggggggggggtggcaagtgctgctatggctatgggcctgcccttttgggccaggccttcgattttcctttttcctgaatggaataagttcaccatagatcccttaggttgatccacgtaccaaaatacttaatataacgcgcctttcaactcctgaaactgttgcaaacttaatcctaagacggtttggatgatggtttcaactgacatgg

SEQ ID NO: 69200 - DNA, 1248 bp, Oryza sativa
gtaaacttttgacttaataaactttgggtctataaactttaggtgtataaactttagatgtatataaatactatatatagaaaatatttgaattcaaattcaaatttgaatcgggtatgtaaacttttgacttataaactttggatctataaactttaggtgtataaactttagatgtatagaaatactatatatagaaaatatttgaatttaaatacaaatttgaatcgggtatataaacttttgacttataaactttaggtctataaactttaggtgtataaactttaaatgtatataaatattatatatagaaaatatttgaattcaaattcaaatttaaatcggatatataaacttttgacttgtatacttttggtctctaaactttaaatgtgtaaacttgagatgcataaatttattaaaataggaaagtaatatggtgctaaaaaagaaaaccaggtggagggaggggaggggggcacccgatccctatcccatgggctgggcgattgatcgcccattagaggtttcgggaggggagagtgtatagggggatggggatcgatcgatcgcctattagcttattagctgtccccccaatacattgcctacgccgtgccaagtgccaaacagggaaaggagacaatatttttatttttcaattattatattaattataataataatccccgcaaaaaaaaatcataaagacttgtctcttcgtatcgaatatcgattcctacccggactctttatttacctttccccaattctcacaaactgaatgccaccaaaatcgaatcgctacaaaccctatccactgccgctggactcgtcgccgtgattcacctcgtgccgccgctcgcgcagcgccgccccgccccgccccgccccgccccggcgtagtaggagatgaagcggcgaaaaatcgccaaatcgacagcaagccgggggagcaggtccggtgtgaaatccccaaatccacggagcagagcagcgaatccgagccggaccggcggcttcttttctgatgaactccgattgggcagatggacttgttaccacggggaggaggaggaggagaagccatggctgccaccggccgacaaatcatccgagtccataagggagtacgtcgccgaggcggcgcgccggctacccctcgaggagatgccggagctcctccactgcgtcggcgcggtcggatactgctttggcctcgccgaccccgtcaccaacatcatc

SEQ ID NO: 69201 - DNA, 564 bp, Oryza sativa
cactataaagtattataataacctatggtctggtttcaaagttcaagttgtaaaatggacaattgtgccattattttgtcacctgctgctattttttaagggaattgaaacagcaaatgacaattatgagagtttcagcagtatcgcaaatacaaagctgagatcagtccatctaattcctaatcttgtgtaccaatctgaattgccttttcaggccacccttgtgaaaatggtcaatgaagccactgcaaacattccagggtgggacgaagaaaggtgattaaatggttttgcctcgctgatactcaattcagctgatagtgtttacattagaagccatcgaaggatctccgtggtcaataaaacaagtgaatcaacgcatgttcttcttaggcggcagacacgattggctaattcctacaaattaacctagaattagtttttggcaagtaaaacacggtagttatttggtcaagtgaggtggtccatttttggtgttgtaaagctgaaacgtgagcttttggtaatactcctagatcatcgattgtattgtaaagcagaaat

SEQ ID NO: 69202 - DNA, 9940 bp, Oryza sativa
cccggcgatgcggaggcgtggacgtgcggcggcggcaccctaggagagagcagagatgggttaggggtggggtaagtgaccacggcggccaccattgttgaccggagacggagggggatggatatctcactggctcgcgagggagatagggttccggtgaggttacggcgacgcgaggcggtggccgagatgacccacgcgacgacgaagcaagcggcggcggcgcgtggctggatgcggcagctctagcggcggcggcgcatggctggatgtggcggcaagcggcggcgctagcggcaagcggcgcgggcgcggtagagaacacgggagggcgcggcgagagcggaaagagggagaggaggctcggaggagtgatttatagggcacgggaggggcggacgtggctgggaaagcccccgatttcgccggtgacgtgggggtggagagagagagagactggggttcaaatttgaatcccggtcggtgcggggcgcgcgcgcgtgcgggagaggtggaggagtgggcggcgaagtgggcacgagcgcgggagaggcgcgggatgggcgcggaggagccgcgtgggcgaggcggcgtgggcggctgcggcggttgctgccgaggcgcgggcggcgggaggttagggacaaccgacaggtgggccccacttgtcggtgaccctagggagaaagggaggggcgtgggccagcccaaaagaaggaggtcgagcgcggttgggcgagctggaccgggccgacggcccaagaaagtaaaaagaaggaaaaagaaaaagaggaaaaagggaaaatgaattcctgggatttaaaattgcactttgatgattttaattggtcaaaattacttataaggctctgaaaatttcactaaaaatcctgttaatgcattaagacatggggaactcaagaaaaattccaccacgccatttccaattattgattgcatttattaattagggaattagctctaggttaaattaaaccatttctttggacgatttattttatgaatttaaagcaaaggaggggaacttcagggcgtgacaacaccctcgtctccctaaccgttgagacagagggattgcgtcgaggacctatttataaaacattttttataaaataattaaaatgcaattatcttttcttaaaaatagggatgctagagagacaggtactaaggatctatttgtaaaaaatatttatatttaattcttttttaaaaaatattttataaataggttctcagcgtaagtgtttttggtgctgacccattcatatcaatgagttcactattataaggggtgaaagcgtcagcaccaataccactgtcgttgagacattgaacctcatggtctcaaactcattgccccagcaccaagaaaaagggttctatttgtaaactaggtttttaggtagggttaatgtaagatcaaagtgtgttttgatgcttatttagtgatgaacaattggcatctgtgattattggttttgatatttggtgattactgtcgaagtggttttggatgattggactcacaggtgctgttattttatgtggtccggtccgaccgggcggaggttgccggtcagaccggattgtgttgagcggtcagaccggctagccgcggtctgaccggccgacgctgtgtcggtttcggtttcgggttgtttgtttggatatcagtgattgtttcatggttatggcttctagatgaatactatacgtatgtaatactgtggtttgctaacaatgagtcaagttggtggtagcttggtctcggaatatggtttctttgtttgtctcatgtgtaggtgactcgatgcctcgggagaatatttgcggtgatggaccgggagtcggcttgttggtaagacgatgtccgtggtggtcagatatcatgcgggatactaaggctagagttgatgcacatggttgatggagattccatatggcatacgatggaggtattgtgtgcgtatgggatgcggagtcgaatttggaaggagtccaaatttggtacgattggttatgtaaagtttctttcttgtactagaaggtttcctaagctgtttagcactcttaatatgagtttggttcgtggctttaggctacctacctcatgtataaatagagagggagcatgaggctttccggtatcgcttttgtatagcttttgagagctagtttagttagggtttcgagtttagtcgagatttttgtaaggagtgctgttgttgcactttgtaaacacagagagaagcaataaagttgtcatctactttgagagttcttctatttgtgtttcaccgggtttcggcggtctaaccggcatctcaccggcggtcagactggcgacctactggcggtcaaaccgactaaggcgaggcggtcagaccggtggcggcgacagcgacttcagacgcggcagacgatcttcaggcggttgaaccgagtgatcaacaccggtcagaccggcggcacgagcgcggtcagaccgacggatcaacttcggtcagaccgctatccatcgaattcgagggtaacttttatttccgctaaaagtttttggtttttgggtataccaaccattcacccccccctctggttggcttagttcttgtgattcgatcctacagttaaaatgtacaaattgcaggtcatgcgcgttagcgtgtatatttatttgcccaagcaatggggatcgatcagttgaccaagctaggtctttatgtacttaagctgcgtagtcgagcataatatacgtgtattatagtactagttcccaagattacagcgcaaacatttccagtttctttctatattgacgatcatcctttttttttctcccatctcttgcaatcgattatccttccgccatcacctctctctttttttttggcgtttgcctgttcggcaagagatattagtaatacacacttagagcctatttgattcccctatcaaaattttacaccgtcacatcaaacgtttgaacacatacataaagtattaaatataaacgaaaaaatatctagttatatagattatgtgtaaattgcaagatgaatcttttaagcctaattgcaccatgatttatcaacgtggtactacattaaacatttgctgatgacgaattaacacggtttacaggcggattttataatttgttttgttattagactacgtttaatactttaaatgtgtctatatatccgatttgacacgccaaaactttacacccctcatctaaacacagccttatttaacgaagctcatgtggtctgtgtccaaaccgctgaccagtaaatagtatatggacaagaggattgaacgcccgatctgatctaaaaatgggcagttaaaatattttagtttgccgtatgcgaaatgttaaattatatgtcgtaaataaagagctcagttatttgaacatttgaaaggatgaaaatgtagtgcacaacaaataaaacaacattaaacatcttgagaaccggaaaaatgtgagtgtgaaacagtgttaaattcaaattgaaacattttactctcatatataaaacattaagttcctacttaaaaaaacattgacaaattaatgagatgaaaaagtagaaaaatgaaacatagtaaatccaaattgaacagtaaaataaaattatctaagattatgtttaggccccgtttaattaaaaaaaatttcccaaaaacatcacatcgaatctttagaaacatgcatgaaacattaaatatagataaataaaaaaactaatggtacagttaggaggaaaattgcaagacgaatcttttgagcctaattagtccatgattagccataagtgctatagtaacccacatgtactaatgacggattaattaggctcaaaagattcgtctcgcggtttccaggcgaattataaaattattttttcattcgtgtccgaaaaaaccttccgatatccggtcaaacatccgatgtgacacccaaaaattttcttttggcgaactaaacaggcccttagttgtgtccgatgatgcagatgggcagaggtggagctcgccacctccgagccatcggtgccgctcctagatgccaccgctcaaaccatcatctgcatttgggttaacgtataaactaaaaatacatttatagtcaaatttatcttttctgcgatatgtataagttgaattttaaattgcatgtctgtggagtgatatatcatatgttaataaatcttcttaatttttctttaaaaaaattcataactatttaaatgacatacatatcagtgcctgagcggagcctttggatcagcaatgccgagtcttcacaattgtcttatcagtacctatcggaagatcgggaccctagtcctcatcagtaatggaatgcccccgaaaagacttggatgggggactaggacaccatgcgactacacgaacatactcctatttgtggcgacaaccataatatccctagggaacgaatccatagctcgtttctgggactccgcatggctaccaagaagaaggccgaaagacttggcaccacaggtatacacaacatccacaaggaaaaaagaacgcttaagaaagcattcgaaggtgagacatgcatacaaaaccttgacctctcagtcaatggtgacatgctagttgagctcctagaccaactagtctccctatagaacatagtccaagatgtgcaactcgttgacgccgaactagatcaaatcacacggaaactcacaacccatggagagtacataacgatgtctgcatacaaagtgtggttccttagatccaaagcagaaactacacaacaatcatatggaagtcctgggcaccgagaaaatgcaagttctttgtatagcttatcatctaaaacagagtatggacgtcagatcgcctcgagacccgctgatggcagaacaacatccactctgctagcataccctagagatggctatgcacctcacggcggaatgtaggtacacgaagagaatttggggattgatatcaacttgaatctcccacgagtaaattaagccagcaaattggaacaaccatgcgacaggccatgagtggtggatgggtctagcctccaatcctggggtgccaaagaaaggcttgcgtagccttatccttctagtatcatgggagatttggaaggagcaaaattagcaatttttagacgcaaagaaccgtcagcaacatgtctggtcgcaaagaacaaataggagccaaagactcgggccatgacaggagcgaaagaattgtgtaacatagtgccttagagccccctccttttcttttaaaggatagcaaactcaggggggcgttagaagagcgaaaaatgaaaagcaaacgggacagcaaactcagggggcctacttatttcgcgaaaacaaaattttttggtgtcatataagatgtttgaccggatatcggaaggggttttgacactaatgaaaaaactaattttataactcgtctggaaaccgcgtgacgatcttttgagcctaattaatccctcattagtacatgtaggttaatgtaacacttatggcaaatcatgaactaattagactcaaaagatttgtctcgcgattttccccctaactatgtaatttgttttttaatctatatttaatactctatgcatgtgtcaaagattcgatgtgatgtttttgaaaaaaaaaattgggggaaataaaccaggccaaagttgaaggaccaaccaaacacaaacaagctgaacgttatgtgtgaattattttctttcaaaaaacacctgtaggacgtgtgcatgttcaatttctacgatagcacataccagtgaaactatatgtattatcagaattttttaatataacatatatatatatatatatatatatatatatatatatattcggtgaccctgtatgtaaacaaaatatagtagtattaccgatagaaacctcatatgtcagtgacggagtgacacgtctaactatctaagagactgagcactgggttcaggtgatcgagctagaacattatattggctgcccacacaaccacaagtgtatggccaaattaaaaggtaaaaaaaatacaatgggggtgttgcgagaatcgaactcgcgacttctcgcacccgaagcgagaatcataccactagaccaaacacccggcaacaatcgattagtggaaccaagatatatatatgcattctcctggacagattcgctaaggcggtaaccaagaacgttacgtgtgtacacaggaacagcctgaacagctcgcacgcatgcaagcgcccacgtctcgacccgtccagcccaccgccttctttaaccacttcaccgagcgatgaatcctcccaagctcgctcgctcgctcgatcgtttactaactatacttgcgggagatgtcgtcgcttctgctggtgggtccaaggatgagcgcccggttcctcgccgcggtggcgccggccagcagcgcgcggcccaggggcggagctaaagaaaagatgaggggcttcctgactttctctttataatataataccggtatgtataattctgaagtgatattgtactaaagtgatattgtactaaatagttgtgtacccaatacatataagaaacatatctctaattgatgtcaatatacaacaagaaaatgcatagaaaaatgaaaaatatacgtaccataatgaagaaaccatcttataactagccacttgctgtcatcctactcccctccgttcaatgcaagcaacaaacactaacttaatcaataatcatgggttatggatagtctagcaaaattaaaagaggggaccaacgggacttgacttatcgattggattttgatgctgcggcctgcagtggtggagttggtggcgaacagtgaactgctggccgatgttgggcatggtaggagtaggcgataccggcggccagcggcaggcacggcaagggcactagggcaggccgcactgccgcacgtgtccagggctgatccaggcgataggggcagccgatgtcgccacgtcgggcataatcagggatagatctagacggcgagagactgaaaggtgagggacgagtcgcgcgttttgtggaagacggaacaatgccgctctgatttctggtcgccgattcgctaccctggctccctgattcgtcgtcacgcgcgcatgaatcgatcaaaacacgtgcgatgcgactcctcatctcctctcagctgggccttctccaccaataaagaaatctatgggctggccgaccgggccttgtcgagtggaagttttaggctagacaatggagaaaggttccttggtttgggctagaggggtgcccatgtggtagagatataggggttacaagatatttcgaattttgggccgggttcctgggcacccccctgggcctattgggctctgcccctggcgcggccgatggggacggtggcgaagggcaccacccgcgccgccgtgcacggctcgcgctcgccggccacgaccaccctccatgtaagtactccctccgtactcgtaaaggaagtcgtttaggacagccacggtctccaaagcacaactttgacttcttttttctataaaaatatttattgaaaagtgatatatgtaacttttatgaaagtatttttcaagacaaatctattcatataatttttaaatttttaaacttaataacttgagagttattcatgatttatattctcaagatttaacttaaacattgtcttaaacgacttactttatgatgagtatggatggagtatacgtagacgtagtcgcgcgcgcgtctcagctacttaattttagctgtcgcttcagttcgtttgctgctgaggcatatatatgcagaacaaggaggaggtggaaacggcggtggagagaggtcgggagcagaagcacaaggcgagggaggaagtggaggacaaggtggacgccagcatcgccgaccaccgccagccaacgaccaaataaaatgatcatccgagacttgatctgtgttctttgtactattattagtagcttgtaaatacacggacccaggaataagtaatcttatggatttatagcttgtaaatacacggacccaggaataagtagtcgtatggatttacgaacccaggaataagtaaatcttatggatttgttacatacacaaaatacacgatgacaacaatatttgtttcaagttaccgacgtttcgacattaatctgagccgtggggagaaatctggacgagcacgccaagagcggcatctgatggtgcagtatttcagtctccagcatacgtcgccgcaggtcgccagactctatgtctatcattcatggacatgatcgtgcagatgcatatctcaattgctccatgatttatttcaagtatcgagagaaatcaagtgttattttttcctctttaaacatacaattattctcgttcctcgttcaacagatccattctatgatttcaagtctcaatagaaattaagtgttcctttctcctcataccatacaattatcctcattcctaattctacagatgcacaggtcattgttctatgatttcaagtctcaacagaaactaattgttcctttgttctcttaacataacagttattatgagaggaaggcagaggttaccgttcaagaacaacgattttttttgggtgtatcctgcaaagcatgtttcggaaatgctttcttgaagaaatcatcatttgctatgagatccccaccctcgcaccagatgacatacatgcaagctacgcaaaacagatcaagcagtacatgattgaattgtaatgtgaaacgatcataataacatcagttgaccttatgttgacatgatgaaaccaagcaaggcaactgaagccaaacattcggcagatctatcatcagtcataacgaaagcactgtgattcgagagagaataaactgtccatgagcactgaatctttaggaaagaagacgctggttcttaagtcctgcagtttttaactcaaaatgttgcataaatgtcgcaagaaattgaatgaaacctagcgaatgacttggaaattagggcaaaaatcgaacctagcatgaaggcaactaaacataaccatatccaaaatgttcgtgtaattttcataaaggggaatatggcaagataggtaacatgcaacacatgacatagcacactaatgatcagttacctttaatagggctgaacctgaacgtgtctgcatatccagatttgcagtccaatactagcgttgttgtacgctttcagctttattagactaattttcagtttcaaatgttgaaacaaaacctcactgtatgttaatataggtaactcaaaatactaggaaaggtaaacaatacctacctgatattttttcccctctaaaaggaagactgtagggtcccaacagagctgttacagcagaacagagattcaacaagcgcaacacatcgcaaaactcatttgtacaacaggttaaatggcgaaagggacataatggtctacctcatgagttttaactcggaataaaactatctatatgttcactgatctgggccatgcctgcttggagaacgagacctgctcctcactctactcctgtcctttctcatgtcatcactcctatatcggtgtctgtctctttcagaatccctaccatttctgtaggaactgcttctatattctgatcctctatctctgtgatcatgagacctttctcttccacgattgcggtcatagtaacgatcacggtcatagtcacgatccccagacttctctcttctagaaccaccgtccctgcctccaacatcatactctttttccctctgtttcctacgttcttctgctttcttctcccttgcaatcctctcttcgtctcttgccttctcttttgcagcctgaac

SEQ ID NO: 69203 - DNA, 20878 bp, Oryza sativa
atgtcaaaaattatcgtttgtgtaccctggctggtcctggacagtggtttaatgcacattcagcttagaaattctggttcatgaatttctgggcgtgacagtgttgacaccaaaatcactggcgtcaagatgttggacctcagccagggtcacttgcattgagaaaatgatataaccctgactaagtttatctagtggtttatttgtaaaatatgtttcaagaagggccaaatgtaaaaagtgcagcacacatgaaacatgacacgcacattttagtatagttagcagctatagcgtccacatgctcgccatcagtccgccattttgactttcaccaggcttgtaagtacaacaaacgccgtcgttgtccttaggagcaaatatacggccatagcgatgtaaacaatgaaaaccaccgtatataaaaaaactgacaaacagcggagagaaaaattaaaaacaggaataatgctttatatttataatttattaattttataactcgcaaacgaagttgactttgttataattgtctttttttttggggaacttttttttatgactttgttatatttatctttcccgcatatgcgattttctttagaatgtttttgagaacttctaaaaaaaactttcataatatgtttttcttgggatcggccactacaggatgccacctagatatggatatcgagttagctcggctcgattcggcttatgtcaactcgtgaagatacatacaaagctggtttggctggtgcatgattcgggctttgtttcatagcaattgtggttcgcaatcgtatgggttatcacttttttgtcggtccaatgctattgaatctcagacttcatgccgaaacccgaaagagagagttggaaaggtggagtcatggtgaaagagtgtcaaagttgtactctcatcgactcaaccacaccgatttcaagagggttctcaggacctccccgctccgtgagggttcaccggcatcttaccttccattggcattggttgtctagctgtccggcgcctagaggtgcgttatcatctagtctcaagaaaaaaaaaatctcgcatatagcaaaggtgatattatacatgtaaatttagaagaataaactcaactacatttgttaaatacaaatttgacaaacaatggagaaaataataaaaaagggaataattctttatattttcaatttgttaattttacaaacgaagttatatatgtttgttcttacaacttttgttgcctatttacatcttccttgcatacgcgattttctttagattgttttttaaatttcttaaaaaaagttcgtatcatatatatttcccatgggatcggccactacaagatggtacctactaagggatagatatcgagcattcgagccagctagcttgactcaatgaacaaacaagctaaacagctagtagctcatctcggctcttcaatagctccagtagagtgagtaggtaagaatagaatcaacagcttacttttttaaaaaaaaagctttgtctcgtccagcaaatgttatctcatacagagtagtactaccaccaggtacaaaatcaaatcgagccgttgattgtggagggagcggggtacattggcatcgttcgtcagcacgaaatcaagtttagcgagacctttgtgggagtgcctgactgagcccactccaccacatgtccacattcgatttttttttattttttgaactttttcaatttttaatttttttgggaaacttttaatttaaaaataagcactttcaaaacttattttcaaaatttgaatcttttggcgtggctggtgcaataaaataacgctgtaacgtgtagtctggctagattgacaaacgttatatatttagtcacgtcgatctggctggcgtgatggtgttatttagcccgttatatgtgatgtgtcaatattgttttgctagccagacgagctgatgtggtcaaaatgtttagattctaaaaataagttttagaaatatttatttttaaaatctctactattataaaaattaaagatgtttttgctggtactttggtatgtcatccgtgtatgagtcgaattttaagtttgttcgtttttggaaatacatatccgtatttgagtcgggttttatatttgttcgcttttgaaaatacaggagtaatcatatatataagaaatctctttaaaaaaacttatatgctaacttgagatgatcggactcctaattgcaactcatgattttctagaaaaaatatatatccaagcgaatctcacaatgaattgtagaaaaaaaaacaataacagaattaaaatagccttcaccgtagcaacacataggtattttttctagtaaataaaagttcaaaaaaaaaaaaattccaccacatcctcacctcccagcgcagattatactgaatccgcagttctctctccccacggcgatgggggagggggcggaggcggatgcatggtacgcaacggcggcggctgcatagatgcacggccatggcgacacacactcgcgcggcgcggcggcggtggagggggagactgcgtcactcgtcgaaatcggtggcgtcagcggagctaggatgcacagatacggtgcgcatgcaggtcacgtatcccgtatcggatacgtgtaggatacggatacgtatccgatacgcacggatacgtatcccgtacgtatcgccgattaacaagattttcaaataaaaaaaataattccggatacttcccgatacgtccaagccctagcatcgatcttctccagacaacctcgtgcgccgccgtcgttcaccctcacgaagtgcagcgaggcccagcagcagctagccccattcccagctccaggatacgtgagggagcgtgtatgccgagcgaacgacggagctgctgtctgacgcgatgcctccgccgtccacctgctggtgccgcagcttcgctctccggcgcgcagcgcctccgcgggccgctgggtgccgtagcccgcagccagcagcttcgctgccgggcacgccgccatggccgccagtaaccctctcaccaccctgtcacttgttcgtccactccagttcaagcctcttcaaatcttcaatgatcttttatgtgcccccattctgctagtatgactgctaacgcaactgcaacttcatagcgttggtggagatagctgtgagaattattgagatgtttcattttcctgttgattttctctggctttgcgaactccaactctcaatcacagtaagtgtgtataaccttaagacagtcctagaagatcttgcagcgtttgatctatctgatgatgcaagcaacaattaaattgatctagctctctagatattgagttgaacatgaagttctgaacaagtctattctaatttgtcattgattttttttctgcactatacgtagtcttgcacttatatgattttctgtatgtgttatatatatatatacatatatatatatatatatgtatatatatgtatatatatatatgtatgtatatatatatacacacacacatatccctgtatcaaggtaacgtagcatcggagtgctcgcgtcgcggcgttggccaagcgtgaaaagacacctcttcccatcccatccaatgtgaaaatacaatatgaggtgttcaattatatggcaccacctcaatgacacaaatggtactcactgtactaacctccaaccgttggatccgattgtaccaccggttgagatttggtaccaccctactgtgttgggcgataaaaaatctaaaaagaaaaaactaaatcaacagcatgcaaattaaggtttagttatgaaaaataaaacaaagaaaatactctcatattgaaaaacacataacttcttttagaactgatttattgaagggcgtacatatataaaactgatacaaaacagacgaaaactgaagtcgcagtaataatatcaacgcaacatttactggtactatattacaaacactataatcgtggcaaggctcgatccgtcggcttgccgttgccggccgcgccgcgccgtcgagcaagctagtcttcaaacagcagtggcaccggccggcggcgcagcagcttcagggtcacggtcgaggatgccggcgtgcgtgagcagcgcccagatgtgcgtcatgaactcgccgccgcgggcgaggctctcggcgtgggcgtcggcgttctccgacggcgccaggaagagcaccagctcggcccagacctccgcgagcagcttccaccgccggcgggtgtcgtagctggcggccatcagctggctccccagcctcgctccgtccatcagtatcccgtcgcggcctccgccgctgctctcgccgaggacacgcagcttcttgcacttgttcgccatggccgtggcgtcgacgaggtgtttccgggcctcctgcacggcggcgtccaggaccagcgtggccatgtagctgtggtccggcagcatctccgggacgaaagccagcaggtaggcgcagtaccctgacaggcgggtcgcgacgaggcggtcggcgccgttctcgtcgtcgtctgcggcggcggcggcgtccaggtggtcgcacatcgtggtggcgatgtgccacacgaggacggtgtgcgtgtgagctcgcgtcttccagtgcgtgtcgctctgcagctgcgtcgacggcggcaggaagcggtcgcacgcccaccgcaaccggctgtccagcgaccggccgacggcgagacggccgccgctctccttgaacgaacggaggactgccaccttcacctcgcgcggaagcctgacgaccttcggctccagcaggcgcccggtcagccatgacaggcagttgccagctgacgaatggtagaggagagagtactggccgagcttgttctgccagtgcctcgacgtcctcgcccggcgagtcgccaaccgcttgatcaccgcttgccggaagccgaagccgccgccgtgccgcttcttgttgttcttgtcgacgcgcctgacgtagtcgcagacgaagtggacgaccgcccagtcggagtatccggtggacagctgctgcatgacctcgacgccgaggatcatggagatgaagaggaagtcgttgaaggaggagaagatgccgacggcgcttatgtctttgaaaatcttagctgtgtagctggccgtgtaggtgaagtcgtagaagagcttgaggaaggcgaggagggagacgaagcgggcgacgtggagcacggcgctggtggggaacagcgccgggtacttggtgtagaagaagtcgtgggcgaacgacagctcgagctccacgacgcggaacgcgcgctcttagtcgtcgccggcgaggaggccggcgacgacgaagtccctcgccttctggtgccccgtctccgcgacctcgagcccgcagaaccgccgcttcagcagcttgaacagcgcgaaggagaggcacgtgtccttgagcgcccgcgcacgcgcccgccgcttgtcgccgacgacgccgtcgccggagctcaccagcagctcgccgtcgcagcgccagatcttgtcaatggtgacgacagtgccgtcttctggaacacgtgtccggtagtccgtctgctccgacggcggcgtggagcgcccttcctcgccgtggaccagatacttgtacgggcccatgtccacggagtcgaggtcacgagcggcggtcccgccgtcgccgccatggccgcagtcgcggtcccacgcgtcgacggtgtcgtgcatgtagtcggcgaccaccttggcggcgcgcacgaggccgtgcgaggagctcgccatgcgcatcgccttgatccgctgccccatcttgacgatgctgtagagccagcagacggagagcgtgatggtccactcccagttgacgccgcggggaggaggattcgagcaggatggcgttgttggcccgggtgacgagcacccagagcacgagcacggtctgcacggcgtgctgggccatcatccccttgctctgctcggcgtcgccgcgggtgaaggcggacatggtgtcggcgctgccgaggaggaggagcagcccgacggcccaccactgctgcacgctgtagcggtcgggctcggcgacggactggacgaggccgacggtgtaggagacgacgttggaggagacggtgtaggcggcccagagcaggacgaggaagagcttgttgctgctgcgccggcgccggtagcccagcagcgcctggaagccgagcagcgcgccgcccaccgtggcgaggatctggatgtgcgtcgtgcggtcgctgccgatctggttgagaaggtaccggacgctcatggagtccatggtcgtgttgggaggagggcctagctccagctcgaacgccatggttcacactagctagttgaggcctcggaggctagcagcaggttgtgtactgcgctgcgcagtttccacgggggcttttaacaggcccgcccggaacctacatggcttgactcagctcaggcggtcaatattaacaatagtttctgcatagtgctaaggcatactccctctccctgtgtcaaaaaaaaaaatcaaattatagtggtaaatctcaatgcagaagaataagactgtaggaatgagtctggaactgttgcactactggagaatgcatcttctatcccggctcataacccatgtagtctcggttgcagaccgagagaagaaattcaagactaaagatgacgatctttagttccaatttaaatacccgagagtaaagatgcttgtggatcattgtttttatctatttgcacttttttcagttgaactcatccacggttcatctcccaacatcccaagtcatccacaatcccaaattattcataacaacaaaatcatcatccataatcccaaatcattcacaacaacaaaatcatcatccacaaaacatatatagtcaaaaaaaatcatccacaaattaagagggaaaaaaggggggaaaaaaaagaaaaacattggccggccgaccctccgcgtgcgcccggccgcctgccgccacgcccctccgcgccgcccgccaccgagcgccgctgcccgccgcgcctccccgcgtccactgcacgctcacccactgccgcaatcgtgcgtgagaggataggatagagagagagacagagagaggaaagggataggataagggaagatatggttgctagaggataagtgcgagggattatatatactatgcatcgatttttagtcccggttggtgttttcaaccgggaataaaaagagtagggggcggacactttttcaaccgggttggtgttaccaaccaggactaaagatcatagaatggctgtgtggtttttaaccggggctaaagatgatttttagtcccggttctttttggaaccgggactattgtggttttcggccaacctagcaaagatcagttctccagtagtgttggtttttcttaacgacgatactagaaatataattcccagcaatagcgtcgagataatctcggaatattttactattacaaatataatccaaaagcacacagatataccgatgtagcatttcacctagaagtattccaacggtatcgtatttatttaatcccaatggaacatatgataagagagtactttgctaataatttatatcacttatatagatcgaagtctatgcagaggttaggcaatatttatgggtagagatatgtgacacaaagaagtaaccttattactctcattaaaataaagtctaagctaagtggagaaagaaaaagaaaagaatcatttttgtacttttagtatatagccattttaatatacacttgctagtatataataatgcaaccaaatttccctaactatgccttcctggtgtttcgagagactacccctgattgccgagtttcttacggcaacccatcatggccattcatcggtaatgaatacggaggagtacccataccagaaaattgtcttaatactatatacccacgtagaggaatacccgtaacgagctgtcaccatcagcagctcacctctaccaaggttgtcaggatcgggatactacatagtatcattttgtttaaagtaatatcgtatcgtagtatcaggatactatgatattttcttttttaagtttaattaatatttatattaattatatatagccattctatataaaaaagtagtaattatatatgtcatgcaaatagagacatttatcaagagaaaccacgttggttttgatatatttaactgatttttatataaatttgagcattttatttacattattttcaaaccatgttattttaaataatattttgtagtatcgtagaatcgggataccacctaaaatttcataggatcgtgtagtaatgaatattaggatcgagatactataaaaaataggatactaggtgggatcggtatcatttcggcttggtaggatcgtagtatcgtaagatactaggatacgaatcaggatactgacaaccttgacctctactgcctcgtggcatataataccaattaatgatatgtaataatttaagcaccacactgacattactaaatagtactccatatcgctgcagcagacgtagagcaatcatcgaaatgaatattaaaccacaccattgcatatctctggtaagttagccacatcattatatcgagacaagtataatataaagttggtacttagataatataaatgaagtaaaggatcgaagctatataaagaagaatatttcactaataatagtataagtcttacaaaagaaggaagagctactagagccatacctgaaatctcctgaagattcaaggaaaatattctattcctactccactagcaatagaacagataactaaacttgagagagctcttgattcttcttcttgagtgtgtgttggagtggagtgaggcctactccttaaataggttgccaatgacagttgtggcggttgaaattgtcggaaatggcccgcaaccgtcattggggagcaatcctggacatccacgtggaaggccgggatgagaggcctcggctaaggttcgaccaaacctggtccagcccctctggcctccaattttggccgaggacttccttgttaggacttattcttcgtgacatggcagttgggcttatttgcagatgttaaataagttttgtaagcccaagcatcataagtctaccagtcggcggtcattgattatttcctgctgattttcctccgtttatgtagaggtcgttgtgttcaaataaaatttcaagcacaagtggaaatagattatttctaacaaattatgcattgcaagcatagctagttctcctttattccggttatattgacagtcaaaattggtctataacgaccgtcaacaggcataggacaagtttgattctttctgggcagaaagattagttttttattcaactcaaaccttaacttactccttaattttctgttagtatgttttttaaactgttaaatgatgttaaatgatgtgtttgttgcaaaaagtttatgtatagaagttatttttaaaaataaaataatttcattttttaagtttgtaataattaatacttaattaatcatgtgctaatcatctttctcgtttcatgtttttcctccaaaatcactatgtttttcctccaaatcaaaggggcctaagtgtgtaaataaaattcgagcttgcctcgtttgagctcgttatcttaacgagccagttcggctcagattgttaacctccataggagtaaaaacttagagcgtgttctaggggatgaaaaaggagaatattaagaagaaacttaaaacgatgtgagccattaatacaagattaaataagtaccacctttgtttgttataacctccttatcttttcgtatgacgtttgaccatttgttttattaaaaattattataaatatgtaaaattatgagttaagattatagtttccgtgatggtaaacaattcacaacaaaataaatgatatttatataattttttgaaataaaatctagggtcaaacgtcacatcaaaagtcaacggcatcatacattgaaaatgagggagtattaattacttcaaacttaaaaatagattatatgacttttttaaagcaaattttctataaatatatattttttaaaaaaccatttaatagttcgggaatcgtgccagtagaaaacaagcaagttttttcactctttgtgctgcttccgaacgcagcctttgatttatgagtataatcttgggctcttgggctggttctttaagctctaatttatttatataatcttaacaatttaataatttatcaatttattatatactaacataatatttcctttgttttacactatgagacattttgagttttaaatagattcatagagggatctatgtatgtacttcatatatgtcaaaattcatatagatattagtaaatctaagacgagagatgaagaggctaaaagaagtcaccaaatataaataatcaccaaatgtgaaatagatcgagggagtaataaacataaccaaatataagtagtttggatgctactaaaagattaagcattagtgaagaagcaataagaatatgaagatatagcgatcttttgtattagcaagctagagtcgttcgtgagttaaaaggtcaacttggctcggctcattgagattactagttcgagtagatccaagtcatgagcttcaatgtcgctaattaatcgtactgctggatgttctctggttacctaaaatttaagaagttaccgagtttatctcaatagtttattggaaatagccttgccttctaatttgatgtcaggcacaaaattacctatgtaatcatccacctaatggcccacatttttgctacatttccatagctacctcttgttatatatcgtcagattacaagcgatcaatggatataatgcctctcaagcaccttagaaaatctcaatattataatttctggaccgttcaatcactttaaaattcattatcttcttattgtccctctcctcattgtccgatacccctccccccctccccctccttttccccgtcgtcatatccctcaccaccagttgtcgccttctaacctctcgctccactttgccgccattgccaacacccgtttcattgctgaccaacgatccaccacctcccacggccatcctctaccctttttttctttccttcgcccccctcccccagaccgtaaccctgatttcaaaaccttaactcgtcatgctattgttagtcgctggagctagaggagttttgagcatgatatcttcaaacaaatcaagtgattctaatctataaaaaatctccctgattttaattgaatgccatttagacctagcaggtcgtttggaaagacggagggagggagaataaggttattgttcacatacaaatctccataacaacgctagttgtcaaaaggtgaccggatatgagggttctgtcaaacatgttatgagcagtaaaaaagctgatatgctcaccctccctgatatatatcctcacccaacgatatctcagtaatcatatggaaataaaacttttcgtccttatttttgttcttaagaaacacagtacaaataaagaagcttacaacaccctatgaacacacgcgcacacctacccctatgagtatctctgaaaaactagatggatatatctttagatttaatgaagtcatcacgaatacctcgctgctaacggatactccctccgtcccataaaaaactaacatactaccggatgtgacacatcctagtctatgtccagattcatagtactagaatataccatatccggtcatagattcgttttttatgggacgaagggagtacgttgcctaccattgaaaaaataattagctataaatacgaaccacatatcaagtctagaatttaaaccggataggctgcttccattacaaagaatctaactaattgtgctatgcttacttcgtatcatccctttctatacacacatcgtccgatacatcgctcaacacactgttggtcgggtgagtaaacaaattaacgacagctaggaagatgctgaggcttgcttccttctcatgttgtatggtaaaaataaggacttggcatgtcagactcacgtcaagtgatcacagagtgtgcacacaacaagcatatcattaattctgtcactctacatacaatatatcacgttgagtggttgaggtacgactacacaccttgtctgagtactggcgtggtagtgatcccaccacctctacgagtgatcgaggtatgacaacacaactggtccgagtaccagcgtgtgttgacgagaaacacagcggcataggagatttgctttactccagtgtaggtccaaggcttgcctcgagtgtcaagagcgtgccagatggtttgatcttgcaacaacaagaaagacaaaaaaatcgtaattagatgaacgatagccgattggctgacagagccgatgacgtatcgtcagaatcccgccgatacggttaaaccaaatcggttgcggctttgagatggataaataaaacagaaccctaaatatgtcttatcgtctgtaacgctatctcttttatttttgtcaatcacttttagaaatattatagaaataaccgataatctaatatttagagccagaatagataatgtattggctattactccaatagagacttacataaacagattaatctagataaatataccaaataatgatcaatctcagatacaatgatttgatccagattgattaagacttgatatatatagagtgatctatctgtataagtggcaaatatacataaaaatagattatgagacgtgcactattatgtatattaggtaagatcgactgaaactctgatactatcattaattataattaattccaggttagtatctaagattctaaacaagactagggttgatgcaactcaaagtatgtaaagaaatctaaagtctaaacaatcaagttattaactacttttcaagatggtaaatacctaactaatctaatcttgtaaagcgattgagccgataccggcataaaccctaaagcaagaatcagccgatataactaaatcaaaatactaactagattaactaagatatatgatagtgatgaccacaataaaaagactaatacatctaaaatgacgtaatagccccgatagtgcaaactattgagacaaggtacctcttgtcgagagatcgcaaccgatacccgactcaaagcaagaactcgtcgaaaaaaataaaagaaaagggtagcgatacgccaaaagttgtattgattggattgtcgttccttattacaatgatctggggtttatatttatacccggagtacaaaattcttccattatggacacgactcaaaccttcctaaagataaaaacaaacaagtctacatgacagactcttaccatatctctaattcaaaacgacattaaaatcctaattaatagatacagttgccttaaataagctctatctctatacaacaatgatggttatctcaatcgaggcccaaaccgagcccaagttgagctatatcggctgctttccatatcggctcaatcaaactccgaatatgtttctagccgatgcacaatctgttttggcaagattcaatctccttcaaatccgcttcggtatccaactccaaatcctagtctatcttgccaaatttcactgttaacagcgtggtagcgatcccaccgctctacgagtcctctacgagtggtagaggtacgactacacacctggtccgagtaccagcgtgatagcgatctcacctcctctatgagttctttacgagtggtcaaggtacaactacacacctggattgagtactggtgtggtatcgaccccaccacctctatgagtcctctataagtggacaaggtaccactacacacctggtctgagtaccagtgtagtagcgatcccgtcgcctctattagtggtcgaggtacaactacacgtctggttcgagtaccagcgttgtagtgatcttcgagccgcctctatgagtggtcgggttgtagagggtacgactacaacctggtcctcgactagcgttgtagcgatcctcgagccgccttcacgagcggtcgagtatgactacaacctgatcctcgactagcattgtagcaatcctcgagtcgcctccatgagtggttgggtacgactacaactttgtcctcgacagcgttgtaatgattctcgacccgcctctatgagtggtcgggtacaactacgtacaccttgtccttggccagtggttgtagtgattctcccaccacatctacaagtggtcgggtatgactacactagttctcggctagtggttatagcgatcagcccaccacttctacgagtggccgagtacaactacacatatggtcctcgctcgaccagtatgtgtagcgatcctactacccccatgaattaatccatgtaagtttttatacatatcaaatgtgcaatatttgtcagagtatcatgttttctcatatcgctactggttggattcaattcttatactcgtattatgttaagtccgacaagtcatcgggttccctaaaccttggccgaggatgctcggtgctattggactagtcgggttgctaagggtcagacaaccagtgaaatgtgtagtggcttgattttttgttgtaagatagccaatgatgagtaatgttgctgattatttgtgatgcttatgaacatatttttcctgctgatttgtgttatgccattgtatctatggctacaaatagaagttattgataaggccagatacaatagtgcgttcttttaaattgatactgacagatacacacttgattaatagtgcttatttgtgatgcataagaacagatatgcctgcacttgacccttattcgatatggtcaggcaaccaaacatgtttctgtctttctgtgatttttctcagtattttatagttcaaatgatctcagcggaactgaggccacctctacacttgaactgagcagaatttatgtgagtacatgaacatatttttctacacttgtttttttgcttgctgttaggctgggtaagacagcaaatgatgatatatgctgctgtttgtgatgcatgtgaatagattttgttctacacttgttctctttttcttgctgtttcttttttcctgcgcttggtcttattttccttttcctagcttgtaccttttcttttgctacatttgatagatactggtaagaacagatacaaatgatagtagctacttcctccgtttcacagtgtaagtcattctagcatttcccacattcatattaatgttgataaatctagacatatatatctatctagattcattaacatcaatatgaatgtgggaaatgctagaatgacttatattgtgaaacggaggaagtaattcacattcttcatatatctgaggccattgttctgcatttatttacttgttggaaatgaggctcaatgatgtcaaatttctgcgcatatttgctacattttcgagttattgatgttaggaaaatactatcaagttccttgttcatcttttcatatcaacatatgtactcatttcttttagtaaccacacttgattttgacatgatcaagtttttgataagaaaccgatatactctgcacttgctctttttggtaaagatcatactactattaagtgttgatgctcttgcaccctgatctctgcaactcagatcctgtattatttcaaaggtacaggttatcctgtttacttttactatgtttcaggaaaatgtgataatggaaaaacttgtgagaccaagtgtagatatactaaggttgatgtgtttgaagcaatctgtacaaaagcttgcaagcagaacatagctgaaacagatggttttagttttgtatgcggttactaatttgcttatcaaattggttccttgttttaaaaaacttgccatgggcacgtatatttgtatgtttgttttgaattgtcaaatgtaccagtgttgtcaatgaaattatgtacatgatttttgctataataatcactctcttgcgtgttcatctagtaagccaggccattccgtaacatttgttaaaaaaaaatgatcatcagtgctgctcattggttttaaaaaatgacaatatcattaaaacgtacatacacattacatcgattctccatgagaaaaatgagctccgaagtattagtaggtgggcatacccacagagtgacacaatttaatctataacctctactacagattaactttaccacacataaatagatttagggacttagaaaaaacctcgcatcacaaactttatggggtaacctcaccacccacaagaataggtattgtcataataccacatacctaatagtagttaactaagctcggcagggcccaccatgtaacaagtcttatacgaaatcatacctcgtatatagaaggagttccggataaggaaggacaaatagagttctatattaaaactataaggactactcggattatatccatattggtctctctagttctacttgtataaggggacacctatgggtataaatagaccccctaggaggagggggaggaaacaacaacaacaacagatcgacacacaatacacacgccaagacaagccgccggttatcgacatcagagataagcctagacaaacccaatatggtgtctgtggaggccaacaagagggatctagcgctatatctgatcttgctgagtttggattcaaggaagactaccccattgtcgactacgtgatagtatttcaggcagtcaagtcgacaacggttagataggttatcccaaatattatactagtgtgattatgatgaataagagcaacaccggctttggccaataggagtattactgtcagataagggacccgaacatgtataaaaatccttgtctccatctcttttacttcaatctcgtatataccctggtaccaacgatccccatactatgcaaaataccatagttgcgatctcaaacgtcgacaggtatttgcacacaagatgtatccatccaaccaaacaacatctcctgcatgctaccgtttcatccgccccttgctgcaaccaaccaaacaacatctcatcatatccaggtttatctcatgcaagcaaccaaacacatgcatgtgtatcccctaaaccaggctaaacttagcctggatgagagagatgagccagactagagggataagagcaaccaaacacacccgtaatattgtacgtgagatagagaaagaaaagtctattgtgcgaatatgagcatgcattcttatcacaagaatgccccactctttcctttcttggcaccatgttttttctttcttggtaagtttgtacggtgaaagtttatgtccgattcagaatggaaagttttacaaaccaaaagttttgtatgtatgattctgatttggagtaaaaaaaatatgtataatgtttctctataaaaaaaattgcatgtataaattttctacgtataaatttttatgatgggataacgctcacgatagatcagaagcacgtgagctagcctgagcctttgggttcttttttatagatccgcccctataggcaaccaaacacggaattcctgtttggcgggtgatcgctgctccatccacccagcgatcaccccctgcctccttcctatactatatactcctccctcctctcctcccttcctcctctccttcttctctttctactagagtacaccacacaaaatattttaaaaaacaaaagttagaaaaatttatgtatagaaatactatataaaaaaaatttgaattcaaatttaaatttgaattgggcatgtaattttttgacttataaactttggatttataaactttaggtgtataaactttagatgtatagaaatactatatatagaaaatatttgaattcaaattttgaatataattcaaattcaaatttgaatcgggtatataaactttaggtctttaaatttaggtgtataaactttagatgtatagaaatactatatatgaaaaatatttgaattcaaattcaaatttgaatcggatatttgaattcaaattcaaattcaaatttaaatcggatataattcaaatttaaatttgaataggatatataaacttttaacttataaactttaggtctataaactttaggtgtataaactttagatgtacaaaaatactatatatataaaaaaatatttaaatttaaattcaaatttgaatcggatatataaacttttgacttataaacttttggtctctaaactttagatgtgtaaacttgagatgtataaactttagatgcataaatttactaaaatagaaaagtaatacggtaaaaaaaaggaaaccaggtggagggagggagggggaggaggggacctacccgatcgctaccaggtaggtagggcgatcgatcgcccattagaactacccaaccaaacatgtcctacgtgatttgaggccgaaggggtggcgagaatgaaattgagctttttattaaagtagatatttttgattcgttttacaattcagatgcaacagctgtatcactgacatacaatttgacttacaaagtctcttttataagatgcatcatggaaagaaaatagcgcatttgggaccgtatggagtatgatgcaatatatatgcttgtttgtccaagcattcgggaccaattgaccagatcaagtctttatgtacttcagctgcatagtccaattataacacatgttttattaagggactttctagacaaaggtcagtttttttttgaagtccctcaagctgcgcgtgcgcagcaactactcttactcaaatacttggttctctagggtccaatcttctattgattttttttcattcatttcagcgcttgtagcggtaatccttcggataatcttgaagagcctttatatatagtatatatatattcactctgtcctaaaatataaaatataagtacttttagactctaacgcggtctccgaaatactactttgaccaataatatctataaaaataaataaaataagttatatattacgatagtttatttaacgataaatctagtaacatcaatttcacataattgattattttctttttgctattaatagttaaagttgaaaatgtttgaacttgtcactatgctaaaaatgtttatatttcgtaacggagggattaaaaaaaaacaacggacggaaggttctcgttgtctaatcatgtgccgcgtagtaacacatatatagtcactcactgacatctctaaaattcagccctcgaatcatatggaaacatatggaaaccacatgactttccatcgttgtctgctcaacacaccgttggttgggagagtataatacgtacgactcctgagactttgcttccgacctgctacgcgataacaccaaaaacaattactttgggctcgtttggtttggagttaatttttgccctatcaaaatcttgttagtgtcaaaatattgacaaatattgacactaccaaattaagtagtattcaatttaaattattatgagtaaaatttgatagcaaaccaaacatgctactattgaaattagtaaaattttggtatggtaataatttagaatcaaaccaaacaggcccttcatttccatgtcgagtctcatgctcacttaacccacaagtgaagtagatcccaaaatattactaggagaaaatttaacccatcgtagaataacgaatatggatagacctctgtctagattcatggttctaggatagattaaatctcatcataaattgtaaaattttgggatgaacaaaataactacatagccgaaagttcaactgatagaaaactaatataattgcaataaaaccgagcaatcaaatgggtagggagtagggatggacagaaaggtcatgacttttgttagctcgctcagtttagctcgactcgtttcattttcttaaagagctaagctgacatttaagctcggtatagacaacgagccagctcagctcgtgagtcttaatgagctagggtagacaacacctcagcatgccacaggtgggttgtttctgcttctgggctgtcggcccaaacaaagagtaacaaaacacgctcaacccaagccactaggcaccagcgccgctcgtcgcccgctcattacgctggcaatgccgctcacgaattttttttattaaaagttttacaaaaaataattttctattttaaaaattaataaaagtggtcgcccgccgccctctggatcgcccttccagagggcggcaaatgtgacatggcagacggccatcgccctttgcaggcggcccccttaccgccctccgcaagggcgattttacactatgcggggggccgcctgcaaataggcggcgagggggcctggaattttgcaggcggccctcttgccgtcctggggaagggcgattttacactgtgcattggatatttttataattattaataggtatacaatcttttatattgaaaactcaatacaagattttagtctccaagattggtgaaatctgtagcgcccgttccgtcgtggcgcctagctggaaaattatctcttaaaaaccctaattgcgaaattgtttccttgcttgttgtttagtgtctgtgccatctcagatctcaaatccccgatctatcgtcgagttcaatcccgaatccaaatacttccaaatcaaatccctccgcaaaagtctattttgcctccccggggtcgatgggccgaatttctctcggcccatct

SEQ ID NO: 69204 - DNA, 6844 bp, Oryza sativa
ctgtgttgaatatcatattagagtaagtattgtaaagtaactgaaagaagaacgaaagaagaatgtgctcaatagtccatacatcagatgctctaacatcctagaagaatcaaacttctgcatttaaatgtagcttaataacatcagcacaaggaaatgctagggactagaaagagcaaactaaggtaattcaaatctatagttatcataagcacaagcgttaattcttagtatggagtttattttatgttaggcataaaattaagacttcattcaacctaactcacaaataactgaatttacgctacatttatccctgctgaccaaagggtccctctaacatgccagatcttgtcatctttggactttataactggctgaatggacaaaaagatatttgaaagcaagaacgaaaacaactaaccaaattaccttttcattgacatcatgaaactgtggatcaatgtcatatacctgaaacctgtaaagaaagttagctgttaaaagaatagcataattaatgggtaccatgtgacaattttacagtaaattgtaacagacgcttacacaattggttgaagaacctcaaactggtagtgcacgttgattcttgcattccaagatgggttcaaagaattcaatattacttcagtacgcccaagttcttcaagtgctccttctttgcttttagaatatacaatgaccatgggattgctctgagaaaagatgataaaatattaagggaagtataactagatagcacaagcagaattcattaaatattcaggatggcatgcatgtcaaaagaaaggtgactgcaactatttctgcacaaatattcaccgaggcttccatgataatggcatgggcgctctggtttgtaaacagatcaatttgtaatttgcagttatatggactatgtcttttggatatggatggatatttactgatatcacgtattcacgttaaatttggttgggtgtgaattatgattggatataggcacgtagcatggacttccaaaatattcatctgtaggttttacaaaatagtctccggacggtaggagccaccagcatgaaacttataacaggtaacttagaaggcagctcaggcagccaacaaactagtatatgcaactgttcaagctcaagtatgatcattgccaacaattcactgggtaagtcttagtttgccaaaataccaccatggtatgacaatgtcaattgccacaggtttgtgtgtttgggagacaggaactgaacggaggcagtagtggagtagcaggttcaaaggaggacaagggtgacaccctcatctccccagcaccatggaaagctaaggggtaaggtattcagggatagcatgcctataaaaatatgtcaagttgtcaacacaccaatgaaggtggaaaatgggatgagaagtgagtagtccagtatggacagacatggtagcatgttgacaactgatgtggctttctgacagaattgcagtttttttttacaagtattgctctttaacatggtagctctcagctatttggaattcgaatttgagtttgtggttccttgatagaagtgaaaataaagttatgggtttgcaaaatctattcacaataatttctctaaaaatctaatgattcttaactaatcaaaaacagagatgtcatgcaatagtaatgctcatcgtagatacctaacagaccagaataccgatcagttataaactgaaataagaaaatagcaaaactaacaaaatgcaacaagtgaaaacctggagcataccttggtaaagaattcttggtcgcccaaatttgatgcagagagagataactgtttcaacaggttatacagagttcttgtcaaaataaaacacaattaaacacaccctcatcagttcggtaattgcatttctatcagtaaatccaaacaagacataaatttatacaatgcacatgcatcataatagtcatcacatgaagcaacatcacagtattaaatatttgaagtttttggattaactaccaggtcaggtagtatgaaatgacagaaatacttagccacacaacttgcagactcccaagcgttcaggcacaaaatcttactaataaaccacaaatacagtaaatcatcttttacgcaacgttatcaattagaagaacatcagcagccaactgctgcagccgtcagaacatcagaatgttcagtgccgtgtcaaaccaagagcacacggcatgctcagatttcacgcccgctcccaatcatcgtcgtgtaatggttttttatcccgatcaacacgaaatccctcgggttttttctcctttttttttgtttgtttgtttgcaaggctgagaacaggtagcggagtaaattagctgaggcacagaccacacgcatccgctagtcccgtcgctgcaaggcgcaaaccacgagactcacgcagaacggcgcgaaactggagaaccgccagcgacgcacgcaaccgaagcgcacccggcgcaatggcacggccacccacgcgcgctcgctcgcgagcacctggcggcgcgctactactactactactgctatggtgtgaagcagaattaaaccgcatggatggggcgtgaggcggtgtgtgcgttgtgtgtgggttttccgcacctcgacctgcgtggacgcgccggcgccgcgggagcggaggaagcggtcggccgcggcggacgcggcctccgccgccgccgcagccgcggccgccgcggggccgacggagtggcggcccgcgtggccgccgccgccgcccatctcgtcggagcagcagttccccatggctagtggctctcctcgccgtcgagcaggagggggaggaggcgagcgagatctaccgccgacgcatcgatctggaggtgggaggaagagggagagcgagagcgagaggagagcaagtggagtcgtggagacgacacggagactttggacccctcaaacactaggcgaggccgagacgcacgggaggggaagggacggcacggcacagcgaaacggggcggaatttacggctttgtccctgttccgccggggggggagtggggcccggcgtccacgttcaaggagagaagtttgactttggttttgactggcccggggagttgggacttcggacttgggaggactggttcctcgtggcaattagggatggcaatttcccccgcggggccgggtcccctgcggggacccacccctacgggggcgggggcggggccaattttcgacccgcgggtgcgtcggggacggggccccgcatttgggcggggaggggacgggggactgatttcacccgcgggcccccggggagtacatataaatctcaaaatatagatcaaagaaagcccaaaaagcccagcccactaaaaaaatccttaaccctagcagcactgcagcacagcagcagtgcagcacatccctcagtctctctcctccccacatccattcccctcccctcccgtcatccactcatcccgtgcggtgcggctgtggcgtcgcctctggatctcgccctctcggcgtcgccggcgcctgccagccgccaggccaccatctcctctcccctcctctccagtctcccatccggcgtccggcggctcgagctcgtcctctccctccggagtcagcggcggcggcacacagggcggcgccgcggcgggccggcggcggcgcacaggcgcggcggggaagcgacaccggcagcaagggcgcggccggcggcgcacagggcgcggctggcggcgaggttgcagcacatcacaaagagtgagaggtattgctccatctccaatactccaaatgtgccttgtgatttgtgaatgaaattatgaaacagaagattgtgatctatttcagtgtatatttcagtgtatatttggtagatttggtagtacatagcacatagcagcagattgtgatctattattgaattatgttatttgtggacagaatgtcgaaccctgctgccaccgttgagtcacaagttgcattgacaccatcttccacttccactcccactccaaccaatgctccaagcgtcgaaataaatgattcacaaggtacagaagtagaacatgataataagagactgaaatctgcagcatggcaagattttgttaagaagaaaataaatggtgcgtggaaagctgaatgcaaatggtgtcacaacaagcttggagctgaaagtagaaatgggactaaacatttgttagaccatattaaaacttgcaagtctaggcatgctagaaaaggtctaacacaatccaatttgaagatgggaatagatgcagaagggagggttaccgtagggaaatatgtctttgatcaagaggttgctaggaaagaacttgcactgatgatatgcctccatgagtacccactttctattgtagaccatgttggttttcgtaggttttgtggtgcattgcaacctttgttcaaggttatgaccagaaacacaattaggaaggatattattgacttgtttggggttaacaagatttctatcagtaattattttcacaagcttcagagccgtgtggccattactactgatttatggacagcaactcatcaaaagaaaggatacatggcaatcaccgctcacttcatcgatgatgaatggaaattgaagagttttcttttgaggtatattgaatatgtgctgcacattatgctatatcatgcttcttacatttgtttaactctatactaatgttctcttgtggtgttttatgttttgtaggtttatttatgtaccagcacctcataccgctgatcttataagtgaaattatttatgaggttcttgctgattggaacttggagagtaggctgtctactatcacacttgacaactgcagcaccaatgacaagttaatggagaacctattggggacaatgctagataagttgcctgctgatactcttatgttaaatggttcattgctgcatatgcgttgttgtgcacatattttgaatttgattgtgaaagatggaatgactatcctagataaaatcattgagaaggttcgtgagagtgtttcattttggacagcaacaccaaagagacatgagaaatttgaaaaacaggcccaacaaataaatgttaagtatgagaaagtaattgcccttgattgcaaaactagatggaattctacttatctcatgcttagcactgcagttttgtatcaagatgtctttacaaaacttggaactcgtgaaaaaatgtatactccttattgtccatcaaatgatgattggaagtttgctagggagctttgtgatagattgaagattttttatgatgcaacagaggctttttctggtagtaagtattgtactgcaaatcttttctttcctaaggcttgtggtatttatttggatatgagaaaatggtcaactagtgttgatccaaacattataacaatgactaaattgatgtcagccaaatatgagaagtattggaaggatgtgcatggtattttggctattgctagtgttttggatcctagatataaacttcatatgttgaatgctatgtttatacaaatctatggagaagaggtggcactaagaaaagttaatgctgtgaaagaagacttgtataagttagtgctacaataccaaaatcatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttggaagagaaaccgttgcctaggacacaagattttgatattatcaattggtggaagtttgggggcattaggtacccaactttgagacagattgcccgggacattttggcaatccctattacaacagtagcatctgaatcagcatttagtactggtgggagggtgataactccaaatcgtaatcagcttaaacctgatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataacatacaatgcttagttgcttcctctaattttgatttcaggaagcatctactgtcactgaagcttgaggtggagatttcataagtgaaggattgggctagaaagcctgcattgcaaactatctacctatatattttattatgttggcaatgtaatagtatattaagacttctatatttctgtgagactgaatttgcttgctgagttgctgtgtgtgatgtgttgaacaattcaactgttgaactttgaaggcttgattcgcttgaacagttgaactcatgtgtgttagtgtgtaactgtgtgaaatgatggatatcatcaatgtgttcttgctgaatttttatgatgaaattgaagtattcatgctatttttgatggtgtgttaattatgtacaatatttcttttgatgaaatgatgattgtgttgtattttttgagctgattggatggagatgctacccaatgcggggccccggtcgggttgcggggccccgcaggggtcgggggcgggggatgttttcaacccgcatcactggtcggggccgggggcggggggtgaagtcgggggtcggggtcgggggcttt

SEQ ID NO: 69205 - DNA, 1590 bp, Oryza sativa
ccgttttgtattgagctatataaaaggagaacttttacggtacaatatactatagaagggcatgttagaaattttatagaaaataaaacaacactttagtaattttttgttcaaattaaatctaattgggagtacctcgtcctaaatcttatcatacactagggaaggaacattctaagcgccatttgatgacaaaacacgtgacgatagcatgatctgataatagaataatgaagaaaagacaaaattaccctttcaaacattataatgcaatctaattaactaaaaaatcaaatcaatctacactattagatcatatatacttgtagtatattgtaccgtaaaaatacagtataaaagagccagagagatgtccttgaaaaagaaatagaacaacaatcatcttctctctacattctctattgccatcgtgctgcgttgccataagatccaagctgaccgtggtgctcgtcgtgcaacgaccatcttcatgagcagtgtcttcaaaccttcgctgcatatgcacctgcatggaggcggtgtaaaggtttctgacaacgtatataatatgcggccgctcgacgtcttcaacgactcgatcgctgtcctgttatcgctgcgagcacggaggcacaacatcgatcgtcttcatcttccctgactcgttggtgtagatcaagtgactgcactgctttgcctcactgatcttcatcgatctattcagtgactgcataagttaaacccttttgattaatctcagagtccaaagagaccggtgtatttctaatctagatttgtgtgcacggcactgttaatctagattcaaatattgtggcaagattcgggggtggatccaggaaaaaataatagtggggactgaacaaactagggcagtataaattgaaacatgtcttatatataaattggctacatgtctagttcaaagcacacatacaccaaattaatgatatatagtgaattttatccataccaaaccaatgtccaatagatgacgtgtgtcgcccaatcgcctattattcttcatgactagtaatctatacaaagaaaatagcaaattaatgaataaacaaaacatacttattttgaattcaaatagtttagaaactaagaagataatggaggcatggagcataccactcatttttgttgaggcaataacgtccgacgccttttcatctcttcaaagtgttggatgattttttcatcactaatacttctaaaaatctgcttctcagtgtaacaaatcatctagtcatttagtcattcatcccccattttgtttcgcaaatctttttgtaagacacatagctgaaaagaccctctcaaccgaagccattgccaccggaagtatcaatgataactcaatgagcctatacaccaagtgataagttctgttctttccaatctgaaccattaattcagcaacctttgcaagatctttacatccaagaaattctttagttctcctaacattgctaataaaatttctaagttgagtccgtagtagcataagatcaccaaccaaaaaatcttcaacataaatttcagcaagcttcaacataaatttca

SEQ ID NO: 69206 - DNA, 1669 bp, Oryza sativa
ctttggctcataattttacactacaaacaattaaaaatggttcttttcacttctttaaaaagaacttctttatcactatttacctaggttgggcgtaactaagtctagtatttaagcaaacaatcataaaaaaataaaaaatgttttcaaacttagataaatgtgacatctatagttgtaaaatgttacaacttaaagtatactatcttatatgaggagagaaaaagaaagataaatattattaggaagtcgagtggaccattttcaatagttgagggtaaaataagccaaaaatggtttaaggggttaagcatttttaatggtctggtgtaaaataagctaaaaatgatttaaggggttaagtaatgcaatgaaataattttggggaatgaaaatgaccaatctttaattcaagcagatattagaccgacgtagatgctaaatttacgatttgctacatcaaatttgaattaattttgttgaagaaaagaaaggctaaacagaaaaaggaggctaagcatatgcacatgttacctttataaatagcctcctgccttcctggaattaacaaccacgcccttggcacatttttccttcaccccctcgcatcatcaggaatagcaaatcagcccccgcctctcttcccgcctaagcttttgacgccgccacgatggcttccacgtcaggcacagcaaaagaccagccggtccatggccgcgccacccaacgtcgcgagtccacctccacctccaccgctgcagccgagggcggcgccgtcgcctcgcagccgccgcgcccgcctcagccccggcccggcaccacccgcccgccattatggcgtccgccgcgttggccatggggctccagctccagcgccgccaccgccgcggcacccggtggtgcttcgaccgccgctgcagcccagggcggcggctccgctgcctctcgcccgccgcgaccgccgcgcccgcctctgccgccgcggccaccgcgcccgcccctgccgcctcttcgagagcccggagagggaggaggccgcggcgacggccggggcgccaccggcaccggatcgagctccgccgctgcagcggtcgaccggaaggggaagaagaaggtcgacgaaggtgatcgggatccggaacaggtgaatggctcctaccacctcgcattcctgtgccatcatcgcgttttgggggtggatttcgatcctgttcttgagcgtttcttggtttggttttcccttgaaggcgctaaggaagtctggtccccttgaagggaagttactccagagcagcattcgtgcgtatcaagggccccccgccgccgagaaaccatccggcgcgccgccggcagcaacaccccccgcccgcaacaccggccgtctggggctctccgaccgtgaggcagatgatgccttgaacgatatcgacctggcgatggtgcgtatgccatcgattattctgggcatcttgggagctttgttgttctaattgttcttgagcatttcttggttggtttctctggagtaggccaggcagctacctgttgttgataccactgttcagaaggaggaggaagagaaggagaaagagaaggagaaggaggaggaggaggatgatgacgacgatgaggagggggagctgctgtcgcacgtttccaggagaaagaa

SEQ ID NO: 69207 - DNA, 7754 bp, Oryza sativa
acgccggtgtggcgaacaatgcttcagatccgatagtggccagagacgattgtagattaccattaagtaatttgagtacagttgaggtactaccaggtagtagtatttggatttgtaatatggatgcttatgttcagctgaagcatcaacaattgcaacttgctacttctgaatatcaccatgagtttgtcctgattagtgtctgtttcggatgaaggtgtccgaatctttgtgtagaaaatagaagggaaattctataaaaaataggaaaatgtgttgtttaattttggtttcatatagtcatccgaatttttaataggattattcttgcatcagagtgagttagtgtcccaatgttaacctctacttatgtaattcgtgagtttctctgcaaatcttgagcatgggtcaaaatgattgcaatatatttgatgtatgtaattttttgtatcaataatttcattaggaagcagcaaattcatggttgccagtaatggctgtcatttgtagatcttttgaacaaagctgaagccatatccagaattaaccaatggatacaatgcattaggagaaggtttgttttttttttttggcggatcatggatagttgaatcctctatgttgagagtatgacattatttatacttaacaggatagtttgctactttgcttgatatgccattattctttatttcctatgccccttcccttccagagcataaatggtcttttagttcgaatctactaagcatcttctgctattgtcttttagtgtttctgcaattggtttattacttataaaatcatggtgttaaccacctaattttgtttacataatttctctcatgcataatccttttcagggcaatctacagcatgaacacactggtagcagttgtacgtacatacctaaacagtttaaaaatagggaaaaattttccaaaaataaagtttaagcccgaccgtggggatcgaacccacgaccacgtggttaaaagccacgcgctctaccactgagctaggtcggcttctgaccatttttgcaaaaaccaagaataaatacatattttcaaacaggagaaacgagcacaccgtagccctgaaacagaagtaacctggttttcctctattcctttgttggttaccgttcatctattcaactataaaaatccatttttcaaatatgcacgtaatttcggtaaaggctgtgaaaatatcaaggtgccctcactagctcattttttcttagggctttcacaatgtgtataggtgtcatttagtctcagtctcctacatcaaagatttcacgccacatatgcttctctgaccaagtgaagaacggggagccaaaataggtcgtgagtttctcgtcagggatttctcagggaagggagaggaacggcgcttgcgcggtgatcgttccaagctgcattgtcgcctccaacatagtgcgggagatttgctgggggaaggagatgattgaggaaagtgattttcgtggtggggctggcttgagaaaaaaaaattggtggtgggcccacctaaagccatgcgtgcaccagggagatgggagcttcatttgttttgggagtacctatacatctttcgaaagatttttataatcatatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaattcgagtgagaaaatcgagtgagagataagaaaaaatctttcgagtgagatatagcaaaatcgtttgttttttcctacctggagagttgggcttcttgttgaggcccggacgtgctgctattacccttagggcatagacaatgtatagagatcaggttacatacatacatacatacatacatacatatatacatacatacatatatatatatatatatatacatataggcaaagcagacgataaggttgttcccataagaaaaaaaattctctactcctcaatttccctatctctactccacatccaatccgtagtttgtgtgaaatggcgaaatcctatcccgccgggttcaaatccatatgagtggacagccatccatagaagcgtgagcggtgaggcgggcagacaactagctagcgatgagagcagtgttggaagtgaagctggggtgtttgccacgaccggaaataacccaatcaggctttccaatcatgcataaatcctcgtattgggagacaaggtacacaataagttgataaatatcaaagtacataagcgaaagcatattgtatttattacatgggcgaccaaaggtccaatacccaaggagaaacgataaaccatggaagactacgaaaaaaaaaccacatgcacttgatggtaggcccgagctcgtgtgagagggtgaggggcaacgacgatggtcgaaaagggatgagggacgtccgagcaccaatttataggggtcagacctatagctactgcttgtcagcgcctctgctagcgccgaccgttgggatcaaacccatgaccacatggttaaaatccacacgctctacgcctaccgctgagctataggtccgcttttgccaaaaaaatgatagattggttcttttcaaaaacttatttcagactagactatgcaaaatgatagagatacaattttgtattcttatctcttgtcggttttccttgattctctcatgattatgtttttataagtcagttgtagagataaggatgtacgtgcctatatgtactcgtggtccatgattaatcaaattatcgtgttgactcaattaccctttcacagaagaaaaacatcaacaaaaaataggccaaagctcagcactaggcctattggcactaaggtctaatggctcaacggcaatcgaattggcgccaacccctactaatgtggcctgggcaccgatcccctcgccaacgtggcaatgtctcaacgccaatcacccgattggcgctgagctcccaacctcagcactaggcccgttggtgctaaggtaggggacttgatagcccctccctccttatatccatccatctctcactcatttttttagcaaccaaacaagggtttccgaggagcctaggtgatttcaaaagtgagtttacttcttcccctgcaattatctaaaatatagtgtttgatctatctattctaggttggaacttgtattgccacctcatgccttccatagattagagtttatggttagggtttgagtagttccaatctatttgagttttattgtccgttgtttatgttttatggagtggggaattgtgtttggacctacttggtatcatttgtttgaagtgtagatgtggatattagtgtggtaatggtagggtttagtacataatggagaaggaacgaatgttgggttatttttgggtatggtcctaatatttaggagcggaaatggttaggacattactaatacttggaagatgaagtaatgtttgtcaactacattatagttctacagtaatattttgtaggcatattgaataaaagtgttgatttattaaattacatcaaaattgctaatcaatgagtagttcatttgtctatgatttgttgtttacaatggacattacgggctatgtccctccgttgggggttccggactttatgaattatccaagtcctcatcaataaccaccgttgggggttccggactttatgaattatccaaggttgagaattgagggtgcaatttacgggtggataaaatttgtgatgttcaaaacagatggcacagacggcaggagctccaatactatgtttataagcattaggagtttcactttgtctttcaatcacaaaagttatgacacttgtatttggtccaagacatcaacaaaacaatcattctgtcaatctaaagctactggttctcctgccaactgattggtcaaattttggcccatctatgtccactggtacagtaattagaacagacaattggtattgtaaatcagctaagcagccaaccgtgatgagagcttatgctagttctgacgtgaatgattattaccctagtgatctaaggcttcgttcgttcctgatcgatccaagggattgagagagaaaagtatctcgttttccacacgcacgcttcccaaactattaaacggtgtgtttttttaaaaaaaattatataggaaagttgctttaaaaaatcatattaatccatttttaaagtttaaagtagttaatactcaattaatcatgtgctaatggctcacctcgttttgcgtatcttcccaatctccccaattcccttctcctcaaacacaccctaacttaacaataaatggattaaatatgaacatgggtattcatcgactgtacagtggttattggtttggttttctctaatatctcaattagaattgctaaaaatagattaagatgatatttgctactttccgtctgttaagatgatatttgctacttttcgtctagatatttactgcatagaggaatgccaggttagcatagcgcaagcactatatatatatatatatacacacaaaaaaaaagattcataataactgaccaagacttcatcacagctctgtgcaaatatcaatatttactggatggttgctcatggttgataaggtatgtatgatcgtgtgattttttcctcatgagtcatgcgaatgagaggataaagctcatgaatctgaagaaaaacctgtacatcaatcttatgaaacatttttttttgaaaataactgtttttcacaaattcctttggctcagattttctgaaccttcaagcttctcttttccctcaccaaaatcgtagaaggagatcgttccattactcaattactcatattgatatcgttcagttactcatatttgcttactcatcaagttagcttgttaccactgaaataacagcactctaatatacaggtgacagttagtgaaatctaaataccgtaggcgtaatttcactgattaatggttatggtttgaaattgcatccaagcgcaggctgcaatgttcattggagaagcccaactggtcattgaactgcccgtacgtgctccacgtttactggtctaacagtttaaccgctagctcgacaggttctaaggctgcgttcggaaagtccacctgtccgcatggaaaacggtattttctattagcgcacgattaataaagtatttgccaaaaaaaacttgaaaaatgagttcatatgatttttaaaagtaactttcatatataaagtttttctaaaaattacaccatctagcaatttgggaaacgtacgcgcgaaaaacaagtagaagttgaaaaagttgggggaaagaacacagtctaaatgtacgactgtggtcagtttttttttttcaaaaggacattgctccttggccatgtgtcaaagaaaaaagctcacatgggccaacaaggcaatgggtttggtgggtcgaaagtgtgtgctaccagcaaagctgtgacaaacaacattcttgcatgagcgtaagctgttgacaaaggatagggacggttttagaacaggtacaataagactgacttagcaggcggtagattgatctacattagcctaatcctaggtggaagagtgagaaaaggagagagaatagaacgggcgcttcatctgtagccggacgatagcagtagaaacgaagctttccgcccgcttaacgctagtatggttgatacttcacgttattttgtcggcccctgcggtgtttccttgatctggcgtgctcgcttttccatcgttctttccgtgttcaaaactatatactacctttgtcttacaatataataacttttgactatgtatctgaacatatatttaactaatatagcaagaatttgttatattttgggacggatggagtaaatattaagtttttaagctatagaaattatcccataactctaaaataccaaattaaatagtaatttcaaacgaaccgcccagttttctcgccatttgatggttaacattgaacctttcaaatatgtatctatctgtaaatactaaatactatatatcaattggctagtttccattctaattacccggttggaagactacagccaacatatttaagctcagtttgaatcagatttctgtttggctgctaccttgttttccattagcacgtttctcaaaaatgctaaataatactccctccgtcctagaatataagaagtcttagggttagacacggttattaagaaaataggtagaagtgagtggtggagggttgtgattggatgagtagtggaagtagttgagaaaagtgaatggtaggttgtgattggttggaaagagaatgttggtggagaagttgttatattttgggacaaatcctgaggagggacggaggaagtattgtttttcaaaaaagtatatatagaaatttctttaaaaaatcaaataaatttatttttcaaatttataatagttaatatttaattaatcttgtgttaatgactttctacgttttatgtgccatcaattcttgtgttaatgacttgctgcgttttatgtgccatcaaaaagctgcagttaattaacaacctattcgaactaagcctacttgctaacaattcaaattattcagaagtgatacgatttttcttatttaattcaatacatatcaatagaaatactttatcttaaatgaaccgaccctaataaagtacattctcttaactttttaatattttcttgacatgcacttcaattaattccctaatctgctgttattccataagtgtggggatcgtggaagcatgcgcatacgttcgaataaccaccaacccttatttacccttatcggcatagtaatcacaattccaaactagaaacagggagtacgtgaatcctgccgaggcatgtcacctactcgataacgataactcagagtacaaaacctattttacatctcaataattcacatgtctaaattaacatgcaaaatgtgaccacaatttaacatcaccatgttctagtcatctctacatgcaaaatgtgaccacaatttaacatcaccatgttctagtcatctctacttgcaacgcaatgatgctgtggtaaaacaattgctatttattgtgtgtacagctccatccctcttagagcatgttcaatagtatcactggctaccgacgatatccatatccacatcagctaacagttaatatggagagcaaattatccagtacatcacagcccccaagaagcatttctttttttctgtgggatccaactgacaagcatctttcatagtattcatctcactgtgtgtggacccatgaccatttttaaaagttaaaaatttctaccttgctggctttttcaccttggagctcacgtagagctggcgacaaaatagtcgcccgttcctatcacctttcttcttctctgttctccagttcattagttttgctgagatggttgtactatcaccggttattgtactcgctcttacactgcataaggacaaactgatgaaaataatatgcttgtagacattgatcatttcattaatttcagtgcctaatgttagccgcataatatgtgtgcca

SEQ ID NO: 69208 - DNA, 2415 bp, Oryza sativa
attcctgcagccccttttgcagcaacttgtgattcttttgcatcatacatatgctgtacattctttctttcttgtgtttgtgcccatgggtggatcaattgtaatagttgtgcagttttctgaaactgtgacaaggagaagagaaacatgtgttgtaccggcgtttgagtccgtgatgtgtcctgtgatcatatgatcatgaattattcttctgaaacttgtgattaagttctcttaagagcctttgctgcagaaatttttttcccttgtagataaagaacactatattggaatcctgattagtttcgttgttctaataaacttatccacatcattcttgtccatatattgaatatttacctggacttgtctggttgggagaggataggatagaataattatcattcactgtttgattgcatttataaaacatcccatttttaaaaaagttgcaatgattgtatagatcgtatatgattaagtcatatatgatcgcattggctatgttctttgccctgggttcccaacccccctctctctcgttttccgcgctaaacggtgtggttttttaaaaaaagtttctagacgaaagttgctttaaaaaatcaaattaatctattttaagaaaaaattagctaaaacttaattaatcacgtgttaatggactgcttcgttttccgtgcggaggagatgggttcctaacccccattagcgaacacaccagtgaatgatgacgtggatgatgttttgtcacaaaaatcggctgcaaagagcaaagaactggaactcgtagatcacaactagcctcggtctcgtctagttgcccatcgtattatttatcaaaattgtataataattcgccattcacattaatgtatataaatttgattttaatacgattttgaagtattttagagtaatctattgtttatatacgtttgtatgtacactaatgtaatataaaaggcacgatttggaaaatgggtgaataaatagcacgaatttaaaactgagtcattcaatatatgggtaaaaaatacccatctctaaaatatatatatggatatccaagttagctaataactcagttagcaaactaatttcctgacgacattgcgggtagggggatttggtttgtttgccgatgggggtgccagatccactccgacaccgccggggatgatatgggatggtacgagtagaggtgaaaacggagcggatttggatggatagtagttataccatatcctaaaccatatttttttaatcggattcggagcagttgcggatagtgtgtggatgtggagcggattgttttcggatgtcggaaatggtgcagaatcggttcggacacggattaaatttatcgaatgttacgtgtatatgcaatcaatacaacatcgagttagcaatgcaatggacaataatacaataaccaataaatgacccatcgtaataattatatgcttaagtactaaacaacataaatacatgatgtccataatataaaaatacagctacgcaagtataacatgagacggtgaaaatctcagactaagaaatttaggttaattgatgaattagaccgttggatgaaccaacttatgttatatgtaatagatacagtggttacatgtgttgataattttggattatctagctaacggtctatcagataatccgcatccgcatgctttcagagataccatatccgcatccgctccatatccgccggatttctaaaagcctataccatatcctcgtttcggatggatttggagcggatcggatcggatattatccgatccgttttcacccctgggtacgagaaatagtgcgttcatgaattagatcgtaaaaaaggtgagacatatgtctggtccattaatttttatcagtcctactcaatactataaaaagatcaatcgattaaattaattttgtattgaaaacaaacttcatattaagcaatccttcttgacctagcgcactatgatatcctggcccaattaaaatgagacatgtgtaatccacgagagttgtttgtgcatgcttagtaccaccttactagtttagcaagggtggaaccagcttataaggcctcttgcctccaacggtatcactctcgggttaacccttttacatgaagcgatgatgtaagtataagtgaagtggtatatgtaagtgggcccgtttgtcggttaggctgggctgcgcagttctagagggacgactgttacacatataactaacacatggtattttctaaagcttactaattttaaaataaaaaatacttcagatttttatagattttggtatgaaaaacaccattgttacacatataactaacacatggtattttctaaagattactcattttaaaataaaaatacttcaaattttatagaattt

SEQ ID NO: 69209 - DNA, 5369 bp, Oryza sativa
attcctgcagccctaaatatatgattgcaacataagctatattttattatgtgaatatatacaaatggcatatttatctatactggtttattaaaaaaataaaaatcatatattgttatgtttgttaggagctcgagcttgactggacaaagctcgcaagctttggtatacgctcgggctcgactcgtctggaactccagtcgaggttgaaactagcctaggacgaatcgagctcaagcagcctgtgagtctctagcttttctgatagccctagtccatgtaagttactttatgggtaggcggcacaatactatagtatacgataccaaagatgtctcgggcatgacccatggttataaattatctgaaagaaaggttccaatgaaagagaatttatgattgactcatatgctatgggtacccttcgtgtttgctacttaggctggttataaaaataatactattagatagctgtttgagagaagataattcattttggaccgactaaagtaaagggataagaacacaagtatgagcaataaaatgctatggccatgcataatgccttaaaaaagaaagagtaaaatgcatgaatgaccatttaacttgtttagatttatcatgcaggtcattctacttttagaatacacatttagatcactattttaagttaagctaactattcatatgtcatctatgattggaaaaatgcttttggacttggcaatatacaaaattagaagaactaaatcatatcacttgggcatgttttaatgagttctcttagttcttagtcctctctctcacttaccatcaatcccgccaacggtagcggccgataggctgaatataaacagcgatggaaacaaaatcttaggaggcaccgactaaagatgtccaggtgcaaatttttacaattcaaggtggcatgctatgcgtaccaggtgtgctcatatggatagttagatgattaaatgacacacttaactcatgttagtgattaagatgtacattttaaaagtagagcaatatatatgacacatccaaacaagttgaatggctctccatgtattttactaaaaggaaaattcaagaggtttagggccaacacaaatattacatcaatacaagtcacaatatgaatgaatttctctcgaataattgattttcttttacacttaataagtatggttaaataacatgaaagaatgttattccatgcaagtgaaaagagaatgttttcataaaggagggtttcatttgaaaagattaggctgatatagtaatataaatgctaaatcaactaggattttgccacatcggatttaaattacttttattgaagaaatgaggaaaaactaaactgaaaagaaagaaagaaaaataaaaaccccgtctgctggactccataggtagcaactgcctacgaatgctacatttataaataccctcctgcctttccagaattgacaaccacacccttgaaatatttctcctccgccccctcgcgtcagcggaattagcaattcagcccctgccactcatcccgcctaagtttttccccccgcccgccacgatggcgtccgcgtccgacccagcagaagtagagctccatgggcagcgcgagccccacgcctcgagctcctccaccgatgcttcgatccccgcgccgacctccgccgccgccgccgccgccgatgtccctccgcctccgtcgtcgtcgtcgtctccgccgccgccgcctccctcgtccgtcgagggccgcaccaagcagcccggaggcggaggccgcggggccgacgccgcgtcgagcacctccgccgcggcggcggtcgagcagaaggggaagaagaagatatcggcctcggatgatcgggagcaggtgaggattcctaaatcttttgcgttcttgctgtcattgcgtttgtgcctggcatcttggggttttggtggggttttttcttttttttgttcttgagcatttcttggttttgccctgaaggcggaaggggatgaggaggagaggaaatctgattcccagaagaagaagctagccgggaggaggaggaggaggagattaaatcttgctgcgtatcaaggcgacgccaagaaaccatctgatgatgtcaacctggtaatgatgctgcgtattttggcatcttggagttttggggggcttttgttcttgagcgtttcttggtttctatggtgtaggccaggaggcccgggaagctaccttgggatgatcccagagtttggaaaccgcatgtgacgcccgtttccacggtaaagaagtcactcgggattagcatccttgtctatatcagcaacaaggtaaggagaagtttctgtttctgttcttggctgggctgagcattcttgcgccaaaattttgtgccctgtttgtgggattggttcctgccgttcttgtgaggaaccatggaaaatcttgcatccttgcttaggtgccaatttgcttgttggaaatgttgaactgggatctttgccctcgtgtttctgtttattcgtgtgaaatcttggatgatttagtgcaattgagcgaagatgtcttagctgaaattatgatgcactctaaatttgggtagagatcattagtgatttcagggaaaatttggctttctgttgaaatacaggcaatgacctgcttgggaaatacaggcagtgatcttcttgcttgcattggttcggcttgctgttaatgtgacgtacttttcatttcactgtaaaaaacgagcaatgtaggaaactactgtatcatgtcattattactgcgatatcatggcatgttcactgttattgaattgtgttgtaggaagtcaatctagatgtatatttgggattgcattactgaacgcaaattctatattattgatcgcctgtatgtaaaaccagcgatcatactttagtgttcagttgaatagattcaacctctgattggttgctacttgaaattggtgggaaaacttaggacataaatggcaagcgcagaccaattctagaaatatcagttttgctctcttgctatatagttttttacaagttccatgcacaaaatgttttatctttgatgtaaattctttgtagtcagtgctaattctgccattctatataattttgaccctttttttttcttgtgggttagtttttacgtagaaaaggaagtccagctgggttctccaatctaaaatacaagcagcaacctcttgtgcaacatcaggtttgactctttttatcctttgataatgttgaaattatcctttgataatgttgaaagtggatgtgtataaattataaatgtcaggattagaacccttaaacatgatattgtggatactcacgaatttttgtttgccactaactgtttgatcaggctaccttttcttgtctagatactatcatactagttgtgtttcacatgcaattgattgcactggattgccgtgggacattaaattggcctagtgctctttaattttgtgagggacatgatttattgtactaaccaatgaccgttctgtgtcaactatattcgtgagtgatttcaagcatttgtcagatagtgcagaaaccagaaaactggaatgcaagattacattgcattttagttctacatgatcaaatgtccataagttgaatcccctcatttgtgtctgttgtgcagaaaattcccctggcttctgcccctgaacattatgggctgcgatcaggtttgcggcgaattatgtctgcgaatttgctgatacttctcaacgagtattcagattttaggccggtgcatggagatggggaatgtttctacaggagtttcatattttcctatctggtagcggaccagttatcctcctccctgttccttagcatagcatcgtatgcttcatgtttggtgatttattcctttatttggcaggagcaagttcttgacatggtgggcacagatgaggaaaatcgcctccttgctgctgttggagcaattgatcatcgtcaatgggcctctggattttctcagagccacaaagtaatcactcgccttctctgtattgtttttttgttcattctgattgaaaaatgcgtttcagagacgactctctccgcgaatgcttgtaacgttttttcttttagttaggccctttacttaatgtttaactatcacagcttctcagacaagttatcctactatcttcattcttttctaaatatcgatgataagcattttgcaagcctcattgtaacctgttaatctccagtctgtgtgcgaaaaatgccagctgtttgtaaggtttaacatgcacggttattgcattactgactctcaggtatttgagaagctgatacagaacgtgatgagatggaagaggagacagaagggtgtagcatcagctgacaggtgtttatatgcttggttcctacagttccaacagagtgttgtttgtaaatgcatcccatcccactgaccacatatgggcgcttttttcagccgtaggcagaaacttctcgagttcttcagcagttacagcaagtcggatggcagtaagaacaacatccttgagtctacgttcctttgattcatcctaattcttggttctgaaacttcttttttgtcagttttggctttcctcaaatatgcagcagctaactggatatgctcgcacagagaggagtatgaaccgaacatagctgggcttggaggtggctacaccctggaagctgttagtgccaatatcacttcccttgctcgtttctgaacttgcaacaattccttaacacttgatactcatttcactgtacctgtttgcttgcaagcagtggtgcgaaatctatcttcttcagcctcgtgagcaaactgaccatattcagatgacggccgtggcagccgcgcttggggtgcctctccgagtggagaacctgcataatggaccagctcaagatatctacactgccgatggcgttaacattcctcgcgtcaccttgctgtacacaggcgtccactatgatatcctttacccacgccatccttctggtgggagtgggagtaagagctcgacacaacgggctggttgctttcgtcccttctggtagggagagagctgagtttgattgctgcagatgagtatgaacattgccgaaataggtggcagacaaattttgactttttggtgacaaggagaagagaaatgtgatgatcttgattcttttgcaacttaactgtgattaagttctcttaagtgtctttgcagcagaatattttttcatgtagataaaagaaaattatattggaatcctgattggtttggttgtgctgaccaacttatgcacacccttgttgtccatatattgaatatttgcctgga

SEQ ID NO: 69210 - DNA, 652 bp, Oryza sativa
cgctgcaactattgaatagtcttatattggttgtgaaagggcaagtgacctagtatataagtgggggagtctctcacctcattggttaatttttgaggtgggaaagaccatttcgattctacaattgctatctgagtctggttagttcaatatctctaacctgagtggcaaagtgtgcgaaggcatgatggaccgtggatgcttgtggagcctgtatacctgagggaccgtagagaaacagtgaatggacggtgaaaggccgagggacaccaacgtatacctgagagaccataaggaaacggtgaaggggtggtgaacggctgagggacaccaatatatgaaggggggagattattgaatagtccacattggttatagaaggacaagaaacttaatatataagtgggggagcccatccctcattggctagcttttgaggtgggaaagatcatttacgatcctacagcagcagcgtgaccttgcctcacgagctgggctgcaaacccgaaaaggggaagcttagtgtgatctctcccttgtgttatgaaaactctgggctatacagacaatatccatcacaatacagagtttgggcttggctaggctgccattcaagtcatccaaggctaggttgaacggttgatgctagcct

SEQ ID NO: 69211 - DNA, 1607 bp, Oryza sativa
aaattttggttgctcacttcagttccaaatcaaactacataagaactccaaatccaaataacacacctagcactcaaaaattggctgctcagcttagtttcagagtagacaattgaaaaaaaaaactaacatcttaggtcagttttcaattacggagctgataaacacaaacatatgaactcagcttttagaccattacaaagaagttgaaaaaacatatagttcagttcagtaccaaactcagcttttaaattatcacatagaagttgaaaaaacatacaactcagttcagtaccaaattacaaaaaaaaaaataagttgaaaaaacatacaactcagttcagtaccaaattaaaaaaaaaattatagaaaaatcagttcagtaccaaatttaaaaaattaaaagaagttgaaaaaacatacaactcagttcagaaccaaattacaaaaaaaattatagaaaaataatggagatgcgggggatcgaaccccgtgcctctcgcatgcaaagcgagcgctctaccatttgagctacatccccttttatgacaaaacaattcaaatcaactaactcaagtaaaattaacaagttgggcctagtgagattacggcccaatgtggtgatgccacttcacttggcagtagagagcagcaggtttagtcccacctcggcgggagagagcgagggggcatcggagacaggctataaaaggaggtcgatctcgccttacataggcatgatccttcaggcagttaaagggagatgaggagtggtaacatctcgcaacttttactgcgagaggggtgcccgccccaacccaagcctgttacgacaacaggggcatccccatcattttaccatctgatcccgaaattttaactgaatttgtttggattttgtttttttgttgtggctttttgtttttttgttgttgctttactccatttcttgattgtttatttggtttatttggccaaatgttttctattaattgccggtttttatttgctttgttcctcttaagttgctggtttttatttaccaatttcaagctgtactattgtcgctctcttcgttgttgagatcacgcagcaagcatgatcaaaatacgaggaaaactaacaaggtgctgcgacacctgtaatgggtctagcacccaccctgatgctctgccttctcgcactcgcggcgctgtctcgcactcatcgtcgttgtcgaccttggagccacccgccgctgccgctgccgctgcctcatcgactcctctccaagaccctgatgaaccctgagttcctctcaacactcaaggctgttgttggcccgatctttcggtgagttgtgataactacgatttgggagatacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatatgatattgcaaatagaaatttaatacaaatgataagttggggttccaaagaacaagcagacagacggtctagccgacacgcacgctacaagca

SEQ ID NO: 69212 - DNA, 561 bp, Oryza sativa
tggaactcatcgttggtgccttcccatctcgtccgaactgcgacagatggctattgtggccggcatcctccccatcccatgccacctcgtgatgtctaggctagtggtcggcaggagaggagcaaggcagcgatgacaatttctagagtagctcccggttgatcctaccccagctcccctacgagctcgctgatgtcggccactgtctaccttcctagagacctcagcggcagtggaggtcgatgggtccagcacggggagctatgtggacaccatccaccgccgatcgacctatccaagaaccgccttgccggccgcatcctcgacaaggtgttcgcgatgtagaaactcaacaagccgcttgtgcttgggaacacgctcttcgggacactcctttccaagtttcatcgactacgcatcactgatctgactccggtttggcgagaatcataaatagagataaagggtaaagagggggggtggggcgttattttttttctcactgacatgtgggatttatgagcaccatgtatgacgaaactgctatcaaaatggccaagg

SEQ ID NO: 69213 - DNA, 565 bp, Oryza sativa
gcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagcccgtcacgccgacgcctgggaccgtcgggcggacgcctgcggccgacgcgccactgcctgggagccccacgccgccacctgggaaccccgcgtcgcagcctcgccgtcgtcgcccatcaagagagttaaatcgggttaggtttaggtttttatcttttcataatttttttcctttaccggtggattgggatagaataatttggagtgagagcaatttggttattattgtaaaaaaaaattctaatagtgtggactaaacggtatgttgactgtgatggtatttctaggagaaataggtttgtacgatggt

SEQ ID NO: 69214 - DNA, 23698 bp, Oryza sativa
gcccatctccccctccctcccggcgctcgctctatttctctctcgctctctctccctcctcttcctccgctccgctccgctccgctccgctccgcccgcgcgctgcacgcgcgagcgcccctcctccgctccctccgctctgtccgcgcgtgcgtgagccgccgcgccgagcgcctccctcccccctccgctctgcccgcgcgcgagcgcgtgagccgcccgcgccgagccgagccctcctttctgctccctcgctgccgctccccgcgcgtcgttcgcgtgcgcgcccgcgtggtcgtcgcccgcgtcgcgtctgcgccgcccggccccgctgccctgccgcgcctgcagccgctcggccccgcagccagcgcgcgtgcccgagccgcgccactccatccgccgcgcctcccgttgcaagccgcgcgcgcgtgccgagtggccgaccgcctggtcaccgccatcgtcagcgcctgcccgcgcctgtcgcccgtgtcgccgttccgctccacaccgccccgccgtcatcgccgtcgtcatcgcctcggccccgccactccgcgcgcaagccgccaagggacggaggcagagccctcctccctctgccgcgacgcccccgctcccctcctccttttcccaaagtggcaaggaggcaagccccctttctctccctccttttcccctttttcctcccgccggcgtcatcctccctccgccctgtcgccgatttggacgcgagcgccgagcgccagctcgcgccttgaccgcccaaagtcggtttccaaaaccgacattgccgccctttaaagccccgggcgccctccctctcttcttctctcgttgtcccatcacctccactccattgttgccgcccctctgtttcgccgtcgccgttcgtcgttgcgcgtgtcggaggagccggcacgagcgaggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctcctccccttagttttcggtagtagctcgagtagcctccccgtagctagccggcaccgccccgaccgttgccgccgcttgccgtgtgctcgccgccgtcgccgcccgtgttccgtagcacccgctcgtcgccggcctcgctcggggtagctccgctcaatccgacgctagcaacgaattcccgtggccgcgtagatactctcaccgccgggaattggcccctcgtgacctcgtcgccgttttccccttttgctctccgccggttaccgccgccgaaatccgccgccgacggactccctccggcgaatccaagccgttggctcgctccctctcattcttcctcgtcatcccggtgtacgccccgtcgcccctcatcgtcgcaaggcgccccggagaaaccgccgccgcccgccgtccattcgcggccggcgccttcgtcttcctccctccagcccacgtggcagccacgtaggcgccacgtcggcgccagctcggccgaaatcgggtcgggccgaccccggtcagcccctcccgtgcgcgcgttccaccgcgagccgtgaggctgcgcgtgggcccgccgcatcctttccaccgcgaaccgcgcgcgtgcaccgcgtccctcccccgcccgcgcgcgtacgccgcgtgctcactccgcacggtgaaccgagtcaccgtcaagcgggtcccactcgggaccgcgcgtggtgagcccggtccaccggctctctctctcctccctcccgcgcgcgcgcgccttgggccgccttgggccggccggcccatttagctcggccggaccgctccatttctctcgggccgcgccctagccgcctgaggaaaagtctattttccctccctcttttcttttcttttcttttttttttcaaaaaggatttaattaaatcctttttctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatattgagcctatatttgaaatttaattatgttacttgaaaaatattatgcattgataggatcgcacttaatctgttgtcccgtctgcaaggcagattggcggacctacctagtttgttgcatttgatccttgttaattgttatgtcatgtccccttgtaaccatctagttgcgtctcgatattcgtgcatcctgtgcgagtatcgacggacgcctccaaacttaaaatctgaataacaacttgggtaaaacttgggttttacaaaagacttggaaaacccgacacctgggtcggtgcttgcgaactaaatgatgttccaaaaccgcggaccggggaacgtaccgggtgtacggtttcccgctcttgcacttaaggaccgtttccttggaatttcattcaaacataagacaagtacaaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgtagaggttaacaatctgttcgaacagccgtgcccacggtcatgggcggatgtgaggtgattcctagcgtagttttggttgactactgcttgtgaaattgctgttgtggaaaggagttcgatgtttgaaaaatctgcagctgatgggatcagctaggcccgggtggccgtttgaaagttgttggctcgggtggccgtttgaaaagctattggccgggtgccaaccttgtttcaattctaaagactgatacattgcacatactccgaccggacgagacgccctgtctcatccgcgtcgtttgagaagcactcacttagttgtttttagaaaagagtttaaataaaatcaattgcaaaaacaacagcctttctttgaagcctgcattaaacacttattccccatggcttgctgagtactctcgtactcacccttactctatataaataattcccccctagttgctgaagaagatgaagcggatcctgctgttgaggagttcttccaggagcaagccggctacgatgagttttagggtttcgacctagttcccaagtcgcgcctgtgttgtttggtccaagtcctggcttccgtttcccttttgtaatgcagttgtgagctcgggatctgtccgcagcccaaaatgactgtacctctactctataataaagagacctctgttgctgtgatatcctgtctccctgtgataccagcactgtttcctgggactggtatcgattaacaggttaatttggagcgtcacgagctagttccggtcgggactagttcggggcgtgacaaaatccaattttatcaattttttattcttatgcatacaaaaatacaccatcataattaaacattgtaatgataagatagttaagaagtgccatcgatacacgatacaaatttaacattgtgcctgatgaaaacaatatctgaaatcgccctcccccagggcgacaagggggccgcctgcaaaattccaggcccctcgctgcccatttgcaggcggccccccggacagtataaaatcgcccttgcggagggcggcaagggggccgcctgcaaatttgcttgacggccgtcgcccgagagcgaacggccgtctgccacgtcacatttgccgtcctatgtgaggacgatttgtgggcgactacttttgtcaatttttgaaatagaaaattgttttttaaaacttttaataaaaaaaattaaaaataaaaaaaattctgccgctcactgcctgtgatgcacgtcttcggcccaccgcacgcctctctctctcatcaaactgtcacggcgtgctcctgtctctcatctcgaactttcacgcaacgcctctctctctcatctcgaaccgctggcccaccacccccaccgtgccattcacggcccgccgctggttgtgtggccgcgccattcacacggattgctccagacaaggttggccgtagtcgacgatccgtactgctagtggggcaatagcaatgctcacttttagggaaaccatctttccttccgatttgtaaccctcatttagtcccggttattcaactagcactatgaatccgagattaaaaataatgatctttagtcccgggtaaaataactagaactaaagatcgatcttaacaccaacctaaacaaaaagatccctatctttagtcccggttggagttaccaaccgggactaaagagaggataacagcagtccagatgatcccatttcttcttttttttttattttctcctgaatcaagtggcatgcatatctccaaatcccaaatcaaagtagcatcccaaatccacatcacaaatcttaaagttatttatacacataaatcaaatacatcgcatatcctaaaaaaaaattacatacaaatcaaattacatcacaagttctataaaattcattgtaaatacatcacaaattcatatcgcacacaaatcaaatacatcacaggatcatgcaataaatcataaattctaaaaaaaaaaaccacagaggcgccgcccggctggccgctgccgccttctctccgcgccggccggccactgccgtgcagcgtcgcccgccactgcgtcaccgcccgctgccgcgctgccgcgtcggccgccgccccaccgtgcggccctgcgcgctgccgcccgctgccgcgccatccgccccccggccgacccgctctctcgctcgatccaaaaaaaagaggaaggaagaaagagataaggcaggagttagagaggaagaaagaaagaaagagatagagtttgttgtgtggacgagagagaggataagtaatagggattatatagtacgtgatgatttttattcccgttagtaacaccaacaggactaaagttaaatctttagtcccggttggtgttataaaccgggactaaagatcctaggcgcctgacacggtctgacatggaaccaactaggactaaaaataatctttagtcccggttggttttaccaatcgggactaaagatcatttttagtcctggttggtaacaccaaccgggaataaagatcatctagtcctgttgttcttataaaccgggactaaaaatcatttttagtcccgatttttaatagaaccgggactattgtagatttgggtcgaccgaccaaagatggtttctccaccagtgggtggcttcagtatcacgagttaatgcctccatgtccttggtgtgatatccgaattccataatcactttcctttatggtttatccaagtatcctagacttttagtctcttagatttgtgcagtaccactcatgtagtgatgtactcatgtgaactcaatctgaaattatttagctttgaattaatatcactttacctaggcacctagcactccaccagctaataattagtttatctgtgtatgaatttgggcatgaaatggtggtcgtgtcaaatggggggagggggaggatgaagagaacaactttgagatggacgaaagatgtcagtaagcctaccttcttagcgtaagtgagggagagaatggagataagaagtcaaaggctcatagattaggagtaaaaaggccaaagggaggtatttcactgtctccttccaagtgcaaagtaacgagaggaaagcgggctggttgttggaaataatttaaggtgatcaatgttccctacaagaaggagaatgggaaaatggaaacaaaggcaaagtgcatgttttgtcatcatgctatgcttgtcacgtcccgactttcgttcgggattaaaaatcaattaataatgtatttctagaaattaaattaaaagtttaagcaatttaatcaagtgaaagattgggagaattaaagattttcctctaaaaatcatggccaggagtattttgaaatattctttgtgccctaaaaatactctccagatttttccgtgaattttcggagctcaagaagtaattataataataaaaagttcatttaatcaatttaaataaaaagaaaacaaattaaaccggcctcctctccccgagccaccgacaggtgggccccacccgtcggggccatcccctacctccggctacccctcaaccgccgccatggtctccccacgtcgccgccgattccgccctctcctccacccgcgcgctcaccctcatcgcggggccacgtcgccccacctcctccacactccttcccccacttgcccccaaaatccggcacctaatcgccgccgccacccctcgatgtcgccccacttcctcgccggttgttgccgcccttccccggccatgcccgtgactcccgagcgctataaaaagcttccctgtgccatcctctctctttttccccattcgcccgagctcccatcgcgccctctcgagctccccgtgtcgctcctctctctccgccgttgctggtgatctccagccaccactcgccgccatcctagccatcgtcgcgtcgcgcggccaccaccaccggcttcgccgccgcgagatcaagcttggccaccacatttcctccccaaaccgccgcccgaacgccgctcccactgccgacccgagccccaccaccacccgccgtctccggccgcctattgccgccatccccgtccacctcaggctgtgccaccatgttgacgaccaaatttggaaatatcagtatcggagatgaagattagatcgaagcggaatcaaagataagggttatcgcggaaacagagtaagaatcggctggagtccggatcggctacgattgggatcggctaagtccgagtcagactgggttaggtgatgcagccgattctgacaatacgacttgtgtacaacatcgggttgagttgatatgcttcaagatgattgccacgcatggatagagtcctgagaagacaattatatctattaattaggatattttatgtaatttccttagagataagtgtcacgcccagaaattcacgaaccagaatttctaagctgaatgtgcattaaatccctgtccaggactagccagggtacacaaacgacaattgttgacatacagatccatgtcttacaaaaatataaaagtttacaaatgcagcggaaaagataaaacgaagtaaactcggaagcttgacttcagcagaggggcgactccattccacaggcaatccttgacgacagcgacgaaaccaacctctctgagacggctccaactagaaagatcttcagctctggtgtgggggaaaagagagcaagactgagtactacccactgtactcagcaagtcataccggaagaggaggtataatgcaggatataaccaaaggaagctaggggttcttttgcataaagcaggcatttcaaagcagtagttgaaagcagtacaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcacctataaccgcgggcacggctattcgaatagttttactctggccagaggtgtacaactgtacccacaagacacgattccacacatgtcgccatgccccgaagtatcaccatgatattgcaaagggggaaatcgtgacaaaaccctccacataaccctcccctaaccatccacaccacgctaaggtttcacccccacccctcaaaaggcagtgggcggtcccctcttgcgccgcggtgaatccggtagctggataaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcagtgtattttaattaactaacaccattgcggtggcaccaatccaaaactatgctcatagccaaagtctatgtaataatgtgatctccatttgtgtactagttgagctaagcatggctaagcatttcctaaaccaacatctaatcattttgatacccaagttatcaatggcatatggtaaacaataaatggctgagtaataggacccatcccacattacattgtaaaagaatgcaacatttaatagaaatgcgggatatttgtaaattgggtacaatatgatcaattgtaatgcatgacttgccttgctctcgcactgatgagaccacagcaacgtcttcgagaaaccgcggatcgacgaaatggccgaaaactacgcgacaaacaaagcacacaagcaaaacatgctataagactactgaaacaggaaacaaaaccatttttaatggattctttgtatttttcttgatttactgagacttgaatggacttaaacggagctcggatgaattacttatgaattttagaagataaactgtgtttttactaataaagaaaaagtctttaattaattattgcgcaataacacccagggctgacgtcatccaagggggggcggtgccgacaggtggggcccacgggtcagcggctcaaagggggtcggtccaccgtggaccgggaccacgcgggtggtccaccgccggtccactggaccgacggtccagatcggccgggaggccgatcggacggcacggcggcggctaggcacggctcggctcggcttcaaaaccggccggccggccatgacaaccggcggcgacgcgcacggtcgccggcgatggcaatcggcggcgcgggaagcgacggcggacggggtacaggactgcggcatcgaccaaaggcgacggcgagcgcgtggagagaggcggcgcaaacgagagagaggggaagaggtaggaggggggatcctcaccggcgagtatgtcggccggagcggaggatgaaggtggcggcgacgacccagcgatgtggaggggcggacgggcggcggcggcacctacggagggagttgagaaggattaggagtagagagagtgaccacggtggccaccattgttggccggagacgaaggagaatggatagctcaccgtcgtgcgaggagaaccgggctccggtggggtttagcggaaaccgagcggcgaccgaggtggctcacgcggcggcaatgctaatggcggcagcggcttggcgcggcggcggctctagcggctacggcgcgcgaccggatgtggcggcaagcggcggcgctagtggcgagcggcgcggcggcggtaggaggcacgggagagcgcggcgaaaaaaggaaaagggagagggggatgcagggaagctttataggggctcgagaggggcggacttggccgggaaaccccccgatttggccggcgacgtgggggaagagagagagagagtggggggtgggaattcaaatcgaatcccacccatttgcgggcgcgcgcgcgggcgagaatggcggggagggcggcgacgtggggacgtggagtgggggcgtggcgtggagcagagaaggcggcgacgcggacggtttcggcggcggttgccgtcgtggggcgggcggctagaggaaggggacgacctgacaggtgggccccacctgtcagcgtcccggagagaggggaaaggggaacgggccggcccaaaggaaggaggccgagcgcgggagggagtgggccgacggcccaatagagaaaaaagaaggaaaagaaaaagaaaaagaagaaaggatttttcctgggatttaaaattgcactttggtgatttttaattggttaaaattattttcaaggctctgaaaattccactaaaaatcctgttaatatattggagcatgggggaactcaagaaaaattccaccacgctatttccgattattaattgcatttattaattatggaattagctctaggttaattaaacaatttctttgcgcaatttatttaaccaattcttaaagcaagaaaaaggggaaacttctgggcgtgacaataagtgtgggcaaaagtctgccgtaaagacttatggtatcttagagtttgtttgagataatagttgtgtccgatatggacatatcttgtaattctcgggtataaatagaccccgaaccccatgtatcaattaattgacgttcaatacaatctcggcgcatcaccaccctttttactttcgttttgtttcgacgagtttttgttttcaggttgagctgcatcggtttcaatcttcaacaagaggtaaaacttgttatggcggcttgcgttctcgagattagtgcttccatcttaatgataatctaatcttgtctatgtaattcgtcgagttatcatatatcttatataatctttgataatatcgtcatctaacctataatcggctaacatctgttagtagaaggcagccgattaggttaaatagcgacgttagcttagattatgtaggatatctaccactctatgaaacttccaatggcttgattgtctagatatcgtccttcttttcatacttatagctacatcagttgagtttgatcttataagtcgtgattagaatctcaatctctagcctgcttcttggttgccgattagggtattatcggggtttcagccgatcttacctgatttaactataattattctatatgcttgattgacatgttaaatctgccctttatattaagatcttgttgcatttaagtatattaggccatcatttaatatattctatccgctttaatatcttaatatagagtggtatcggagtattagccgatacatgctagatctatctgatcggctatgctatgaatgtatataatctcattattaatatatattttgatctaagtgattcatactctctcagcaaggtgaccgatctatcccaatcacttgatttaagtatatgtcgatataaggattatatatcgttaatatctacagccgatcgtgtagatttagttctgatttgtttattaatgcttgccgatcgatgtatatatgacatcggcccaaaggtgaatgatatgtcatcggcacctagccgatcggctatcatttatggatttaaccgctgtttctttgtttttgtttcttgttgattgcaggatcaaatcaactggcacgctagcatatccgaaggcgagttttggacctgcactggagttaagcagatctcctaggcctcatgttttctgtcaacacgcttttggcacgcccggtgggaccgattagaagtcagagtcacaacagcaattttctccatggccgagaagcaaccaggatcgccatcgccgaactcggctagtcctggctcttttaaagagaagatctagaagctgggcttatctgagttgatgaagctaacattgtgaccatcactctggataaattgacacctgagcagcaaaaagatcttgatacgatgatgcagcaagcgcgaaatcagttcttgggctcattcacagagacctgcttgggaacacttgtttagaaatacaaagtgaaggtagttgctgatgttcctgggaccagttcttctaaagatggagaagggaaacaagctccaaatggctcggctcagtcgagtgataaaggtgctatagatggttctcaaggagaccaaggtgacggctctcaaggagtgcaaggtgttcaaggtgatggtgctcagggagttcaaggtgaaggccttaatcaaggcagcaatgtggcacagttgcagttcaataacttccaagatcaggttgactatgttgtgcaccatgctttgatcaatcagtctggaatattagtcaacactttgtcaaacatggtgaagtcgatggttgatggttcaatagctgaatatcaagctacgggaccagtttatctgcaaggaggtactttcccgaattatcagctcttaatcactgataatcagcaagccgttcagtcggttccccctaatgcaccatcggctcagccgacggcacaagcatcggctcccgcacctgctgcaccatcatcggcaccgggccagttagtcaatccccggttgttggttagagatcaaccacagcatagtggacagaatgtgaatcggctaacgcaagatcagattgcggctttgttcttacctcctcaatctactgttgacccaccccagcaacagtagattcagcaaacgccaccaaggcaacaggttgtacagccgattcagcaaacacctccgatccaacaggttgtgcagccaattcagtagacgccaccaggacgacaggttttgcaaccaattcagcaagcgccattaaggcaacaggtcattcagccgattcaacagcaaggcttgatgaatgcatcggctgggttcgcaacacctggtggtcagcctaggcaacatgatgcgaatcaagttgtctccgagcatttggttcatcacgtacaaccagatcaaacggtgatacctcaaattgttcccgagcatttggtgcacaatattcaataagactttcaaaattaccaagggggcaatttgaattatcagtatcaacctccgtcaccgcaagttcaatatcagcagggagggtcggctcagcctcagtttgttcctcaatacaatcaattcgagcccatgccacaacaacctcaagttgcacctcagcaacgaccatgggccgatatgattgtggatgtgatgaaggagcagtttgggcttaggccgaaggatgttggaaatttgtagcgacagccttatcatgaatggtttgagagagttcctttgcctactcggtttaaggttccagacttttcaaagttctcaaggcaagatagtacatcgacttatgaagacatcaaccgatttttggccaagtgcggtgaagcatcggctgtggacgccttaagggttaggttgttccaattatccttgtctggatcggcctttacttggttttcctctttaccatatggatcaattaatagttgggccgatttagagaagcaatttcatagctatttctacagtgggattcatgagatgaaattgtctgatctaatagcgatcaagcaaagatatgatgagcctgtgcatgagtatattcagaggtttcgagagatgaggaataagtgctacagcttgagtttgactgatgcccaattagccgatttggcttttcagggtatgattcttccgatcagggagaagttctcatctgaagactttgatagcttgtcgcatcttacacagaaggtaaccttgcatgaacagaggtttgcagaagccatgaagaactcaagaaggttaaccatgtctgtccttacatatatgggtcggataatgatgatgatgatgattctgaaatagcagcagccgagtgggtaagaagcaaaaaagttataccatgccaatgggtgaagaattctggaaaagaggagaggtatgactttgatattaccaaggctgacaagatttttgatttgctactccgagagaagcagattcaacttcccgctggtcacacaattccgtcggctgaagaattgggcaagaagaggtactgcaaatggcataattccgggtctcatactaccaacgattgcaaagtctttaggcagcagattcaagcggctattgagggaggcaagatcaaatttgatgattctaagaagccgatgaaggttgatggcaatccttttcctgtcaatatggtgcatacagctggccgaacagccgatggaggtcgtgcaagaggttttcaggtgaattcgactaaaattattaataaatatcagaggaagtataacaaatagcaggaaaaacattatggagaagatgatgatggctttgatcctcattagggttgggagttccttagattttgttggaatgaaggtatgagactgccatctatcgaggactgtcccggatgcagtgatattgcggagagctcgagccgatcgtatagtacgggcaatcggctgaggcaaacaagagttcctgttcatcaaagattgggtcccgtgaaccaagatcgtggccaggaggacaatgaaaacatgaaaactcaattgtgtccttctggtatctttacaaagaatcagaagaggagggttgaaagattgaggaacagggagcgctttcaggaggtcgaacaagaaatcaatcatcggctgaagaagacaaagccgaggcaggaatgaagcgttaagaatcaagctcctgaagccgatgaggcaaagaagttggcaaaagggaaaagtgttgtaatggcatcagttaacatggtttttaccttgtcagctgaatttgggatcaagcaagccgatgttgacgaagtggaagaagaatggctaagttggttctatcaccagaacaagcagtctttgagaagcctcaggggacagagaatcggcatcttaaaccattgtatataaatggctatgtcaatgggaagccgatgtctaagatgatggtcgatggtggggctgcggtaaatttgatgccttatgctacgttcaggaagttgggcagaaacgctgaagatctcatcaagacaaaaatggtgctcaaagactttggtggcaatccatcggaaaccaaaggggttctaaatgtggagctgacagtcggcagcaaaactatccctaccacattttttgtcgtcgatgggaagggttcttacagtttgttgcatggaagggattggattcatgccaattgtggtattccttcaaccatgcatcaatgcttgattcaatggcaaggcgacaagattgagatcgtgccagccgacaggccagtcaatgttgccagtgccgatttagctctttgggagatggatggtctcaattgcttatctggaaaagtttgggatggagattttttaaaagtgtccgattccgatatacagccaattgaagatggaaaacccaagctattattttgaggatgtcatggagggttcaaatgtctacaccaaggacaaagtagatgatctcgatgacaaacaaggacagggcttcatgtcggccgatgatttggaagaaattgatataggtccaggtgatcgaccgaggccgacatttattagtaagaatttatcttcagaattcagaaccaagttgatagaactgttgaaagaattcagagattgcttcgcttgagataactcaaaggagtgttaatgcaatcaagaagattcagcctccggtgaacaagacagaactacaagagatgatcggcaagataattttgttagaaggtttatttctaatttgtctggacggttagagccttttacaccattgttgagattgaaagccgatcaacagtttacttggggggcagagcaacagaaagccttggacaatattaagggatatcttagctctcctccggttttgattcctccgcagaaagggataccttttcagttatatttgtcggccggtgagaagtcaatcggctcggtcttgattcaggagcttgaagggaaagaaagagttgtattctgcttgagtcgtcggctcttggacgtagaaactagatattcccctgtggagaagttgtgcttgtgcttatatttttcatgtacaaggttaatgcattatctattgtccaatgaatgcactgtcatatgcaaagccgatgttgttaaatatatgttatcggctccaattttgaaaggaagggttggaaaatggatattttccttaactgagtttgatcttcggtatgagtcaccgaaggcgatcaaagggcaagctatagccgatttcattgttgatcatcatgatgattcaatcggctcagttgagattgtgccatggactttattctttgatggatcagtatgtactcatggttgcggtatcggcttagttataatttcccctcggggggcatgttttgagtttgcttatactattaaatcttatgtgaccaataattaagctgagtatgaagcagttctcaaagggttgcagttgttcaaggaagttgaagccgatgctattgaaatcatgggggattctttgctagtaatcagtcaattggcaggagaatatgagtgcaagaatgatacattgatggtttataatgaaaagtgccaagaactgatgaagggatttcggctggttactttgaagcatgtatctcgagagcagaatattgaagctaatgatttggctcaaggggcatcagggtataagccgatgatcaaacacgttaaggttgaggttgctacaataacagccgatgattggagatataatgtacattgatatttgcagaatcaatctcaatcggcttctcggaagttaagatataaagcgttgaagtatactttgttggatgatgagctctattatcggacgattgatggggtgttgcttaaatgtttgagtgccaatcaggctaaggttgcaatcggagaggtttatgagggaacttgtggcactcatcaatcggctcataagatgaagtggttgcttcggcgtgcagggtatttttggccgacgatgctagacgattgtttcaggtattacaaaggatgtcaagattgtcagaaatttgaagcgattcagcgagcaccggcgtcggctatgaatcctatcattaaaccatggccatttagaggttggggaattgatatgatcaggatgattaatccaccatcaagtaaaggacataagtttatattggtggcaaccgattatttcaccaagtgggtagaggcaattcctttgaagaaggttgattctggggatgctatacaatttgttcaagagcatataatctatcgatttggtattcctcaaaccattacaactgatcaaggttcgattttcatgtccgatgagtttgttcagtttgccgatagcatgggtatcaaattgttgaattcttcaccatattatgcgcaaactaatgggcaagccgaggcttctaataagagcttgattaagttgattaagagaaaaattcctgattatcctcggcaatggcatactcgtctagccgaagcatatcggatggcttgtcatggatcgatccaagtccctccctataagcctatttatggacatgaggctgtcttgccatgggaagttagaatcggctcgagaagaacggagttgcaagatgatttgacagccgatgagtattataatcttatggctgatgaaatagaggatttggttcaatcacggatgcgagcccttgcaaaggttactagggataaggaacgaattactcggcattataataagaaagtggtgcccaaagatttttcggaaggagaacttgtgtggaagttgattttgccgattgggactcgggatagcaaattcagcaagtggtcgccgaattgggaaggaccgttccaaatctataaagttgtatctaagggagcttacatgttgcaaggactcgatggagaagtttatggcagagcgctaaatggcaagtacttgaagaaatattacccaagtgtttgggttaatgcatgatcggctgatgttgccgatacatgatagccgatgtatttgcatcgccttgagatggccgatattgtcatatcgcccttagttgtttttctattgtaatcggttgtggtttgccgatgtacaaatggccgatattgttgtattgcccttagttgtttttataattttatcaatgcttttgacattgtaaaattaggggtgcacatatataaaattgcaaagtaccagagtatctttgctgattaaaaaaatttctaaggcctattacacagagagtcaccgagacaaatattgctggatagcagaaatagccctttgtctgatttgttctacttcttcaatggcttgggcatcttgagcatcggttccaggaattacttttaaagacttgtgagctcggcaacattcttggtagctgattttagtcttgccttctgctcttcgacgaattttgggaggtcggccagcttcttatgttctatatctagctcagcattgcattcttcaagttgtgccaagagctcaatcttgcgagtctcgagccgatcaatgttggatttgatcggaccctcagatagctgatcaagcttggacttctcgtcgtgcacaagttgtcgattggcttggattgtggcttcaatatccttgcgctcccgacgttcggctagtcttagcctagctttctccagcttgaattgatgctgctcaagataaacggctggagtaaggatatcggctagctcatctgggattagagcttggatctcgtgtaaccgagtcctgatcggcccacagtttaccaccaagttgtctagcgatgatgcttctagccgatgagagaagtcttcaagggttttctttacatcatcggacaagggaactaaagacttgctggtggtgtcttcttctgtttcttcgtccagataatctttaatgtcgaaagagaacagatcggctaaggcctgcaagaaggaatttgagaatagatgagtatcagcatgagttatatggccgatataaattcttgtgttaaaagacaagacttaccgggattgcaggagcagctggttgtgtttcttcctcaacatggtgactccctgttgacagaaaactccagtgcaggtccaaaactcaccttcggatgtatgagcatgccagttgatttgatcctacaatcaacaagaaacaaaggcaacgaaaccgtgattaaatccataaatgatagccgatcggctaggtgccgatgacatatcatttatctttaggccgatgtcatatgtgcatcgatcggcaaatattaataagcaaatcagaactaaatctactcagtcggttgtagatataaatgatatataacccttatatcaatatatacttaaatcaagtgattgggatagatcggtcaccttgccgagatagtataaatcacttagatcgaaatatatattaatggtgggattatatatattcatagcatagccgatcagatagatctagcatgtatcggctaatactccgatactactctatattaagatattaaagcaaccagaatataccaaacaggggcttaatatacttagatgcaacaagatcttaatataaatggcagatttaacatatcaattaagcatgtagaatagaattagttaaatcaggtaagatcggctgaaactccgatactaatctaatcagcaaccagaaggcaggctagatattatggttctaagcatgacttaatagatcaaactcaactaatgcagcattaagtatgaaaagaacaacaatatctagacaatcaagccgctggatgtttcatagagtgatagatatatcacatagtctaagtcaacatcgttatttaacctaatcagctgccttctattgacaaatgctagccgattataggttagatcacgatattatcaaagattatgtgagatatatgatagctcgacgaattacataaacaagattagagtgtcatgaagatggaagcactaatctcgataactcaagtcgtcataacaagttttacctcttgttgaagatcgaaaccgatgcagctcaacccgaaagcaagaactcctcgaaacaaagcaaaagtaaaagggtggcgatgcgccgaaattgtattgaatgtgtgttcatatttacatagggctcggggtctatttatacccgagaattacaagatacgtccataccggacacgactattatctctaacaaactgtaagataccgtaagtctttgcggcagacttttgcccacatttatctctaaggaatttacatgaaatatcctaattaatagatacaattgccttctcaggactctatccatgtacgacaatcatcttcaagcacatcaactcagacccggcgtcataaatgagtcatattgtcgtaatcggccgtatcacttaacctagtctgactctgacttagccgacctcatccgtggccgatctggactcagccgattcatgctctgttcttgaatcgatcttcacctctaactccgcttcgatccaaccaccctttccgatactgatattaccaaatttggtcgttaacacatgccccccaagtccgggatatttgataatgtttcggattggctgtatacatactccgaaccggtttcgcactttgctgttttctgaccgttatccaagcgctttaaatactaaccgctgcccctgagtaatctcacaccgttactcccgttttcaccgctcaagcgaagctctaccttctctctctccggcgattcctccggcgcaaaagcgatttccaagtgactccatcttcagcgagatctccgcccgcagcgatgtcgtcctctgccagcccatctgatgcgccatcagccgagtatgctgaggtaagtccccatcggctcaatcccttttcttagcagcaaatcaattttattttgccttatatcgctttcctcttctcgaccgctttggatttgtagcatctctccaacctagttgtgattcccagtctatcgcatgaaatctactactttctcggcccagtcggcaatcctgatcccactgagttcatcataggtgaaaccaataggattcccttcagattaaccaacccagatctaagccactagaagaacacctttaaatcttggccgtctctagagaaaacttcacccgagaaaatttggactacatggttcaagcgcatgtcggccagcaaaagagttcactaggacgaaatcggaatcgggcaagcactcgaccttaccatagccaactcagctaaggacgaacccctgatggcagctgcctcttatttctggtcaaacaccatcaatgccttcttgtttaaccatgggccgatgactccaactctcatagatatcagcatgattacgggtttggacgtcacttcatcggctaacgctatgggcttaaacacaaagaatcaatacgacttcaagaccaagagcataggcggctggtcaggctatgtagcagcatacatgggccaggattcgatcacccctcgagaacatgtggctttcttgttaatgtggctagagaaatttctcttttgtggatccagctgcggtcctacaaccaattggcagttcgtaaccgaagccttggaaacgaaaagacaatttcctttaggcaaaatcctcctcggctacttgtaccaaatgctaaataatgcatcggctaagctagctgtcggctcagtagtcggagcaggtggaccatggtggctactgcaatcctggctaaatctggtagtcatgaaagttgtcaatcggccatccgtgacagaagcagaattcccaagactggagccgatcacagatgatgatggagaagaacacactcatcgccgatgtatgtcatatggagaatatgcatccacaccggccgatgctggagcaaagttatcagccgaactgctcaaagactggttttgcagcttctatgagggtattcaaaaagatgctcgagtttgtggtttctttatggagactcaacagacctcgagctcccataggacttcagattcgaagacatcaatcatgaaagataccaaaaatccagggaagtcttcacagttgcaatcactccgtgcatccttcccgtcggcattcatcaagggagaaacatccaagtttcctatgagttttatcatccaatgagttctgccaggcaatttggaatgggccaactcccaatcggcttattctttgccgataagatccaatgccgaggagaaatctcatcaactttaatgatggatcggctgctcaatctccaaggacctcctctaggcagcattgacaacataaagctagcaacctttaggagcaaagtatttgacagatggtggggcgaatggaagttgcacttattccatcaatcaacttctatgtatatgacagacctctttctagatgttgtcccttaaataagtcttaactcacttaattttcatttgaataactgcttagccgattaatccttggctaactttccttttgacttgcagacaacagaatcctctccccctcaccagagcaacagcggcaaggatattgagtatgccccaggattgatccctaacggaggtgggccatctccccccgtcatcggctataatgcccccaagacttcagctcttcttcaagggctcatcagagaaccagccgatgccggcaagaagaggaaaaccagatcttcggccgtaaatatttcagccctagctccaaagaagaaaactaagacaaagaaaaccacaccagctgatgatctgcctgctctagatccatccattgaacaagctctggatgaagaagtaattgaagatgatgttgatgaggccgcagccgaagtaagtgatacagaacaaacaccatcggcttcacccaaacagacccctctaactccttctgctccagtccacttttcaagagtaagcagctctctttgatcccttttataatcattttatcttatggccgattacttacagatttagtaattgcagaaaaagaagactgctatgaagaagaaatcggctgcaacaacatctaaaccagctccaccagtaagatagtctcagtttttcattagtcaattctcagcccattttgtctaacacttgtctctttttagcctcctcctcctccttccccttctatacatcaatcatcaagtgaccagactccatcagctgtaggaagtcaccatgtggaagaagaagttcaaccaactgctcctgctatcccagtaggttttttttacaaaaaacattcaaatcggctatgcccatttaatctctaactctctttaaatcattgctgcaggtcttagccgattttttctcttttgaaatcagagattatcttgatgaaagagaagaagacaccataagcaaagccttagcccctttatccgatgatgtgaagaaagttctagaagatatttctcatcggctagaagcatcatcgctagatagcttggtagttgattgtggctcagttaagactcggcttcatgagattcaagctctaatcccagatgagctagccgatatcctcactccagccgtttaccttgagcaacaccaattcaaactggagaaagccaagttgagactggctgaacgacgggagcgcaaagacattgaagccacaatccaagctaatcggcaacttgtgcacgaagagaagtc

SEQ ID NO: 69215 - DNA, 64090 bp, Oryza sativa
  unsure (1)..(64090): unsure at all n locations
ctccattccacatagtaggttaaaggatgtaaatattggtatttggcctagggtgatcctagcgcggagtgtgtcctgacatacctcaacatccacttaccattgcaagactcaggtatcccatcaccagagaaagcgccgagaacattgttgctgcccattttgtcactgccggataaggctccactctctcgcgcgtgcatggaggaaccggcacttgccgcgtcgccgccaaagagggtgctcccctatctcacgactcttcgaatgttgtgatggcattagatggtgtgtttctggcaaccgaaggatgtggttgtgttcagtcaccaaatcatatatatagctcataatttccttcaactctgtttaatgttattcccatatgaacattgcagccagttcttgtctctactagaggatttttggttagataatctcttttatgttttcctcgataaccagcacttgagcaaacaaaccatctacttgggcccatctgctgcacttttgttattatactgcttcctaacatcaaagccaatcttaccaccatagctaacccaaaatttccaagcctcgtctacacagctaaacttcattccagtcctaggcatccaacatggtgtgctatccattctacaaataaataagaaaaccatctgtgacatatgtttgattggaagatgccccaaaaactgctattgaaaaccaatgaaataataagaatagatgcaagcaacaaaccttcacttctctgcattttggttgatcctactttcctccatctcctgttggctcatatttgtggaagcatctttggcgctaagagaaattgggagataagtagaacacatgatagatagaaatatgcctcaaaatttgttactggaagccaagaaaaccataaaaaaaaatagatgcaagcagcaatcttcacttgcctctctaaagtttggttgatcgtacttctctccatctcctgttcatttatcttcatagatccacttcagtgttgagagaaattggaagaggtatggcatgagagagagaaaatgaaaagactcataggaagcaagtccgtagaaattggaggaaaaaggagtcctgcaaaggttttggcatctaaaatcaacctgggcctactgctcttcccctaaggcccatttcatttttgccttatctaatccagaggatacagatggatggactggattggagctaatgccaccctctgcattagcttctctaatgtagaggacccaaatccccaaactagagttgaaaggccatattttgagcatcggtgcaaaaataggttgtggaggatagattgcaaacttcctacagtgaccacatgagcaacggaaactctaatgagcgatcaatcgccctggctattggctagcaatcgccccattcccccctccctccctccacctggtttcctttttttggcaccgcattacttttctattttagtaaatttatgcacctaaagtttatacacctcaagtttacacatctaaagtttagagaccaaaagtttataagtcaaaagtttatatatccgattcaaatttgaatttgaattcaaatatttttttatatatagtatttctatacatctaaaatttatacacctaaagtttatagacctaaagtttataagtcaaaagtttatatacccgtttcaaatttgaatttgaattatatctgattcaaatttgaatttgaattcaaaaattttctatatatagtatttctatacatctaaaatttatacacctaaagtttatagatccaaagtttataagtcaaaagtttacatacccgattcaaatttgaatttgaatttgaatttgaatttttatatatagtatttctatgggtgaatagccaaagtggtcctccaagtttcatcgaaagctcagtttagtccttgatgtttcaatctatccatattagtcattcaagttttcatcttagttcaaacttatccttgaaccaacaactctcttgataaatgacacttatacccccatcattcacatatataacagaaaattgcatgcttgatttttttttatagaaaatgcatagtaaattatgtaaaacgaaaataaattatgtactagcaaatgtatacgatagtaattgcttaagtttcatgtgcacatgttgaaataataggaaaaacatctgcaatgttatttattcatcttggttttctcttttctatctagtatatagctaaatacaaattaagggcaaaagggacattttctaatagaaatattgactacaaatagccatatggcatattaagtgggcccaaggatgatttcaagccaaaacaaatatttagaggagttatgtggacaaaatgaaacgtgaaggaccaaattgagccttcgatgaaacttgaaggactaaattagctattcatcctatttctatccataattttttctaacttttgtttttttaaaaaaaaattatggtgtactgtaataggaagaaaagatggggaggagaaagggggagaagaggaaggaatcggcatagggggaggggagtgcgggtgatctctcagtaggaccccatgagctactgattgttagttgtggtaaatataagtacatatattaaaacattgttccgcggttgagctttgacccaccggtcagaccaatgaaccaatgaaagcactactgatttgactgctggtccggttattttaactatgcttgcaactggtagcatcttaataatgtgtagtagtatgcatgccttttgtgaccttttaaagccatggttctctctctttctctgaccatttagggcttcagtaaatgctaagtactcaggcaggcagaggtacaagaagacaacattttttttctaataatggaaagaaaaaacaactcctaacatttaacatcttgcactagttattccttgagtccactctaaaggagatcctccactttccctaaagtatatctgttaattttatcttgtactgtatgcgtgtaacagaaaaaagaaaattgttaagttaatcatgcaccaatctagaggcgtattaagctaagtttttgggtaccaaatatgtacttgtccaaagtcaacaacaactaaagaaacgttagcaataacgtgtttgcaaaagagagacttgcaaatggtgtgcatctcaagaagagagacttgcatagtctcttctagtaatcatatagtaacacttgctaggacaactctaacattgtgcctacctgcagaatatctcagctcagcagcgatatggagggagccatggtaagcgctctgacgggggcactgaactctcttctcttcaagctcaatgacctgctcggaagcgaacacaaatctctcaaagggttaaggggggagatcaggttcctcgagagcgagcttcgcagcatgaactcgatgcttgagaggctcgcagacatggaggaaatcgatgcccagacaaaggagtagagggacagggtgcgggagatggcctacgacatcgaggattgcatcgacctcttcgtgcatcacctcggctccctcaccgggaaagccggggtcatcaagaagatggcatggagaatcaaggggctacagttgtcgcatcggatcagcgggcggatacaagagctgaaggctcgtgtcatggacgagagcgatcggtacagaaggtacgacacgatgaacatctccagcatgagctctgaagcacatctgcacagagatgcctccggttctagaactagatcagttgatcctcgattgtccgctctctacacggaggcggagagacttgttggaatcgatggaccaaaggataagatcatcaaatggctaatggatacgcaaggaggcatctcacaacggctcagaacaatggcgatcgttgggtgtggaggtttgggcaagaccacacttgcaaaccaagtttaccttgaagttaaaaatcagtttgattgcagcgcttttgtgaccgtgtcgcaaaatcctgacgtgaagcatgttctggcaaaattcctctctgatgtttccggggccattggtggtgcattggctgatgaacatcacttaatcaacaagctaagagaatacctccaggataaaaggtatgttgggtttcagttttggattctagaaccaatgttttcttacgacaaaaggagcataaattaatcaatttcttttactattaattttggtgccttttaagtattgaggtaccgaaatgtagaaacgatacaattagcatccttagaagataagttgtagaaacaatacaggctcaaatgatgttccctttctattgctttttggaacaaacttttctgtatcaatacatccttggttgataattaaaagtcatgtgaaacagatattttcttgtcattgatgatatatgggatgcacaaacttggagaataattgagtgtgcattggtcaagaacagtcaaggtagcagaatagtcaccacaacacgtataaatgaaatagctaaatcttgctgctgctcttatggtgatcaagtatatgaaatgaaagctctttgtgctactgactccaaaagattgtttttcagaagaattttcaattctgatgaaaggtgccctcctcaattgagggaagctgccaataacatattgagaaagtgcggtggcttaccattggctattatttctatatcaagtttgctggctaccaaaccaaaatcattagaccagtgggataaggtgaaaagtcgaattaattatacacaagaaaacagtccagatattgaaacaatggcatgggttttatctctcagctactttgatcttcctcatcatctaaagacatgtttaatgtatttgagtatatttccagaagattatgtgataaagaaagagcgtctaataggtagatggattgctgaaggattcattcatgcaaaacaaggggaaagcctatatgagataggagagaattatttcaatgagctcatcaataggagcttgctccagccagtagacatagaggatgatggtcaggtgcatgcttgccgagtgcacgataccatccttgatttcgtcgtgtccagatcaaatgaagaaaattttgttactatggttggtgcttcagatctcacatctactccaactggcaagattcgtcgcctatcattccataaaaacagtgaaggaagtgtcacaatgccaacatacctgctcagatcccatgtccggtcattgacgacatttttgcacgctggacaggtgcctcctcttctgggtttttatggtctgcgtgtgttggaccttgaaaattgtagtggattgaaaaaccatgatcttaaaagtataggaagactaattcagttgaggtatctgaacatcaaagggacagatataagtgatctgccatgtcagatacgggaacttcaatatctggagacattagacatcagatcaactcatgtgaaagaattgccttcagcaattgttcagcttcaacggttggcgcatctgcttgttgattgccatgttaaactacctgatggaattggaaatatgcaagcattggaagagctaacaggtttctctgttttcatgtatccttcaacatttctgcaagagataggaaagatctccagtctaagggtgttgagggtagtttggaactacgtcgactttcaaggaaatgcagaaacttacagggaaaatctggccatttctctcaccaagctaggcacatgctaccttgagtctctttctcttgatatccatggacatgacgaggaagacgatttctcactacatttgtggacccttgctccttgtagactccggaaattatacattggtcgatggcatcccatttccaggataccaaactggactgaatcccttgcaaaccttcagtacttgcatatatatgtcaaaagaattaaccaagaagatctgaggatgcttggaagcataccttctctcctcactctatacctattctccgatgaggcccctaaagagaagctcaccatcagtagccaaggattccaatctctaacattctttaagattcactgctatcatatgggattggtttttgaggcaggatctatggcaaagctcgagtaccttcatatcctgatcagtgcatttcaagtgaagtcttgggatggcagctttgattttgggattcagcatctctactgcctcaccaaggtgtatgcctatattaactgttatggcttgaccgctgaggaggctgaagctgcagtgaatgccattatgatttctgttgacacgatccctaattgtcccaagctgcagattgataggcgatatgcacccttgtgatgaagaataaatattttttttttgctaactgatgcacatactgctgctgtgatctcaattgttacatctatttttcacttccatatatagctttgctcctgtaatttctttcagcagtatcaaattaaagggcttgaggtttggcaatgatttggtccaaagacttcatttcatttaaatggatgttccaattaatctttcttgcatatatttgttcaataaccaaagggagagaacggttacaaaaatcaaaaaagaaaaaaaatcaaactaccaagcctgagttaacttgaagaccctccttgtggtctgaccacagttaaacttttaaaagttcaggaccacaatttagttcagctagactagcactagacaattagaccaccagcctaaaaacagtcatttataactccagttgactcaatatttagactatagagaaaagcaagatgaaatgttcaaaaacatttctggtgtggcggatatcatttgtactggataagggggcatctgtttgttagtaattgttttttttccttacctatcaacctcattttttaacttgtatatcaacattcaacatcttacatgtcgattttttttttgggttgaaacaactcaagttacttttctgaagaattggtactttattgtagatcatgctaataaaaaaattataacatttttggtaaaagaaaatatagcctagataagcataaaaataaatctagattaatgtagtaaatgaaaaacaaagaaatttaaaagtcacactcaatttgtactaaaatttgcagttttttttaacattgtgcgtgtgtaaggatgtttgttacacaagattaattgactaaggcgcagggatttgtggctaaagcgcagggggcagtgggaaactgcacaagaaagaaaagttgcctgagagtaaaggagctcattggtgtgggagaacggagaagaggaccacacctccgactcctccccatctagctagtgtcatattttatctcttagtcctgccgacacatggctcactggttcaaagtgcaatacattggtaccaatacctagccataagtgaaaattattggttaggggtagcccaaaatgaaactttggtaaatatgcctatccttacatacaattcactcttagaacttctgaattattactctttccttagccatccacatgcattcgtagattttctgattcttcttttgatatttaaaaaggctacaaacatttgcatcattttcctaatctttagttattcagccttgcttttgaattttttaagagtaccctttttctcagatggttatggtgtattggcataaaaagaatgtccaggacatatcatgaagattatccatattcagccgaaaactagaaaatacatgtgtggaactcagaataatagcacttctcatagcctaactgaaagaagggtagaaagatatgtcatcaatcaccgcacggtcgtttggtgtcactgaaaaaagatagttgacattattggtatgtacttaggcctaaagggaacaataattctaagattacatcatcttattaaccacatatagcacactgattttaaacaatttggattgtgaataaaaaactcctacgtgtgaagaagcagcagtaaagtggggaaacaattagcatgtacctgaaaccctaagaaagttaagacatcaaagtcatatgcaatattgcagcattatataatgaatggatggtgagcggcgctgccaatgtaccagttcgagaataagctaaccctgtgatacatccgatgacaaacaactggaatgaattatttatggagaagtgtgctatgctgaacatgagtgaactgacaattacggcatccttccatttcattgaggatgacagggctgttaggaggaatccacggtaaatggtttcttctgacaatggagcaatcacacagtataggaaaacacacaatagcctagaggttggactgtcagaaagtatttcccttaacataggatcatatgtatcctgcagtagaatcgaaacaaagaattagcaccttactaattgaaatataaaagtatggtattgtaattgagcaagcctgataataggcctgacgtggaacttcttgaattgcatctgacctcaagacctatcaatctgtcagctactacggttgtgagtgaaaccacggtcatcagaaatatcaaacctagcacagtttcttttacccagctgtgttgtggataaagcttcccttgaaagaaggcccaaagtttatgatcctttttcgtggagtactgcaatagtgctaaagccaaagtaagctctgtcaattgaagaacgaccgtggaagaaacctaaaatgaactaagcagttaaaataatgtatattaagatgaatcaatcaaaacgaagtactaaaaaatcgataccacttactgtggtgagtggatcaagtgaagggcaatgtagcagttcggccactacaccaagccctccaaagctgaaagggatatgaaagataaagaaataagctgcaaatgttctccatatatcctcgacctcccaaggaatatttggagagagcaccgaaaactcctgaaatatcatcacaatgcatcattttacaatgatttctagtttagaatcacaactgcaatttcacatcataattaattgcagatatcatagcctggagaccaaattgaagttgtcaaccttatagaggaaactgggcaaccaaccaggcatcgggacgtgtcaatcatactagaccaacagaatcacgaatttcactccaagatcatttcaaaccacaagtatatctctaccatcctatttttagatgttcatagagaaattcttctaatgcggtaaaagcacctcaaggagatgtcaagaactaccaaacatgatacgccggtaagcaagcaaaaaagtcgatcatgcaactacccgagggaggcattacatcgaacagttggcgggcaccgtcctcgtcgccaccgggggagggagagggagagcatgagcagccgagaaagcgacgacgcaggagcgggagcgtggtcggagccccgagctccgccgcccagatacgaggaggagccccgccgccgcagcctccgggcctgcagtggggaaggcgacgcgacggggcgtgagctgccgctgccccggcggccaagagcatctcgcaactgaagtggcgcgcgcgcgtgaaccgctcgtctctgaagtctaatccttcatgtcgctgctgccaaaggtgggtcttttttataataaaaaaaatcaatttaggctatattttgttagcgatgttttagtttagaccatcgaattcttttctcaagcatataaataatctcaaatatgttggcttataatcgacaatgaacttttatagctatatgtaatatcatttcttctacgtatgacaaatagggtgtagatgtataaaagagttgaggagtggtctaaggccccgtttgctagggctccaaactccaactccagtgagagctagctcctattggagttgaagactcgttaaaaagtgtttggcaagtttcagctctaaatctgaaaaaaaagaaaaaaatgaaaaaagaaaacccagccgccggccgcgcgttgccagcccgccggccgttcgccgtccccaggcgctccgccggccgccagccgccatcatccccaggcacgctgcgcgccgccggccgttcaccgcccccgcagctaggttggatcgggaggaagatgggggatgagaaagaacggtaggagaggaggagtgaagggtagttgagtggaatttttgtgtaaatagaccaaaaaattaaagggtagtgggttttttggggtggagtagagttgtagagcagcaaaaacccagctccacccacgtagttcattttctaggagtagctctgctacctccacttcaaaaaagggaggatctggaccgtttgtcatagtttcggctccaggtaagttggagttgggagctagagctgtgccaaacggggcctaaagtgccacaaaggttaaaaataagataaaaaaaacattggttaaagggtgattcgaagcaaaacatcaataataaaagatgattcaaagtgaaatttactctttttcagtggagcaaaaggtggttatttggttggctacttggctcatttggtttgaggcaatatttctcatatttgacacttaagaaatttcattggaaaatggctacactcggtacgtttggcagagtactaacgagaaaaataacagatagataattgtcaagagacacttagtcctggacaaatcggggataagcaggaaaatattttttcccacctatcctaagaatgagatgggtttgaaatgtaaagtctaatattttgatatgaataatgtggatttgctgaagacctgaagttgattctaagacatgttgtctgtgcatactccctctgtccccaaaaatagtgattcctggatgcccgaggtaattttagctaccattatcaaagaccaaaatacccttgtataagtacaacatccattccatcattcaaataaaaaaacaaacttccgtgcacaagtactactctcgtgcagagtgcgtgtgtgaatgagagagggagtagacgagagaaacgagagagagaggagagaagtttgcgtgaacaagtgggtagactgctatcctggttgctctgctgtgactgtactgctatctcatttaatgcatcacagatcgcttttttctatgacaaatgctcctcttcagaaattgattctttttaggacaaaggaactagatatttaggagcgatacgaggctgaaaagttgtcttgcacatgttgtggcattactaatatatatacttgattgaattatgaacaattctttataaggattattaaataatatatattttaaaatttagaaatagcttcaaacaagccatctatgcaatatcggtgtagaaatttacagatagtattggtactaggggcggcgtctagggatagtttgggaaccaaccataagtcataagctgaaaataacatgttatccactcatggagcatcccaccaatctagaggtggtggtaggataatatactcatcaccaccaagggggtgtttagattcaggggtgtaaagttttgacgtgtcacatcgggtattatatagagcgtcgcatgggtgttcgggcagtaataaaaaaactaattacaaaattcgtcaataaaccacaagacgaatttattaagcctaattaatccgtcattagcaaatgtttactgtagcaccacattgtcaaatcatggagcaattagccttaaaagattcgtctcacaaattagtcgcaatctgtgcaattagttattattttagcctatatttaatacttcatacagatgttcaaatgttcgatgtgatagggtgaaaatttttgcggtgggatctaaacagggcccaagttctttcatacagtaaagattgaaatataagtaagaacacatccattttctttgggatgctgaaagcctgaacttaccagccatgtttctatctcttttcagaccttttcttggtgttaacatcgtaaacagaaaggaacagcttttaaagtctacttcgttattaaccagaggttttggaatccggttacagcaacaaaaattcgggttccaccaaaatggacgaattttggaaattttggctgaaatttgaaccaaatgtgacaaatttgaccaaaaccaaaccaatttcagatgaaatgggagtgaaatggtgtctcgaacctcacagaaatgggcgaaattcgcccaaattcggacctttcagtccaaatcccagaaccgttaagaaaacaggaaagttcaccgcaataaacatactcaagacatttaccacaaagggacaatctgttctcccacaaggtaccgcatcaatccatcacacaaattaacaaacatcacaggcaaattatctcctttcaaatctactacagatgccaagtgcatcttattaagttttcccagctaatttgttttagaagtaatttctcccagctaattaagcagatatgagttgcatctccacttcatcctgtaatttcttgcagctttcctaggggacagaagatcctgcaatatttgtgatgctttgtctgaagaactcttcaacttctgcggcatcctcaggaagtggcatctcatccatcagcagcttgacagcaaatgtgatacacatgtcccattcggacggctctccgtatatcgatgctagggctgcttctgcacctgaaacacctgaaacaagaaaatttttaccaggactgttttgatccagagctgaagttgttcagtgtaaagcttaccattgtctgctttgttctccataggattggtggcaccagtggcatgctgatcaagagcactggcagctgcaccattgctgtccttgaggccagctccagcatcatcagctatcaaggcatcctcctgcttaaatgcatctgcacctgaaagtttcttgtccattggagtattgagagttggcacaccgtccttctggtttgtattttcactagtgctgttcttcacctcagctgaggtatcaatcactcggacaccagtcttctcagtaacatcgttaccggtgccggttttcgcctctcccttggaagctgtcttcttcctcttccttgaataaacagcctgttcattaccattcctgttcttcccagtttcaaatttctggagctcatcctgtgatgtccacaatgcaggctcttttaccctgtggcgcgccgaacgtttaccgcgtgtttttgggtctatgcgttcagtgatctctgtttttatttctagaagtttgtatttagtatcttcaccattgttgtcctttaatttaggtgccgtttcagatgcactgcttgacatgctgtctctttcagttgatttcatcatctttgagccaacactccgatcattcacatattttcttatattccttacagagttcagaagcccctgaagtggtgcccaaggtgtatgattccttccccttgggcggtccgaacgctttccatgaatcttgggaagcataggttcagaatctcctgatgatcctgacaaaaagtaaactacattcaattcattgacattgaaacagggttgttgagatatgcatccaaattacaaattactaatatcaaggggggaagtaaatacaacagtactgacagaattcaactgatttttaacatgaattcattgcccttctgcttggtaaactaagataaactgttactttcaaagggggaagaggtgcaggcaaatgaatgacatatgaaaagatttcccttttggcatgatcttccttttgagaaattatttccctctagtgtttcttctggttattcctaaaacataaattagatagcttttcagcacaataccaaagtaaattagagtggataactcattaaaaaataccttaaaaacaagaatgaactagtagtgaagaatatagaaatgcaagacactgatcatccaatagaatttcaaggaatggaaagatggattaacacgcatccaaaacttttctatatatgaatttcttattatgttgttttaaatctattttctaacttcataatatttaatccgttagcttgtaccctcaaataatcatcacaaatcattcagttattcagccattcagcacagaagaacaggagaatgcacagcttggtatttagcactatgaaatatattgattaataatcaatagttttagttggagataactgctatttaacaacctatgtaaggcatattctatttggcagaaatttttcacgttttcctactggaattaaactgtttcttgtaaagttcatgtattccaaaggaagcttaagtgatggctttcatgatttgtcttgattattggaagaaccattatcataagtttgtaaacagcacagggatacacattgtagaaagcctgtgcactggggtacggcggatgtcatggtcaataataatcaactggttaggagaaggaaatttacagtttgctgaataatagggttaaaaaagaaggttgggtgttcatcattggtcggnnnatacctaatgcaatgatatgatttactcataccatagtccaaaacaaatgagaaaagttttggatgcgtgttaatccatctttccattcatccaggcaaaaacctataaaatctcatttgttttgattgatttttagtggattcattatgtccagatagattaaaacaaaacaaggtacaggtttcatattgtcaggattgaagctaattaagcacccctatcgatgtagttggaccatgggtacgtaatcctcaacccccatccctaccctcatgagaaaaaccatcattcattaggtgatgtatatatatagtttttctttctcgaacacactgaagatctgcgtatcattttattaataagaagaagaagatatacacagggagggaaatccgaaaaatccccaccctaaacattaacacaagttacaaaaaactcaaaaacaggtaaacaagaccatttaacccgcaagggccatcgacctagccaagacctctcagagctttgaagttctagctaagcaccaaactgtgccttcatatgctactgattgaagcaccattgacaccctcagaattgagccactaaaaacacaatcattctgtgattccaaatttcccaataagccaccaaaattataggcgggtttagccatttcttcctttctttgttggtgtcattcactgccctagaccaccagcttgagaaacgatgtgtgtcaggggtcggggtgaggccaagatatttatagtttgaagttagcttttggggtagaggaaagtatgggatgggccagaattacctcttatggggccatgccaaaccaagtggtgatttttgcatgctaggacaactagccaagtccatcacaccaaactatgtggtgtagcaactagtcgtgttagcctacttggcaaggatggaaggcaaattcgccaatcaagtaggcagctagaatcatgaggccagttaggctgacattattttcctgcagaactccaccaatttttcttttccctatagttaaggccacaagtacggaaatacctaaccatgcccttaaaaatccaggatctagtatattttagtttagttatggggttgcaacttgtaatttactatgccacattcctttctaaattacatatggaacataggtctcatctatttcatcaacttacggaaagaaaatctaaatgagtataccaattaatccactaactatgacttaagctatcggacgaacagaattctactacaaatcagtttaccttatgtcgtaatcaccctttataataactagctacttacacagattgagaaggagagtgatatgaagaaatctctcttaccaactagatctgcgtgcatgtagatggagatgttgtcgaggatatcgtagaaacacaagcgaagattcaagaatatgtttgacgaacctagagatcttctcttgaattttatcccctcaaagaccaagaaaggaagaggaaaatactagaacttgcttgggattcctcaatagtagcaaggagaaggtttaaataaaatgtatatggggaatggactatttgctagaataagggtgaggatcccctcgcttcgtaggtgagaactatttattgcgtagagatatgtctattccctttctatttctaaaattaaatgacaaatatggttacatctacacgctccccttgagacctctaacgggcatgcgagttgctcttaaggaattgcgtcatccatctataaagtgataaaggttcaatatagtatgagttggtgttgtcgctatctgtggtatgtaccaggtgtttggtcttctgcttagtcactctgcacatgtgtatacccaagtgacttgaagtgtttatcttcagttccgtgttgggtattgttatgataaatctcgactacttttccttcatgaatcggactctttatgatggtgaaacacctctctatttctctttttttgagtggggaaaaatccccatattgtagtagcattgagttctctcgctctcttctagcttattaatacatctcccacactatagtaggattgaatttcgctcaccctctcccaacatattatttttactggttaatttcatcatgtatgtgtatagaaagtggaatggttgaaacaatgttgatctggacttgtttagatcaaaacaacacttctttttggatggttttccacaaccttttgaagataagtttagaatgtggtccccacattatggccagtgagcagcccccagcaaaacaccttatattgtgctatcaaatgatactgttaccaggatgttctgtagtaacagatttcaccggcgaacagcgtgcaatatattccaaatgttccagctatagctttctcttttcttttcttttcttttcttttcttttcttactatatatatagcttcttcttttttctttttcttttttttttttgcggcgaggagttccagctatagctttcatggcaaaacaaagaggctgtgctagctgccaattgccaaaaacagtagaaacaaattaatggcaacagcaggacgccaggaagaacgtagcaacagctgaattgatttattagccagctcaatccaaacggcattattcacaaactcgatatcaaagtagagttgactaatttggaatggtacttactaatgagagatgacatcgaagatttgttggaactcattaaaatctcatcaactaatatagcaaccaaggtatgtcttggaaatgcacatacttgacggttcttggtatttttctcatggtacatacaataagcgaatgcagcttcatgaaggtaaagggatcggttcacctctggctatttgcatgccaaattttcaagcttctaaaagccccggtcggaagctacagaaccagatagatatctgcgatcacggaggcaagacaacattctggcacaagatgagatctgatagagttttcccgtgccgatcaatccttctcgaagaattcacaccgccatcgaggatattcctcacgacaacgttcagggagctgattcctgggacatcataaatctcaatacttacattctcgagcggatcataccgaacctgatttgctcgatcagcgggaaacaaggaggaatcaagaaggggtgaaacagcattcttgacccaatctcgagtgatcactgccctcagccgaccaatgtcatcagggaaatgcggaatgatggagaaattcaaatcattccctttatcaccggccctgctgtgagctacgtggtatagaggaatctttgttccagatggagaaggaacagcagatggcagtgtgtccatgtttgtgttcaagggaagagtgcccattgcacaccttcttgggcacttgtgttgttgttgatcacacatttgacccttgtcagcattcgtagcctgattctgtggagaaggaatacttgatttcttcatatttacttgccaaaagatcttctcccgatcaacctgtacaaaatacaaatctcagtgtcatccgtagaaatctatgtgttataatctctaaatgttttctctggtagaacccaaaaatatgaacatttgtaatctctcctggaatgaagtacagtgattatccataccagtattttctgcagagttatttccttcttctgcccagtgctgtaaatcatgaaacaaacatgtcagatggttttgcaagttcagaaacaagagaaaattgcagacaccttctccattaaaagtgcaaatacagtagttttcatgagctctcacatgattagctttagtatagcggtatagctcatccatctgagcggtgcataattctgtgcatgaacttatgctattctcaactacaaggcagcatctagatctgagcattgttgataaaagcaaagaatacttgtaaataccttatgccgccaccaccagccggcccatttgtataaagtgcaatgaactcttcaacaaatttgatagcatgttcttccagctcaaatagcccatccatccggaacctgacatccatcacttgtttgacagaactgtctttgttatctccaatggctttcaaactatcatatcctattatgtatgagataatttttccttcaatgccaggatatgtttcatccatccatgacctaacctaattccagaagaaaagatgcaagtggttaaactgcctttgtgttatcacttgtagtgtaaaacatatatttcaattcttaacacatcaggggttatttgaagaaaatatgggaagtactttcatggacttacgaggtatttgctgcatgagctcgcttcaaacattcttggccaccgtatgatatctctccccagcctttccatccgctctcctatataaaatatgtggattaagtgacccacttgacaaactatctgtagctgatgttaaaaagtactatttatccaagccatttcggaaacactattgtttacttcaaatataaaaagaccataatcaaatttcagctatacgacaactaattcaaatactacgcaaacctcaaggcagtgcatttatggagtttaaatattatgtcacatgtcaatactatgtgttcagatgctaagttgaacaaaaagttaaatgaaaaaattcaaataactgacaattaaagtaaaacatacagtaggaagcaattggaggagtttctcgggccagcaaggattggatggttttgctcctttgcactggaccttgtcttttgatatttgctggaacttcacatcacggaaatctacaacctgatccaagaaaatattataactgttcagaaaagaagctacctagaactgaaaccggcatttggtctcaccagatcaggagtaatatagtttgcaggatctccaacttcgtacagaagctgttctgcacatgtgctgtagcttagaagacctccgctgccctctgcctttccaacaaacacttctcctttgtaactgacttcggcatatggaagagacaaatccagaagctgttcaaaagaaaaatctcgatatgcatctcctgctctttaccacaagtagagcataaaatgaacatgaatcataactgtagtgaaaaatcatcatcctagtgattttgaagaagaactgtaccagggtgcatgaaataccctccagtgagttggcatccacattccaaaagatggctagccaatgtcccttgtgacaactcctcaaagtcattccaattccaacctaattcatataccttatgttgaaagggagagaggaaaggattaactaaacaaatatggtattggagaaaatcagccttaattgcattactactttgcataatctaaagaaaatgagcataacaaaaagctgagtagctgacaaaatgacagggtcagcttttatatatcaaggaaaccagaagaatctccaaacttatgcatcatgtttaatttgagccagttaccataaaacatatgtcaaatctttgtgtatttatccgcaggatagacatgctaataactgagctttcgagatttcctaatcacatattttcttttacatgcatgttgcaaaacaattcagaacaccctgttcctgaagcaatatccactttaacatttacattggcacaaagagagttaaaatagtcattatattgtttgcgaacataagaacaactgaacaagctattcaaagcataccataggtgctaagaacagcgcagcatcagcaacccgagaagtaataacaacttgtggtttgccattttctaggcagtgtacaattgaggccacaccaagatatgtgcttccgcccttcacatacaacaaaactaccatcaaatagataaccaaaataggaaattttggttgaacataagcacatttgagtgaaaaatggttaaaacaacacctgtatcaaaataaggcaagagaaatatatgttaataatcaaaactagggcatagcatctcctgatgagtaaatttctatttgattaagtttatctacatctcccagtaataatcaaaagtccacctcatgtgaccaaagttttctatggctgaaccacatggcacgtacattaaaaataggtaactcgcataatgtaacttcaaaattttggatgctactgaatactgatcaattgtgggtaattgtcgtatgtttaaaaagcattaaggttgttagaaggaaatggactaacatgatgtcaaaacgtgtcagagaaatcaaaatagattacctgtcgcaccccagttgattcattagaaaatacagaatttcctgaaaaaagagccaaactaagcttgaatccagcttgaacgactgaatcatgtaacccatgctaggccttactagcacaagaagaaaccaaaagtacctgaagatgtttcataagctacagcgactgttatttccaatcccaaattagatgccagctccagaacttcttcttgagctccaagtggatccactgataaattccaaaggcacatacattatctaaacaagcaaaagaacaaattaggcaataccaaactatagtttgcaatgtcttaccagcgcccatgttagttattatgcaaactcctctatccaaggctaagggtagaagcacagacagccactccttaactgcatgtgaccatattaagaaaaggtgcactaaaaaagaaatcttatctaaaatactaaacacaacacagtaaaataaatttctagtcttctcctccagagaaaaatacacaaataagctatacagtacaaaaatcacataagcttctctatgatttggggcaaagtactctccacaatctcaaaaacagagaaaacagatactgcatacttttagaattgaaaagtgtatacctcggggatcatatccttttcctcccgacatcatgatttggtagcgatccacgagagttcgctcggccaaacactcgagcacaaggtagttaagttccttgactctctccagcaacttgagagcagccatgggccggtcacccccaaatccagcaccacagccaacataaacggtgtccctgcaccgctgaggattgctcctctatcaaccaatagcagtatcagccgaactgaaccatccatttcactaactcgcataattaacatttaacagattttttttcaaattatatagcaagcactaaccaactggaccacacagtcatgaagttcttccattgttactgatgcatcccacggcaaattattcctcagtgaaccaggagcggaactaacagattgctcttaatcagagaaaaatccggaagaagctggatgagaaatcagtccatgtaaaggatggaattctcaaatctatgccacgccgagacatgaagtggcgtggagtggggagtaggaatacgagagaggagtggatatatacctccgattcgattcgaggaccgcgatgggggggccggccgcgcgcgtcgctgctccagacctgctcgccggcggccgtgctcgcgagagaggaggcaagggggcggggccgtcgccggcggggagcgcgcggaggcgagacgacgctggaggaggggggaaaagctgcacgtgcgtgcctctcctccggcacggctatgctgatcggagttcggagatggttggaggcaagggcatttttgacatttactatttttaagtctattttttaaaatattaaaatgtacgaaaccatttaatttcacgtaacattttacacgttcaatcttattaaaaatttagtttaaatatgtaaaaatataagctaattttatattttctttttatgataaaacaagtaaaaataaataatatttatgtttatacttttaataaaataaacggttaagcgccgggttaaaaatcagtagtgttgtatattaaaaataggagggggtaatattgaaatgttataaagggaagattttagtcatatggtccgtgataatttaaatgctaagggcaaaaacaacataaatttctcaattagtaaataaggatttactcgtgaagttatgttgaaagagtatgaacgagagagattttgggagagagtacgaggaaggaaataaaaataaaagaattacctattaatctatttgacatttggcggaaacacacaatttttttttataaatttgaatcgttttaagatttatacagtaccacaatcttaatttctatctcctccctcctaactctcacagtcccacatgctgccacttctccacctccgcttcctcactaggtcattgtgtgtggcctcgctagtgttagcaaagcttatgtgtggcttcgctagtgttagcaaagcccatcatacattctctccctcgtccccgcctatcctccttaacccggtggtgtattcctgttgtcttcctcatctttgacggctcccctcgcttgttgcatcgtcactgtctctacctgctaaccactcactctattttatccctatcatcaataccgacccactataacaccactcgcagtcgactctttggcttaatcatcgccgccgtctcaccgcccactacgaggctaccgccactcaccgctatctctttaaatccgagtaactttctctgtctccgcctatacctcatccctgatagccaaccggtcggggtcgcagtcgttgaaaatcaacgagcttgccagagtggaaagaacgatgtaatgtgcacgaatctcggagtgtctagggtcgaaaatctgccgaatcgggcttaaattcaaaagaaaaagataaaaaaaagaagaagaagaagaagaagaagaagagagaaaatggcgattacccccgtcgattccccctcccctccatctccgatcagcagagccaacctgcacttctcccgcctcctcgcgctcccggccggtgacggcgagctggctctcggtgttaacacggcgaccccccaccctagcatcctcctgtgtgtgcggcctccttgcgagcaggtctggagcggcggcgcgcgcggccggccccccatctcggtcctcgaatcgaatcggaggtatccattcctctctcatgtgatggcttggcattggtggggattttgtgctctgctgatgctaattggtagtagtaatttggtactgcgcactgaactactgatgatgatgttggaaaaccatgacggcagttttatcactgaattgaactagtagtgtgtggcaacttctgccaatctacctggaatgtgaagtttctgcagataactaataacttcgcttctgccaaatttcttaccctcacattgattatatttgtttgcttaattgtagatagtacttcagtttggaaaaatgtcaggagattaaaattggtggaagccacttggcgcaagtgctactcttcactcttcagtcactgaataatgaagtatccctgtacaatgaaaaggtatttctggcattttatgatgagaggataatcaccttttttcaggaataagtaaaagatttgggcatcattgcatcaagccgaacaaaaaggtttataaaacatcaaacacatcctgtgtgttgagcacaatggtcaaacgactggaacaaaggaaaaaaaaaccgacaattcgacctaagctactgacagaaactaaggaatcagactactaaatgaggcaagctcttactgtgcgacccactaattcgcttcttctgcaattgacgcaatgatccaagaacaagcacttttgcagaagtggaggtgagacatctttgcaggggttggcctgttgacaggaagcctattgagtttacaaaatggtggcatggtgtaatgttgtaatattttgctactcacttcagtttgcagttaatgagttttggagtaatcatagcattagccaaatgttttctgacatagcaaaggtctccaaggtctcaggctctcagcttaccatggcagacctggtcttactgattgtgcactatttcctcatagatattccccttctagcagtaatagcataattcccttctttctgtggaatttcgtatgttcaaattatttcaatattgcctcagttttatactttgctggtgttaattgctactgaactactgataatattggaaaacctggccttatatggaattactgaagtaccttcccttcgatctcagtttaccatgggagacctggccttactagattgtgtactagtttctggtcatagatgttccccttttatgggcagtaccttattaataatcccttttctttccttttgacactgacagtctttaaattacttcaatactaacgaatttgctagtgctaattggtactgacaatgttggaaaaccgcagcagtaattggtgtggcatgttctgcctgagatgttcagttaataacgttgttccagtctactttgttacactcagattgcctttttgtttgttttactttaggtagtacttcagtttgcaaaagacgatgatattggatttggtggaagtcactcggcacaagtgctgctgtcaagagacaggaagctgacccctgtacaatgtaaagtcattgctgccatgcacaggaatcctgtgcatatatgatccaagatgcaacactttcgcacaagcggagatcaggattcaggagataagttcagcttactgaagacctgctgagttcagcttgaagttgacaagttttgcagaaatagctgactcttttttcacattggagcctgtgaaactgttgtaaattcttgatgacgctagatctttttgttttgtatattcttcagtaaatgtaaatataatgtaagatgcacttttaagtacgaatcctgatataaggggcacagcagctctgttttgcagctgctagtatggtggtcatgtaaatcgatgcaagaaaagcaccagggtgtcagtggcactcgtgctatagttgacatttgcagtttaataaaaagatgaaatgattgttctatattctcagtcataccatatgtcatccattgaggttaaaaaaacttttgtgatggatgattgtgagccttttgttgcatgtgatcacttcagtcaataattcagtaacaatggtgcatgcttataaccattgctcatggtgaatctgaaactgctgtttttggagcctgttgtcaattcttgctcatatgtaaacctgaaggatgacaacatgctggcttgtttgcttcacaacctgctgattatatccatactggggcaataactgattgtgtacttcagtacttcagaagatacagataaggaaacagagaaagaactccaactgaatgtgcaccactcaagaagtctgacagatcaatgaatagaattgggaatatatttattgaacagggaatatcgttacaataatgttacttacattgaatccaaccaatcaacaaataactcatctttgcatagattagtcaataaactaagggacatctatctactctgccctacatactacacaagaatatcaacaaatatcgcctctgcactacagattacagctcttcttagaaagacaatgtcaatgccagtgttcttggtggctagctatctccaggatgctagctagtctgcaagatcgaagaggtcgtccatggagaagtcgatgcagctcgtgtcatcggtgctgacgtcgatgtagctgagcacctcgtcaatgctctccgggaaatccgaatcacaccacgccggcaccgcctcgccgtccatggaggaggaatacttctgcttgtccatgaggttcaccgccgctgctgcaccacctccggtgtcagcttgctctagtggcaggacgatcggttcggcgtgatcacggaacaccgtgtcgatcaacgggccggaggagctctgatcggcgccatcagcatccatcggcagaggatcgtgctgtggcggagaccccagctgctcgaacatggcggtctctgacacgccaccgtcgttgtcagtgtgggcgccggcagtgaagtcgatgtagctgagcgcctcatcagtgctctctggaaaatcgaaatcacaccacgcctgcgctgcctcgccgtccatggaggaggagtatttcagcttgtccgtgaggctcaccattgctgtggtagtctctgctccgcctccggtgtcagcttgctctggtggcaggacggtcatgtcggggagatcacggaacgccgggtcgatcacgccagagcagctctgatgatcggcgcaatcggcattgccaggagggagatccaccattgccacgggcgcgagcggaggctcctgctgctcgaacggggcgctctctgacatgggaggccagcgctgttgccaggagggctccatgccggcggtgaagtcgacgtagctgagtacctccggaaaattgaaatcacacaacgccatggagtagttctggttcaccactgctgcggatacggtggtctctgcctctccggcgtcggcttgctcacagaacgccggatcgatgacaccgtaggagctctgatgatcggcgcaatcagcattgccaggaggcccttgctgctcgaacagggcggtctctgacatgggagtgcagggcgtggcgcgttccatgccaccgtcatctggctcaggtggcaagacgatcaggtcagcaagatcgcggaacgccggatcgatgacaccgtaggagctctgatcgtcgccatctgctgctagcggaagaacgggctgctcggacatggcgtccgtgaggttcaccaccgctgcggtagtctctgtagtgtctccggcatcagcttgctccggcatcatgtcggggagatcgtggaacacaggctcgatcgcgccggagaagctctgaccagcggattcggcgcaatccacggcgctcggctgcacgaacagggcggtctctgtcacggcgcgccggggcgcggcgcgttgtccaccgtcgacgtcgtcgtcatggacgcgggcgcccaggcgttccggctcccgcttgcgcttcttgccgtggccgctgaaacggacgcggtaaagccggatcggccacgaggcgagatcatcgggcgccgtgatggcgtactcgtgcatcacccaccccgagctgcccctctccccctcggcgaagaagctcagcatgtacttccgccactcgatctccaacccgccgccgacttcgccgccgccgtcgccgcctgggacgctcagcctctcaccgtcgacgcaaacccgctgcccctgccagaaccccccaccctcgacggtacgcttctgccgcttccccttgacgttcttggcgcgcgcctcggcgaagaagaaggcctcgtcgccgccccggccgtgatcggcgaggagcatccatggcggcgcgccgaggggatccgcctcgtggatgacgccgtggagcgggatgggctgcttccggaggcgccggagcaggtagcgggagacgagctcgtcgtcggcggggtcgaacctgacgcccggcggaagcccatccgccgccgccgccatagccgcctcgatcgctcgaattctagggttttgggggtgaattctagggtttggggggaaaaggagggaaggaggcgaggagaggcggaagcgtgtgtaacggggctggatttgaatttatcagatggggtgacgtcagcgcgacgcgaggccagcgtttttctcacgcgcgcgccttctcctctgccgcgcgagcaacttcagggctcagtttgataaaatttgagcgatttggttttggaagaaagtttctaaaattcgagcagaggtttcaactatcgctgatgctatgctccatgcgccctgcaagtacttagtcctgaacttctgaagatttggtacatgtttctcaacttctgaaggattttgtccctgttctgatcttctgaaagtgaatttggataattgaacttctaaagacagtcaaattacaggagaaaaaacagagtattcctggagattttaacagagcatctcttgaagaataagtttgattttgagcgtgtgtttttttttaactaggactcccatttctcttactagaaatgagatagcgattacaaaggtctcgtaatattttgagcgtgtgttttcattcagtttcaaatatatgtcgtgatgatgtgatagatctgacgagaatagccttgctctcaacattgtcaatgtcccgctatttttacccttctcaggactaaaaagttcagaaatgaaaaccattcagagtcataagaattcagagaagttcagagacattttgtaagggacaatttcttatttgaccctgttttgaactgtaactgccaatttaaccatactttttgaagtttgcttatttgaccctcctttttgaaaacgaagctgccgtctgaccccccctttccactactccgttagggttgaataaaagaaaagaaaagaaaatgctactaatattcctaatgcccaaaataccctcagaaaccctatccatctctctcatgtgacactctctctctctcgttcgaatcgtgagtcggcggcgatctgctcctgcggcggcggtgatctgacggggcggtggaggagctcatctgaggggacggcggcggcgctcagagtgcgcttggaggagctccgaaggggcggcggtgggcgtcggcaagggggcgctcggccggcgtcgacgagggggctgcgagggggccgcgacgggcgtcggcagcggagggacgcggaaagagcgggtccgtgccggcaccggctcgtggagagaggaagcggcggcggcgcacggaggggacgaccggccgtgccggctcgtgggggacggtagcggcggcggcggaggggctcggagggagcggatccacgccggtgcagcctcgtggggggatagagcggcgacggcggcggaggggcatggagggagtaaatccgcggcggcgccacctcatgatgggagggatcgacggcggaggggcacggagcgagcggatcctggccggcgccacctcgtggagggagggagaggcgacgtgcgggagctcggcggaggaagctgcggcggcgtgcggaggaagttccggcggcggtgatgtggcggatccggcgacggttcgatggcgatgaggcggatctggcgatggctcgacggtggcggcggcggctgcgctgttcctcgatctggacgcggaggacgagttgcggtggcgatgctccttctcgcttcgaagaggacagagacgcggtctttcttgttccgaacaaggaggaagacgacacaaacgtgtgaataagaagggcacaaacgtcatttcttgtttaagttaacaccgttacgttgatttaatggaaggggatcagatctgatcttcagttttgaaaatgagggtcaaataagcaaacttgaaaaagtagggtcaaattggtagttagttaggttctaaaacagggtcaaaagcgcaattgcccctttctgtaacggagtgaaatctgcatgcatttcaccggtttagagatttcgattctgatggcctcatgggcactttacacataccagatgaaatgaagggcagagtctattagtgctcacttttctcatgttccttatcatatttcagctataagggtttgatatgttaatgcaatataatactacctcatatgtcattcctattgcccaacagaaaacctctatttacattaaaaatacaatcagctgtttatttgcaaaaactatcttgacacactattgcaagtcagacaagatcagcaactccaacgtgtttgcaagaatattatttatgattaataaagctctctctttcttattaaaaaaaatcttcgctcaatggaacaataaatttttgaaaaaaccttaagtattcgagaccattttcatcatatgcacttagccttccttttggagaaaagattttcttttcagttttgctatttcacttgcgacggatctttaggctcctgtctttcaatttttcttttgtaggatcttgtatcaagattcgtgttcacgtatattcaacttgcagttaaacatagttacagtgcaccaaaattagattttacaactgttgtctctagatttatgatttttttacatgtttgtccttttttatttgattcaaaatgggttgtatctattggttgaaaattctacaagatttgaagttccaaatccgtcgaaagatcatagtccatttttttcccctcaaaatcgttctccattcacatagaaaatcctccaaatatcaccctttccaaaggacgcttgctggtgccggcctacgttgttgaggcgcaggtggcaggagttagaaagggggcagaggggtatgtgtcgcgagaagaaaagagttctagggctgtgttcggttggtagtgttgggaactaatctctcacgcattaaaaatggagtgactcgttagcgcataattaattgagtattagctatttttttgaaaaatgtattaatatgattttttaaagcaactttagtatagattttttttaaaaaaaaatacatcgtttagtagtttaaaaagtgtgtacgtagaaaaggggctcgggactggtcgtgcccaggcttggccgggccgggctgcccatttggctacaatctcattctagaattgtgggcaacttgatccacgcaatgaaaccaaatcaacaccctctaggaagatggaagaatctgttggccctttggatcagacgacaccttgctgatcttgtctgacctgcaatagtgtatcaatatagcttttgcaaataaacagcagattgtatttttggtgtacagaaaagtttcctgttgtaaagcacaaaaggatatagttgcgcaataggaatgacatatgaggtagtattatttatattacggacctcttcactttgatgctaaaaaaaccttactaaaatttggcaatgccaaaattttggtaactataccaaaattttggcaggatttcttatatagttataaaaatttggtagcaactaaatgtagctatttttttggcaactttaccaaaatttgttaaggttgaaaatgacatcaaagtaaacaggccctacattaacatataaaatgcttatagctgaaaatatgataaggaacataagttttttgttgttgttgttgtcgtcgtcgtcgtcaagaagccttctttgaacttctctgaattctgatgtccttgaattgaaatcgccgaaccgatacaagtctgaaggcttcattccatttctgaacttctttgaattctgatgactcggaatgatttccatctcttaactttttggtcctgacaagggtaaaaatagcagaaggacactgacaatattgagaacaaggctattcttcgagagatgctctgtaaaaatcttcagcgatactctgtttttccccttccattgaattatcccaatataattaccgaagttgaggacttggataggataaaatcttcagaagttaaggaattggtacttgcaaggtgcaccgaagcatagcatcagcggtagttcaaatctctagtcgaattcagaaatgtctctgaacttctcttcgttaaaaacttacaatccctgcagacttcacttcattacagaaagacagaaatgtctctgaacttctcggaatgctgatgactctgagtggttgagatcagaagtacttcagacaatactctgtcccccctcttcttcaattaccctaattctactttcggtatccttcagaaagttcagaacatggacaaaatctccataagttcaggacttggtaaaaacagcagaaggacactgacaaacctattcttcaagagatgttctttaaaagtcttcagcaatagtatatactttttctcctgcaatttgactgtctacataagtactagcaacactcttgtcatccctccaattgaattgccccaatgtattactactattttcagaagtgcaggctgtacggagcttatcagcagcagcgatagttcaaaccactgcttcgattttagaaactaatcaaaacaagttccaattccaaaaccaaatcgcacagatttcatcaaacttccagaagaagaacacaaaaaatccgcaacccagactcaaatcccctcaaccgtcgctcgcgcgggagggggtaacacgcgcgcgtgagaaacacgctggcctcgcgtcacgctgacgtcatccccccatccgataaattcaaatccacagcaccgttgcacacgcttccgcctctcctcgcctcctcccttcctttcccccccaaaccctagaattcccccccacaaaaccctagaattcgcgcgatcgaggcggctatggcggcggccgcggatgggcttccgccgggcgtcaggttcgaccccgccgacgacgagctcgtctcccgctacctgctccggcgcctccggaagcagcccatcccgctccacggcgtcatccacgaggcggatcccctcggcgcgccgccatggatgctcctcgccgctcacggccggggcggcgacgaggccttcttcttcgccgaggcgcgcgccaagaacgtcagggggaagcggcagaagcgtaccgtcgagggtggggggttctggcaggggcagcgggtgtgcatcgacggcgagaggctgcgcgtccccggcgacggcggcggcggcgaagtcggcggggaattggagatcgagtggcggaagtacatgctgagcttcttcgccgagggggagaggggcagctcggggtgggtgatgcacgagtacgccatcacggcgcccgctgacctcgcctcgtcgccgatccggctttaccgcgtccggttcagcggccacggcaagaagcgcaagcgggagccggaacgcctgggcgcccgcgtccacgacgacgacgtcgacggtggagaacgcgccgcgccccggcgcgccgtggcagagaccgccctgttcgtgcagcagtcgagcgccgtggattgcgccgaatccgccgatcagagcttctccggcgtgatcgagcctgtgttccacgatctccccgacatgatgccagagcaagctgatgccggagacactgcagagactacagcagcggtggtgaacctcacggacgccatgaccgagcagcccgttcttccgctagcagcagatggcgacgatcagagctcctacggtgtcatcgatccggcgttccgcgatcttgctgacctgatggtcctgccacctgtgctcgcgcagcaggagcctccgctcgcgcccgtggcaatggtggatctccctcctggcaatgctgattgcgccgatcatcagagctgctctggcgtgatcgacccggcgttccgtgatctccccgacatgaccgtgctgccaccagagcaagctgacaccggaggcggagcagagactaccacagcaatggtgagcctcacggacaagctgaaatactcctcctccatggacggcgaggcagcgccggcgtggtgtgatttcgattttccagagagcactgatgaggtgctcagctacatgaacttcaccgccggtgcccacgacaacaatgacggcagtgtgggacgcgccgcgccatggcgtcccgtgtcagagatcgccatgttcgagcagccgagcgccgtggatctccctcctggcgatgctgattgcactgaatccgccgatcagagcttctccggcgtgatcgagccggtgttccatgatctccccgacatgatccgtgagcaagctgatgccggagacaccgcagagactactgcagcggtggtgaaccagaactactccatggcgttgtgtgatttcgacagcggcattgacttcaccgccggcgcccacgacagcggcatggaacgcgccacgccctggactcccatgtcagaggccgccctgttcgagcagcaagggcctccgctcgctcccgcggcagtggtggatctccctcctggcaatgctgattgtgccgatcatcagagctcctacggtgacatgatcgtcctgccatcagagcaagctggcgccggaggcggagcagagactaccgaggccctgttcgaccagcccgttccgccgcttgcagcagattgcgccaatcagggctcctacggcgtgatcgacccggtgttccgcgatctcgccgacttgatcgttctgccaccagagcaggccgacgccatggacggcgaggcggcgccggcgtggtgtgatttcgattttccggagaacattgatgaggcgctcagctacgtcgacttcaccgccggcgcccacgctgacaacgacggtggcgtgtcagagaccgccatgttcgagcagccggggtctccgccacagcacgatcctctgctgatggatgctgatggcgccgatcagagctcctcctccggcgcgctgatcgacacggtgttcggtgatcacgccgaaccgatcgtcctgccactggagcaagctgacaccggaggtggtgcagcagcggcggtgaaactcatggacaagcagaagtactcctcctcctccatggatggcgaggaggcgccggcgtggtgtgattcggatttcccggagagcattgacgaggtgctcagctatgtcgacttcagcaccgatggcgcgagctgcgacttctccatggacgagctcttcgatcttgcagattagttagcatcctggagatagcaagccaccaagaacactggcattgacattgtctttctaagaagagctgtaatcagtagcgcaaaggcgagatttgttgatattctggtgtaatctgtagactagaggcagagtagatagatgttccttagtttattgactaatctatgcatagatgagttatttgtttattgattgaactcaatgtaagtaacattattgtaagtaatgaatatactcccttttcaatcattatattccctattcaaaatcaatatactgcattgatctgccaaacatcttgagtggtgcacattcaatgaagttctttctttcagattcagtgaagtgctgattctttatgagtggagtcataaatatcccaaatatcccaagtaaacattcagttataactccggtgttgttctgacaacacctaatgttgtcagtatggatatagccagcatgttgtgatccttcaggttttgcataacatggatataatgaaataatccttcaagaattgacaacaggctccggaaacagcagtttcagattcaccatgagcaatgtttataagcatgcaccattcttactgaattattgactgaagtgattacatgcaacaaaaggctcacaatcactcatcacaagaccatcttgaccttagtggtgatatgtgatatgattctgacttctgggaatatagaacaaatattcgaatcacatccttttatttgcactgcaaatgtcacttataacacaacgaccacactagcagctgcaaaacagagctgtagttcccctaacttatgtcaggtaccaggatcaacacttacaattacatcttacattatatttgcatctactgaaatactgaaacgaagacatctatcatcctcaacaatttacaacaatttcgcaggttccaatgcaacaagagacagctatctctgcaaaacttgttaatgtcaagctgaagatatgacaatgccggaccattcactgtgccatcattttgtgaactcagtaggcctccaggtctcatctcctgaatcccaatctccacttctgcggaagtgttggatcttggatcatagatgcacagggttcctgtggatgggtgactttacattgtacaagggtacctgccaatctccagtcagcctcctgtctcttgccagcagcacttgtgccaactgccaagtgacttccaccaaatttagtatcatcatctcttgcaaactgaagtactacctacaattaaagaaacataaatgcaatctgagggtaacaaagtagatagaacaaagttattaactgaaaaaatctcaggcagaacatgaacaccaattagagtcacggttttccaacattatcagtaccaattagcacgagcagattcgtgtgtactgaagtaatccaaagatataaaattaaaaacgaaagagaagggattataaataagatatttctggtaaaggggagcatccatgccgaatttcattatatacttattcatgattcatcctttcctgtattaccaagaaacagaaagtctcatgacagtgagtttgcctaacctctgtagccacagaacatgccatccccaatttggtaggattactgggtcagaatcagtaacggaataacaccagtacaccacaccctcaatgaagcccattaggctatgcttccaaggctgcagttagctgttcacatgaagccaccaatacgtcatacgttagaggatatattagctacaaagcaatgataactcaaactggcccccacgaaactttgagtttcgcaagtttcaaattcaatgaagtatgatattcagcagtaggatcacaacgcattctgcatccaggaactaacaaacttttttccagtcgtttttgacctctgtgctcagcacatatggtgtgcctgatgtttcataaaccgtttgtccgtctcaatgcaatgatgcccaaatctgttgcttattcctgaaaaaaaaaagatgactatcatcccatgttctaataccagcaatacctttacattgtacaggggtacttcattcttcagtcttcagtgactgaagagtgaaaagcagcacttgtgccaagtgacctccacaaattttaatctcctcaccttttccaaactgaagcactatctacaattaaccaaacataaaaaatcaattcaatttgagggtaagaaagttggcactaaagaagtaattagttatctgaattctgaagaaactgggcattccaggcagaagctgccacacaccactagttcaatacaataatgataaaatcgccgtaattgtttttccaacattatcggtagtagttcggtaccagagacaatattgtagtaactttaaaatatgccaaattcaacagagagaatgggattatgcatttatgctcatgcctgagatgttattactgacagaaggggaattttagagtgaattgcaccttgagccacctttgattaccattgttacaatttggactaggttaaagccaaacttttcactttgggccagatatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccacgctcaagctcatgctcgacctccgctagtgctacatgttatgctgcacgcctgcgctaaatttccacatgtcgctcgagcttcaacaagttttgcagcgctcaagctccgccttcgtagtgccgcctgcatttgagctcgaaatcaactttggcgggtggctaccctgtgaagggttttgcttcttgccttttcatgcactacacctgatcgagaaagagaccttgagctgtacaaagaaaagagaggaagaaagggagctggaggaagaagaagagagtctaaattgaaactttgtgtaaacatacccggtccaaagtgaaaagtttactttttcactggtccaagttacaacacaggtaagaaaaaatagcccaagatgcaatttactcggaattttatctactgtacgagagaaggaaggaactagtgcatagcataatcagtaggggtgcgaggtctccgatgctaagccgagaccgaatcgaggggaaggctacatgggagagcgtcagggttggggggctgggggcattgcgcaacatcccgccggcttcccagtccgggttcgcgcccccacgggccacggcgtcggcggcgatggtagcggcggcgttgaacaatggatggaagagaaagagaccaagtaataccggattaggtggaaacggagggggagagtagtaggatgtgcaccggagttggagaccggcggcggcgcggcgatggctggagcacggcggtattggttggcttcggctcataataagccaaaaaaaataggagtataataataacgaggcaatggtaatttttatgtttcacctattggcggtttaaaagctaatattaaagaaaaaaaccattgaaaaagtgactaaaataaattaaaatgaattttgaaaatatttaattgtgtgtggtgtgtggggtggggggggagaaaaattatatgtttaagagtatttgtatactattttgcttcaaatccatccaaaattccaggcaataatcgtgatgatgaaatttaaataaatttgcctccaagatcgaacataccaaacggcagaatttcggtttttatttgattaccagtagtcatgcacgtgcaatgcgtgttttcatatatgttgtttcaaaaataaaaatactggattgttgcttcatttccatctctaatgagaattatagttacaaaagcgataaatttctcctaaacaactgaagtttacttcataaataaatgacaaataagggtctttatttgaaaacaataatttgagtatcaatcgttgtttacatatgaaagccatcacaagttcataaatctgtgaggtattagttactaaaggtatttttcacgttcatactgtcgtgtacttttaagcaacctaggaaacaaacagagcaatgacatgatccatttttcttgtgtgcttttcagggtagattctataattcagtgattcaaattccatcacaaccaactttcaggtttgaagcgtgattcagataataccatatacacgttaggaactccacaccatgttctaatattttcttctttagacaaacaaacacacgcaagttttaggtgaggtttttttctcctaaaaatgaagatgaatataaagattaagtttttgacataaaacaagatggtattaacgtatgattgattgagttttaattattacaaacgtaaaaaaatagattaatatgatattttagagcaactttcatatagaaaatttttgcacgaaaagcaccgtctagcggtttgaaaaacgtgccacgaaaatcttaatcttcattaaactcttgttggagaaaagaacgggacataattaatacctcaccaagaacacctgtagtttctgctacacaagcaggagcatgcttagcattatattatcaaacatgatgaagggctcactgctgtactgttgagctaccgtagagcactatacttagccatcttccagattttttgctactacaaatctgctatagcaaagcaagcataacttaaaaaaaaggggaaaaaaccatggtgctgtcaggatttctcaaatctcccaagagaacatccctgctttacccagatattttttttaactgataccggcaaaaaaaaaaaaaggagtaactgtagatatcctctcgccatagcaatctgcaacaaatatatttgctgtaagctcaaaaatgaacatctatctgctttcaaaagggaaaaaaaacagctaatgaaatataaaaaatctgcatatcctttcttttccctgatcagaatatttttcacaatgctctaccaatcccgactttctcattgccatttctgatggtgctatcaaatccacggttgctgtcatccatatcaagccacgcagtgctgacaaaggaaaagattaaaaaaaatagagtaaaatacaccagtggtccttaaacttgtcaggaggtttcacttgttgggatacgcgtaggctacgatagcataaatcaaaattttctatcgcgtaaaccaggaaccatgcaagtattagatcataaatcgttaccgctcgacgcgctgcgcagcggaagaagacgctgagaagtcgaaggaactctcacgaagtagcgcgcgtcgatatagaggaagtagtcaatcgcaccggctcgaccttctccttctcgtgcgttctcctcgccgtactcccacgctgatcaacaccgcaaaccagcggcgcctctaccggtatccacacgtatagggacagaacgctacgcgcagatgtgctagcacccgcgcgcggctagggttttgctcggggagggaagtgacggctagggtttctcacgtaatgcaatacctcctccggtcacacccctcacgaatatataggatcaatcactcgggcctcgaaggtccgtaggactcctatctgaattaagctcatattggatctctatacaatccccttattccggcccattaagcgtgcgaccctataggttcatatatactcgactgtaacccgaaaactccttttcggtccacgcgtcaacagcggcccctagcagaacgtattgacccaccgggcatacataaagatcatatcggctgaacctctagtgtatacttgtatgaacccctttgcctcacaatatcgattaagctcaaggctagatatgtgccattctctaatagctcaatcattcgctcgaacatgttgatagattatataacttgtgattgactcctcaatcacctttggcatggccatgcacttccataatctacatcatcgaggagcccagagatatctctccataggaggggcaaatcccatcttgattattcatatcccactacatgtttcatagcatacccgaaaactacttttataactacccaattatggagtagcgtttagcagtccctaagtaagctactacacatgttgagaaccatgataatctcaggtctaaggattcaacaccaacactcaatgagatcactgatgacacaacacatatggctcttgcaatgtctcatgttgggtctatccaacaacatgttcaccaacatgtgtccacattattaatttggtatctctataccatgatccatgagatatgattatcaattaatacatgtgctgatcatataaacatatttgttccacatatgatatttgatcagggatcctttaaaaatagtaataaacaacataaagagtctcatgaaataatcacatattcattaaccaataaggagttatctatttcaaggaacaatgtcggataaatatgtaaacatagtatgtgatacatatcatctctatgattgcctctagggcatatcactaacatcacttaggtccacaaacttgcatagtgcacatcgaagtccctaaacttggtttattgtatcatcccggtccaaagccacgtttgactgtggttgacatagaatttttttatattttttctcgcttcttccttcttttttctctttcttccttcttttttctcggtggtgagaggcagcacgaggtgaggggctgtcacagtggtgaagagagaaaaaaataaaaaaatttcatgtcatcgttcacgtcgcgtgccacgtaggcaagaccgcggtcaaacgcggctttgaaccgggatgatacaataaaccaagtttagggacctagatgcgcgctttgcaagttcatgtacctaaatgaaacctcccaacaagtttaaggaccgctggtgcattttactataaaaaaataagttgaatgaaggatactgtatctgagtgagcattccatcgagcaacttgtgtgcaacacacagagggacggagagtaccgtaagaacatgtggagaagaaatgggggaggaggcagtgttgaacattggcgggggcaggcacctcctcggagcatctccttctccgaggattcagcgagcttcagttgtgtgaaatcgtccatgaatatgcattcccaggttaatacatggccagagggagctgcgagagggagcgaaagcgaaaggagacgcaccagagaatctgatggctgtggaatgtttcttgaatctttcctgctaacaccgtgattttacgtattcgctatgcatttacgattagtcttgtgtttttttttaggagatcagatagcattgtcgtgtatgcttcgtgcatcaccaaactagtatcattgatatgtcacgtgcaattggagtaccgtcagatgtcctttaagcaggctaataaatagcgttcgtagcggccgctatagtggcagtggacctctaccgctaccgctacaatgtagcatactgcaaatagcgtattagaatttagcggccgctatagcacttcatgaccgctatagcagcccgctatagcgcttcacgactgctatagcagcccgctattgattttgttggattgctataatgattaaacggtgtgcttcacatatggatagaataacttagcattgtataccttcttttatcttatatatttatatgttactagaaaagttgcccgtgcgttgcaacgggtgaaggtatgcggtcggtagtacattaaggtgaaatttactgtgggaattcacttggatatacatatatttttagaaaatcatgagtgcagttaggagtccgatagtctaaagttaccatgtgagtttttttagtgagatgtcatatacgacgacttctatatttccaaaagcgaaataacttaaaaactaactcaaatacggatatgtattatttccaaagcgaatgaacttaaaatccgactcatacatggataacatacttaaataccgacaaaaacatcttcaatttttataatagtagagatttcataatttttatgttatgaaatgtaggagtaattaaacatgcagtctaaattttaaattttaagtgaaacttgatgttaatattgatatacaatcttaatttatggtcatttttcttaattctgttattgaaacttagcgtctgcaatagcgcctgctctccacaatccgctacctagacactaatccgctagcgactcgctatatgctatttattactttgccttcatgtgaaatcgctgaaccacaacgatgcctacacacttcgctctgttgaggaaatgtttctaaaatatctatctatttttttttaacgatcagcaccaccagacagcacaatggttcattgaatagagtagggaaaacccctgaaaagcagtagccaagaaataaaaaaaaaaccactaccacgcatcggcaatacctacacacagccaagagaagattagcactgtacccgctgccgctaagcgtgaccggttaccactagaccaacaaggaagctacatcgagacctcctaacaccaagccatacgcagccaagcaccgaactcaactctagccatacctttgagattgagggggagagagtgacagaaaagaatggatcattctttcctctaaggccagccaacatggccaacttgcaaaaggtaggattgcgccacaagaggacaagatatcttcagaaagcttgcaccagctgtctgagagaatttttggcaaaaggacctcctagatgacatctccacggagaagagcgacgatgagcaatgacaccgctgtccgtcaagatctcggggagaaccaagacagggtttacactcagtagccccaccaaaagaaaggggacgactcgataatgccccaaagaggaaaaacgcgcttgaaacgcagttgttgctagtctggcaagactgagctaggtttacacccgcctcccgcctcccgccccctagtcgatccacagctaatgctccattgctccaccttcggctatcctccgtcagtgcgtggacactgctgcaccgagacccccgaccagcctccgcatgcttccacgtggcctctcgcggacagccgccgccagttgagcatcctcgcaccgcgccggctgtccccctgtagtgccaatgctactcggcgccacgtctgctcccgccgcaattaggccccaccaccaccatgttggatcgccgccctgctttccatcggtgaggtgggggaaggggggaaaggggtggcagcagggctaggtttcgcctcctgtgccgcccgcgcgtggtgacacagggtgggagcaggtctagctgtctgcttgtatacagattgaagcttgttcccatctctgaattctgatctgaatgatttctgtttctgaactttgggtccttcaaaaaagataaggtaaatgtaagtatgaactttgggtcctttaacaagggtataagacaggaggagcagatcatcgggagacagcagaaaaaggataaaggtaaatgtgagtatggcattaataagtggcatgacagcaatttcagcagttcgtatacatggtaaattgttgacagaaaacagtaaactctaatcatccaaaaagacatgtcgcagtatatatatacctcactctccataagaacatatctcacaagctaaatgttcagggtaaccacctgaacagcgttatccttgtcaacaacaaacgatctggttacctttcctgaaggcgttgctacttctaccgtgtatgacccatggtagcctctgaacttcaactctccatggtgatccacgttgccagtaatgctggttagccactcttgcttcagtgcaatgtaccttttgccagcctcattgatcgttccatcaacatcaaccaggtgagcgtgttctcggaacatgaacagctcccagaatccccaaaggataatcccctccacggaaggatgcgcaaaggcttcgcgaaggtacacctccagatcatcggctcggatgtgttcattctcagccgtgacatccaattcggtgatccagatagggagacccagtatggagagcttgtccagggaatcgcagatgatgtcacccactggatgcgtgatatgaccttgcaagccaatcccaccaactggagcacccctttcttggagatcaacaatctgttcaattaatttttctggtgtagattttgagtcgcatcgatcttcaacattgtagtcgttcacaaagagtactgctgaagggtcaagtttatgtgcttccctaaacatgtgagctctaatatcatttcccagtctatcttggtagaaagacccatgaagcatctcgttgtttacatcatgatgtttaaactgacctttgtaccttgacaacagactttgcaaacgattctgtatagcagccatcaggtggtgaccatgtaatgatcgaatccatggctggactgaatcttctacttcccagaataagcagtgaccacgaacttgaatgttatgtttccggcaaaattcaagcaactcatcagaatctttataatttagtctcccttgttcagcctctgtccagtaccacttcagttcattttcaaatacagcccaattaaagttcttcatgaagaaatcagcaagatcctcattctcaatgttacttctccctatgcatgatccaaatggaaaactgttctcggtctgttgtatcttgatagatgaaccaaaaaggtttgcagcatctgatccctggaacttcaggatgacatcacgcttccttacctatttgggaaaaagaaggaaatgtaacttcaatgttgcccacaatcactattataagcaaagcaatggatactttatagaataaaattttggtctaaaattgccatgaagaaaataaagattcttttcaagcttctgcagacataaatttatcatcttaacatacaaaagaagtaaggaaagtttaccttgtcagttttctccttcagatattcaaaacgtgcttttctatcaacagcataaatttggaaccccataactctgagatcaacacctggaggcggtccctgaacatatgcagtaactttggatggcttcttttcaagcttgaatgctcctttgagttcataccattgatcgccatcagcttctacttgcccaccattaacccactgatgatctacagcaagacaaacatttacatggtaacgtccatgtcctccagacccagcacgtacccaagcagaaactctgtaagtggtgtgcagcctaagcttgtcagttatcaactgggaagggcccatccacacatcagtgcggtttgtggcaagaatataagaacctcttatatgttgcttagctgaggggtccttcaagatggcagaaagcatatggggtgattcagtatggatactcaatcgacatgaccccatgggactccacccagaaagcccatgactgaaagcactgttatgtattacattagctccatatgaaacattctgcagtataaagaaattatccttgattcagaattggtgttcaaaatttcactgtccatcatcatgatttgataaacttctaaacatgtatcaagatcatttaaataagaatgttagtcagaaggaattagtttaaacctcaattcttgggcggggtgcagcatggagttttcttgctggagataggacaaggccatcaacaagaatatcaatgcctgcaggtggcccctctacgaaaataacagcttttgaaaacggggcatggaggaggaactttccttttagatgtgtccattgcttatcagatgccgggttcctttgtatacaagaatatgttagtaaaccagtctatgtttacaaaaataacgctgccacttgtcacagaaagtgtaaccaatgaaataagcatatacttactttgcaaggcttacatatcgctcacggccatattcttgtacccacagagtaacgcagacttctgtatcattggcactcccaaatatgcggacagcagaacttatctcataaagaacttttctctgtaccctgccagtgatatcttgctggataccgttccaattgtggacccgtccagtggctgaagcaaaatagctgccatttagaggcttgacatttccataagcagtaagctcatgcctacagatattgcatcctcttccagaccaattgtttaacccttcgtcaaagtgaggattcttaacgatggtatcaactccacttggtacttttacttcctttggaaagaaagattaagaagtaataagcatcggctaaaaaggcaatgtttgtattatatagcaggaaaagcatgaatgaacatatgatgagataaatccactgaaggtagaagcagacatatttaaatttgtaaaaaaaatcaactatgtgttacccctttgcactaaaaaacctatttgggaatacattaggtcagaaaaatagcaatggttcaaaacataaattttggctaagaagaattttagcactctacattcaataatcagtaaattcaagctagttgctcagcctcctaattatacttccgagaaacatgtatcacgccaagattcacatgaagaaaaagttaataacgtttcttagaaaaaggttaaagcaaatgctggtggaaaagcactcacttttaactgctgatatccagagcaagttacatttacggaatcaatgataaggtccacgccagcaggaggtccttccaggtagaatactacacgttttggcatatttgtcaagcaaaaggatccttccatcttctcccacttttcttttgaagctaacaggctattaaatcaagaagggaaaaattagaggagaggtgagaaaaaatttgatcgttgaacaacttttatgaaatgtaccttccaactggactgtagtgcgttgaatcatctgtgttatgcaacctcaaggttgctttaacttcaactttcgtatggatattcccatcaactctaacataggctgatactgcataagcagtaccagcagatactttatctgtaatatcttgttcaagaccttgccagctttcagttctcttcgaaactacagcataattttctcctgagctccctctaataccatcaaggaaaccagaccattgagatgccacatatgcatgacagcagatagggttccacaaatgaaggccttccgaaaaatcataatttgaaatgatgttttctgttccactaaccagtttggatgcagcccgctctgttttctacagaaactctgaagtagttagaaaatggtagcttagagtaacaaatccaatcgaataatacaatgtcaacctttaagcaccactgatagcttgatggggaaaaaaacatgacatgtctcaactacgcatagcaaaaactgtagtagtatgtactggcatgttaagaaaaatatatcatgatcacaattagtcttagtgtatgatttttcctcttctttgctatgactactgagaaatatggtgtggacatattaagacagcattaaatcagacttttagagcatgattcatatatcacaagattgctctgacatgaacataagcaaagagatttaaaagcataccttgtaggagatggtgactgaatctatgagcaagtctacaccaggaggggggccttcaatgtagaataccaaacgtcttggtagagtttttagttcaaatgaaccttccaacttctcccaacagtcttttgatgctgagatcctggtaaaacaacttcaactgataaatccatgatggtgtataatattctataaaatcaccttccagttaaaataccttgcaactgattgatagttcgtagaagaaccatcgccctcaagttttagagtggcctgaattccaacaggctcattgagttcaccatggactctgacatgggcagcaacaatgtactcagtaccaacagtgaccttttctgttatgtcctgctcaagcccttgccaattatgtgtgcgacgagtaagtacggcataatttgaccctgagtgaggccttattccatgatgataacctgatccttcaacagccacaaatccatggcaaccattaggatgccacaaatgtagaccttccgaaaaatcattgtttgacagaatgttctccatgacaactttatcggaagcgccgtgctcctctacttcctgctcaacattgtatgataaataaatttctgcattgctagtccatgtcattgggagaggaactgaaattcatggacagctaacatcctatcacacatgtagattgttagggactcgtggaactataggtctcaaaccatattagtgtgtatcactggatctgtatgttttttagtggtatctagttcatcctttcctacaatgtcaaactctacaactatacatatcttgcattccaaccttgaaatttaactcttaggactatatatcttgcaaacaatcaaaattccaaccatgaaattaaaagataattccatttcttattggtaggatctccaccaccatttttcatcaatcacactgtaaacacgccctgactaaacattccttgcgccctttgcggttggtacgcagtcaatcagcaagggatggcaccaccaagcaaaactatcctggatccttccaggtcagagaactagcaaaactcatttacccttggaagttggaaagaaacaaaggcactagctagtagctacggatgatatatagataccttggactcgagacgcggtggatctggctgcgggagcggggccgccgccgcgcgtccaccccggcgagggcggcacagggaggagaggcacccccagcgcctcctcatctcatctcatctcaaatccggcagcggctgaggaggaggagcaagaacctgccggtgggtggactactgcctaccgggctcgctggcaaccaagaattaaaccccaaggaaatgaacagaaagaaaggcgcgtgagaaagccggtggtttaccttcacctaaccaccgaccaccgaggcccagcttgaggaggaagggaagcatacagagagagacagcagagacggcgctgtccgcagcttggtcggtcggttgcgttgtccacgggggggaaacccgacgtgcgcggagaggggaataggatcagatgccaaggagacgaacgcggcaacgcgaaaccgctggcgacgagggaatcgaagaatctctcctctgcggcataacgccgaacaccccgtgggcacccaagccagtcaaaataggagcgagagagagagagagagagagtctcgcgagtggggtttacctcgcggagaagaccggcggccggcggggagtggcggggtggggaggagaagctgaggcgtcgacgtgtagacgacgtgaaggctgtctgtccgacgccggggaacgcgaaccgatcgaatcggaagcgtcgcgactcgccgaggtgggggaggtgcgtaaattggaccgtggagtgagtggagtggagttgaccatcccttttttgttttccatggacctgacacgtagtactaccacctttccttctttctgagcaaaatgtgttcctgtgcaaagtaccggcaaaaggtacagacctgtacgtgttcatggcgatttggtcggtccggcgagctttaacttttaagcacactctccatcgttgacggatcagaaaatcgattatgtcataacgtatctatcggtatcatagtatactaaattactaattatacttagatcatagtgttataacatatggataaacagttttgctataggttttaccgaaaatcgtcgatgtcacctgacaccggtccttctactgtagattcgcccttgccctccgtcccagaagggacgtcgctttatcaggtagaaaatgtcccaaaaaatttaacgcttaaactctcctgtcatcaaaaatactaatgcaaaaatgtacttgaaataaaacgcataggagtggagttgtctagtatactttcgaatgtttctgctccacgcgaattttcctcccaagcactaccttatcctctcttgttttctcttcttccccatttctcatctatcgtgttcttgttcttttacagtttctatgttaaagatcaaaagctttctcaaggtgagatcaaaaggatgtatagccccagcatgccttccttcttcctctatattgacttgtgttttactaaggtcaggtaaaccccatccatcttcctcttcatgtgctagtttgtttaaatctaccgtcattgtgatatgtggacatggagttgctttacaggttgatgaatggaatggcaagcggctggttgactgcctccttaaggatttgtagggaatagaggggcacccattggcggcaaaagtagcatccaccatgtattttgaattcatgggtctgctggataattgtgccccatgtaatgggagtgtttttgccgctagtgaactcaaaataggtgtatgttttgctgccttattgtcgggacaaatcattcattagttaattgtagacatgaaatattccttgtatgacaggagtggcatgtgtactctttggtttgaaataattaactgtaagtaatagattgggagcaacatggtcattttcacctaaacataatttgcttcaaccatcctaggacgtcaaacatagtggaacagagggagtatattgcaccttatctatacatattatgcaacttaatttcccacagcaacgtgatagggtattcatctacttagaaaagaaaaggagcatgctgcataaatagcggcaagaaaaaagaatcttatataagaaatctagctatcttagtaaaacattttttttctatttataagttagcaagttaaaattggttagaggtgttgttttatgaacttatattaccaaaattgtctggtgtatcacgtgcaaaaaaatatggttttatgcaatttaattataacacgcagtaggagcctcctactattttcccgtaaaaaaataactataacacctgggattttatgtgatccactctgtttcaaggctaatctctaatatgaaactttcacatcttaaattcttctatgaaaacatatttacaagggaattcttgctaaaattttaaaatggaccaatatgttactactccacgcgtttcatattataagttatttgattttttttagtaaaacttctttaagtttgaccaaatttataaaaaatataataacattttcaatacaaaatatacattcataaaaatatattcaatgttaaattcaataaaactaatttggtattgtagacgttgctaattttttctataaatttaatcaaatctaaagaactttgagtaaaagaaaaagtcaaatgacttctaataagaaacttgggagtaacatttaactgtatggcatcaacatataacatattagtgccaatcccatgaactggaccggctaaggctctgtgcaagagttggttccctacccaaacatccctacccaaacagtacgcacgaaatacggaacggtctattaacatatgattaattaagtatttgctattttttttaaaaaatagatcaatatgttttttaagcaactttcatgtagaaactttacgtaaaaaacacaccgtttagcagcttgaaaagctacgtgcggaaagttgggaacaactattgcgaatagagtctaaatcctcttcaatggaacccatcggtgtgtagtggtacggattggagtaaggttgtcgccaatataacttcaacgttggctcattgccactgtttgtcaaatctgtttaatcccggtcacaataagctctctctgaagtgacaaaaaattaaattattcctcattagaatatttttttctaagaatataccactattttgtagaacaattttgataaaagtaccaattactgcatccgctttcataaattcttgacgtttctccattgtacacttctacttatattatactttttaagataaatcttatattgttttaatgattttaaactaaatattttttaaagttttggtagttcaaattataaaagtttaatctcaacagagattagaatcggagggggtacaaaatttgcagccgtagtaacagagattagaaggaaaaataataaaaacaacagtctgtcaagtacacgcctgccttgccggttgcccctcgccggcggcctcgtagccggagcccgtcctctccgccgcgcccgcgtctgccggcttgctggcgagctcgcgggccattgccggagcccgtcgcattgaccgaatcgcggggcaaaaccaccaccatccgcgccattgcttccgagcggcgggaaaggatcgaggatccccttccttctgcatattgcgttgcttgcttgcatcattctccaccgccaccgccgctgctgccccccgcctttttctcttcccttttgccgccgaggcgcggtgcgggccaccgccacgtgatggaatggaagaggagcataccgccgcctcaggtttttgcttcttcccccgcgcgccatcttggtgcggacggcgggagattctctgcgcaccctatcgccgcctgcggaagcaatctgactgggctatgcccatcatgtgttcgacggagtgccgcaacggcaagaaaccttaagacttcgtttttattatatctcccctaggacagaggcggaggaggatcaggattggttatacatcaggccgtaccacgcccttgtattcaaaactttaggtatgttcatcgattcatgcccccaacagccttcattttcctctagtccgtgttcttgttccgttcatgctgccggaatctcacagctcgacaaaccggtgtcccaactgtcctgtttgctggttcttggcacttcaaacttagcgcaaacatgatgtatcatgtatgtatcgatacatagtagctctgggtttagcggaattgtatgtacatgctcatcaaggggatgtttttggttgctagtcagtaatcaccaagtcacacctacaatttttctctctcacttgcattgttgccttaaattgtagccacgccaataagcatcaggagaaccttgcagaagtggagtcgtgtgcaaaattatgacattatttgtggtgcggcccagattaatatttaaataaaaggaagcctcacttacaaagagtaaaaaaatgaaatgtatatctaatcatttattgttgtgcttgtatctgctacctatttttacattcaggttaggggaccttgcagggcaaacagagatcactgcaatgacattggatttcttcttagtgcgcttgaatcttactttccaaacatttgctgcctataattacaagcctataataacttgtctagtcaatagctagcattgtagtaattgggtatcttcatcatttgtcctaaaaaagttacttatcgaaatcttccgtcatcatccacccttttataattaaataagtattctccacgaaaacagtgtgtctcactcttttatgagggctggctatcataatgttaggactaactttactaactttccaattgaagcttagtggtttctccggcaagttgacaagaaaaactgatcatatcaaagatgagcttcaaatctattgaccggttaattaggaggaacagtaagaccaaactttctcggaatattgttgatggtatttatgaccagaaggaagagcaatatgtgcaatccttgagggagttgcttcttgcaaacaaccagcttcccgagaagtttgatgactatcatgtcctactacggtatgcaaatttgtttcctatccagaaactttgtcgtgtacacagttactgcactagagttatccatctttgtaactaaaagaagatattttacacctccattctcttagctctgatgtattctgctttttcattgaggatgagctttatctgattgctttcttcatcatgcagctttctgaaaatgagaggatttaacatagtaaaggcaaaagaaatgtttttaaatatgctaaaatggcgtgaagaatgtgctgttgatgccattgcaaaggtacgatgtgcttagtgttttttatttttctgtacaggtaaaggttgtccaagactgatgcttaaaatattcctgtatccttctactttgttatccatgaaaattgaatcatggaatgccacgatattatgtaatattgttgaaatattaagagtaaatgatttttctatgttacaggattttaaatttgaagagtacgatgctgtaaaaagatgctatcctcatggatttcatggagttgatagatttggcaggccattgtatatcgaaaggattggcttggttgatctcaataagctcatgcaagtatctagcactgatcgatatgtaaagtatcatatatcagaacaagagaaaactttatccttgagatatccagcttgctcccttgtggctaagaagcacataggctctacaacagccatatttgatgtgaaaggattggtacgttattgctacacgaagtactttccacctactattctacattaatacaattgacagaactaccatttcttattctgtaaaactgaggaccaaatatgtcttgaaagcagaattgcaatggttgcactgtaccttggtccttccttaaggccattgctgtacgacttgtaaggttgtatttcaattacacattcatagctggaatagaaattcacattcatggaacaataatatttgcagggaacttccatacatctaatctgtttgtttgaagtgctctcattggcatatgttgaagttatgtttttactgtactaagttcattgtctttactccaaattcagggtatgaataacttttcaaaatctggaagggacctgttcatagagattcaaaagatagacagcaattactatccagaggtttgtatgccatgtctaaacttcaacgtcttatctgtctcttatgatattataagtgaaagttttagacaatatgcatgcaggagttagttcaatatatccagatgttcatggttattatttgcaaaatgtgatattgctttgtaaattactcttccctcttatataacagtataaaattatatgtaggggactccactaatgttctttggttaaaaaaaaaagtaatattgctatatctttcagttcaaacaaataaatgtaaacaaaacacactgataaggttggtcaataacatgtctgatagagcagaaataatacccactatatatgtcctctagcacccgtgtgctctgctacagtgtgaattctagaataagaaatgacaaagttattgcatatgttcaaagccattaatcactcctgtttggctatatggtgtcatgtatcaacgtagtaaggaatttcattggagacatttttgtaccttcactttcatcatatagctactgatctattttcttgcctcacagcagtcagtagtttccactctctatttatgtggtcttgcttctgatacagacattaaatcaattatacataatcaatgctggtgctggatttagagcactgtggaaagtattaaaagcatgcatggaggcaagaactttagcaaagattcaggtactgcatgtctgcatgccctttcttcatgtgctacttattgttggacaaatagattgaatatttttttctcacttatatccttcttgttaggttttagggaccaattatcttagtacaatactagaagcagttgacccaaggtaaaatgcttaaaattttaagcaaaatttgcgtatatcacagattgaatgtttgctcctttctgcagtaatttaccagacttcttagggggaacatgtacttgttctgcaactggaggatgcttgctccaagataaaggaccttggactgaccaggaaatttctcaagcttctaaggtgaggtatggtgcttctttttatagttctttgaatttttttggggcgctgaaactgcaagaagtatatcattttgattcctgaagcatatttttttttcctagggagtgtttggtaaaggtcagaaatctttcgatgagataagtactacagttgcctgcgaaaactttccaggtcaccaggtattaagggttgagatgcccagttcttgttgtcttttgcacgttggctttagcagggtgtgtcctatttgtgtttggtcggcactcactagtatggcactgctatgctttgcagtttttcctttttatggattaaacatttcaggtttattcgattattaatctctaattttatataatatatctattggccaattttgttgtaataaattggcagcctgtctgtgggatttgtgtgctaagtgtccacctaaaataggacagtttagggagaaaaataaaattcatcacttctcattttatctacccatgtcatcttcatttggttctttcttgttttcatttctaaatgccataccgaaagaaaaataaacatattatttttgttaacaggagctttctttccttagttctgtcatgactctgcactatgtctctctcttctccgccattcctgttgtaaaggaacagttatgtattcttgatatttaattgcaggagccttctgtaggaaaattgcatcccatttctggctggaaacgtactcttggcatgttgttgaaggataaccaggtctgatgttttcctttcccttcattgatttttgtttctgtactaatagaattcaatcaatactttgaacgctgcaactgataaaatatcacaagttttttctgctatgatttgactgtgtatgcatttcaacttagtagtttaacggtttaaccagatggtccaactcttccttgggcaaggagaattcgacagttgacgattttttgataaacttctatggaacaggttggcgatacgaatgaaaatattcaacagaataaagtgaatgaacaaatctcagagaagatccaagaacttgaaaattgctctgctcagacccaggaggtgagcaaaggtactctcagcttaaaatattgcaacccacatgatcttcaacagtagctgaatggcaatattgttgttatgttgtatgttcagacccttcacgcactactacagaagcagaatgagcttgcgaaccacattgaacagttgaggaagctcctccggtgagaatctgacatctacttttgttcttttctctaattacagcatatgggatattaaaatgtactaagtatctgctatttttttcaacacagggaggccgcaaatgcagacaacaaagcaaacgtcctaatcttgaagtgaaattgcgtgctttccagcaggaagtgaaacgagaaaatttgaaccagcatcgcatggtagaaatattgcagcatggtagaaaagaaatacagcaatagacacgtcgatagttctcagtaatgattccttaatcgttagtcccttggctggtaatctaacacgaagcaaattaagaaagcaaccgtacaccatgatgatttcaaaacgcaatgcaacttctttgtacacatgctgcgttctgttgtacatttgtaacgcatcttttcagaagggaaaatgttgtatgtaccacatcctttcaaaaggaaaaaatgttgtatgtgttacttatgaaactacttctccatctcctgctaagtcacttaatgagcgcgaaagacctacccattacaacagcatctaacactctgaggatatattagtaaaatcaaaacgaacaagtatagtaatgttgtacaatcaattgaacccccaaacacaacccagccaaaaaaatataggcctatacctgacattggcaagaaaactcagctccgactccccactctctttgtgatgggtcaagctttttcaagtattttttttaattttggggggtttccgtccgcaaaatgtgagctcgagcccaacctgctgcattgtcaagtgatcaagtcggatggggccgagtttgaacaggcctagctacaacaaagataaattgctgttgcaacattcccctaacaagttcgcaacagtaggaaaaataaacgaacaatatcaattatgtaaaaaatttaggaacggaaaggaagtggtggacaacaacgatggtaacaagaagcggcacggtattaacatcaaactagtaggatgagagatgcatgtgttacagttctgtgagcaagtagcatcatggtaggcggagccctaaaaaacaatattgaccattatcataaggcttaatcttttggtgtcacttgctgtaaattaggatgagctaactgtaataggcccgtggtcgttgggattgggagtagagccatgctagccttgtttctagtaggaggaagaggcgatcgattctagatgtaccttaacaatgccatgtttgacccaagcaatagggagtgcagctggagtgggagagagatatatggagcatctaagggaacgtttgattcttttgaacaacttgcttagctaggcaatagcatactagctcacctaggctatagccacaggagcaagctatctagttggttgttttgctaggcttaacgtttgttcgctattacatgggcctcaatgcctgagtcctatgcttgccgttggaggacagccaattatgttctcctccctaggcaaggactttcttgccttaagtgacttctctcacctagcaaagctagaaattttattgctctaccaacatcaaacctggttgagcaaggctagaaataatctagcctcggatccaaacgtaccctggacaaagaaaatgatgggaacgcaaaaacgctaaatgaaacttgtggacaaagaaaatgatgggaacgcaaaaacgcaaaatgaaacttgtggacaaagaaaagaatgggaacgtaaaaacgagtgacagtaatagctaagaggagcccacatgtggaggatctgacgtgcagagatgcatcagacatctgatttgtcgtatttgtggtggattttacttctagctatatatggatatcagcaatgccatgcatcacccatgcaacggacgtaaagtttaagtgatatctgtgtgcataagtaaatatatatgtaagggaaagaaattagatagtagcattaaagtgatactggtttatacggataatataaacaaaaatttggttgagaaaaaaattaatacggatatcgatgtggagcttcgaagaggagagaggcattcgatgtccaagtacatatatgggtaccatataaatcacccatcaatattaaaattccaacataaaagttttgagattgggatatacttagaaaaaaaatacagttttcacaaaaatcaccaaattacccttttaaaagaggggcagcctaaccaggttagggttctctatttacatctcccaagtcccaaccggatcgaaccaaaatcccaaaaccgaagggaaacatagcagccggctaaggtttctcccccctgccgcgccgcgccgcctccctccaacgccatggatgcgcagcgagctctcctcgacgagctcatgggcacaggtacacccacccacccagtctccccctcccgcggaaaccctaaccctagcctgaccgctcccttttctcctctgcgcagcccgcgacctgacggaggaggagaggaaggcgcacaaggaggtgaggtgggacgacccggacgtgtgcgccgccttcatggcccgcttctgcccccacgacctcttcgtcaacaccaagagcaacctcggtataatccccaaccccttttggctcggtttccgtcttctggttggatcgattttgcgtggtttcgtggttcggccggtgtgttgtgttgtgttttggttgcttgatttgttgttcggttttggtgattgcagggccgtgcatgaagatccatgatctgaagcttaaggagaggtaaggcccgattctcgcccccctcagaattatctaggttttggtgctaaacctgcgcccattagtatgggggaaaggtgattattgttatgagaaaaaaaatggtaccataatgtatgcttacacctaaatggtatagataattgatgcttttgcgctataagatgttatttatatcattgcgcgactaggttttgtttagtattgaggaatgaggatttcggccttccgcgtttccgttgagctggtatgttgtactttcagtttccctgcatgtttcctgttgtgatttcttcatgcaccttgctattgagaactaagatgctggattacttgcatcacaccatgtcttgtatgtgaatactgatgccacggcactctacgtagtgtctgaagaagcatccagttccagatgtattacacataagaagctttacatcttaaaagatgtgttctcaataaaaacaacatggcagaaaaaaaatcttgtaattttgggagaaacttgttcagctgatagaaatgcaaggttaaatgcatattgagaagagcaatgtaggaatatacctatacatcttacagcagctaattttgttaactaattcataggtggaacactaatttcttttgggcagagggagtctgtgcatgccgcttctcaacaactttgatgcataggaatggatattctactttttcctgcatataactttgactttcgtactactgtacaaaagagttctttaacaagttacgttatatggacatgttcttgttttaagtttgtgcatgggcttttattcgttaatgtgaccgcatagttcgaattaagtggaaatcaggacgtttagaagtgctatctgtgactgtggaaatcaggatcgcttaattgttgccgctagttccggaccaacctagttttatcttatacgtttttgaagatcctttattaagatatatctgcaggatacacacaataattgtccagaatgagcataatttgtttatggggaatattgttcgtgtaggtcagtgcagggaatattgtttcctatgcagtcacataagcatcacatggcgagggtgaaagggatataccttttctcaatcagacataaacaaattattttggaatgacatcattggtttgcaacatgtactagatgcacccagcctgcttgcgtcgttatgaatattgggatgagggttatcaaagttattttggtcaataacattaaatgtatgctgtattacgcccaatttatgacttcttttaatagaatatgttgaaccaagaacatctttttgactgctggtctgtccctttatatatagggaggactgacttgacatccaaggaactaatctgtaacattataggaaaccagtccacatctctacctctaatttactatcggaacttatctgtttattcctaatctgccttgcctaacctgccaaatgggtcttgcgcattcccataacctattttgaataatcagtccagctcagttgttctgtcgtgtacctatctgatatagggagagcaatttatgcatttaatttttttttctctgggcaagtgcagctttgagagttctcccaggcgtgaaactcacatgcgaaggtttgaggcggaacttgctcaacaatgtgagaaactggtaagttgtagttgcagacttgctttgcaaattccgataactagagtatttaatatcttttttctattgcaggttatagatttggatagaaaaataaggcgtggtcgagaaaggttggctcaagatgttgctgtgccacctcccgtcatagggaaaacatctgagcagctttcaattatagaagaaaaggtcaagaagctgttggagcaaattgaggagcttggtgaagctggtaaagtagatgaagctgaggcacttatgaggaaggtactgtcattaaagatccattttgattgtgtacttctgtcaaatgcttcttcactaactggtgtacctgtctctttatttttggattgcaggttgaacttctaaatgctgagaagacagctttaacgaatcaagcagataataaagtggctatgcttccacaagagaagaagatggaactttgtgaaatatgtggatcattcttagttgcagatgatgttcttgagaggacacaatcccatgtgactgggaaacaacatattggctatggtttggtcagagattttctagctgaacacaaggtgaagtatcatttcaatagaagtactaatgtttatatttgtatgtttactaattggaggctcctctagaagtctccatattagaatatgtgatttttgccgctttttttgtcagaatatgctcctagaaataataaaactattattctttgatattttctgatttgagaaaattctatctgtagcacaaatatttggccactaccaataagtactgcaaaactattccaccttcactgtataccataatgtggcccaattccttccaaaaatgcagcataactggatggaagtggactgggatgatgttgctacttctcgggacggaaattgcggctgatgcatggggttgccagggcaatttcgtcttttgagaagaagcgccgtctgtctctgttgactttgatccaattttgtggtacatttggaaggtgcagttatcttgcggtatttattggtacaagccaaattgttgtg

SEQ ID NO: 69216 - DNA, 982 bp, Oryza sativa
aaaagagagggaaaaagaaaaagaaaaagaaagaaaaaaaaagagaaaaggattttccctggaattaaaatatttcttgctcaattttaattggttaaaattatttctagggctctgaaaattccactaaaaatcctgttagtgaatttcgacatgtagaactcaagaaaaattccacatgccaattccgattattatttgcattgatttaaaagggtttactcttgctttgcaccggtattttcttagggtctcttataaattaaattttagacttgggaggagaacttcggggtgtgacaccggccggcgccgtgggtcccacgcgtcagccgcacctaagggcgcgggcggctgacggccgggccccacgcggcagccactcggcgcgcccgagggcggccaagccggcacagccggcgggaggcggcgcccgcgcccctatggtcgccggcggtggccataggcacggcagagcggcggctgagagagggaaagggaagggggaaaagaagaggcggtccacggctcaccctaggtcgacggcgacgacgaaaaaggcggccggagcggaggaaggcggcggcgcggctcgggtcgacggggtccacggcgttccggcgggcggcgagcgaaatggaggggtggacgaggtcggcgaggatgcggccaacccgaaggaggcggcgccgaggtgggaggtggtccggggcgacgacggcggcggaccggagctcgacggcgactgcagagagagagagcgacggcgcgagctctattccggcgaggagaaagggcggcgagaggcggaaacggacggaagaggtgcggggagggtttaaatatagccgggtccagagagggtggccggggaagggaggaaacctgcgcgggaggtccggctgccatgaatggcgccggcgagatttgcgggggcaaatcccgccgtttgaacgagagagagagagggaaaaatgggggg

SEQ ID NO: 69217 - DNA, 15665 bp, Oryza sativa
ctttttcctgtgaactctaataaagacaaactttatatcaaacatgtagccctcgacgcgatctacaactttgtagttgaatttttttattttaagtcattttttgtcccaaaatgtaattttaaaattaaaatttcaaaatctataaacatgcaacaatattttgggaccctaaacagttttaattcaaaaacttttcaattacaaagttgtaggtcgcatcgagggctacaattttgatataaagtttgtcttcattagagttcacatgaaaaagtcatgaattattttttgatataaagtttttagaccgtcctgtttagggccagggtgacacaactgaacaagttggaggacctaaacaagtgatctgcaagtttagggatcgggatgacacagtcgaataagtttgaggatctgaacggtcgatttgcgagtttagggaccggaataacacagcggtacaagtttagggaccggtgatgaactttactctataatataatataatggatgtttgtgatggcattgtcctattttgctgtccgtagactgtagttctttgattgacactagttgtcaaatttataaccatgacttaactttcataataacatacctttataatcaaggttttttctctttgttattatgttattactcttttttttcaaattgtttatggtctacatggctcgctaagtctccaactggttatgtagttcaggccctgtttagattccaacttttttcttcaaacttttaacttttccgtcacatcgaactttcctacacacacaaacttccaacttttccgtcacattgttgcaatttcttcaaacttctaattttgtcatggaactaaacacagcctcagtttgccaattgccaaataatatcatccattttaggaatggctagagacctttatttacaacctaacttgcatagttgatgctaaacttcatcacaacaatgtccttgtatgaagaatcatgatagtatggaagatgaggatgttttcaattcagaaaattcaaagatgcgggtctcatcttttcgcttatgcttataagctaaaaattgaatttcgaccttaaatttggagttgattttggggtttttcatcgaagtttatttttcagcttttgttcttagatcactaataacacgtatataaaagttttatttacaaaatatttttcgtttgcaaatataccgtttcgcttattcctccaataagcgaaaacgatgggtccggcaaacaaatttaattagaaaatatttttaatgtcattaaatatatagtccggggaatactgaatctactgttctaaaatatgtcaatcggacataacgaatggatgaaaatgatcatactgtaaagtgatgaaattccttggatgaatcccgtcaattcaaatgcaggccaatttgtcggacagtaacagatgccgtccacgtgctggatgcgattgttggctacgacagccgtgacgcaaaagccacacgggcagcatcaaagtacatcccaccgggtggatataggcagtttttgaagcctgatggattaaaaggcaagagaataggcatcccaaatggatttttcaacttcccaaatgggacagtgcaacagattgtttaccagcaacttctcgacacagtgaggtatgcaattacaggaattttcacaaaattatatacgttggcagaatagaagaaaaattgacatttcaaattgcattttacagaaataaaaatcacgcatttattattaattcccatcaaattatatatatgttgcaagtttatactatgaacatgcaatcattttacaaggtgcttccttttgtttcctgtaaatcaaaacgtatgcatgacttgccctcatcaatatgaaatatgatttaaaatgccaaaatttaggcatgatttacctgcatgcaaaacatagtacatagctaagtttttattttctgtttccgcttacattacatacttggcacgaatttatttaccatagtttataaagttcctttagagaaatcactgaaaaaaagttggtacataagctaaattattgactacgttcccaattactcttccatattccaagttattctcatgtaaacatataaacaattataacttgcacaataattcggatatgtgcctccctgatttcaatatgaggaaattttggcatatatttagttacagttggaatgtcccctttcagctgtttttatattaattaaatttacgaagttgtgattaaagcatctggaaaccacaattttccactagccggttgctgtgtattccatcaaacttatatatctgcaatcaaataatatttagttactgcaaatgtcagaaacaaatgtgtgctttatttggaagtaaattgaaatgtgtattttttttattgcatgcaaagaaggtgtaatttttgtgaaatttactgtaatgaatatatattggactttatggaacatccgtattctatattatcgcacgtataggccaacagatatggtgtggcatgatgtgcattatcaaccagtttaggtcatatgccttccaatttataaatatatatatggcgatagagaaaagtcagtttcctagatatttgacttttacatcattctttgaaggaaacaaggagcggttgtgattgagaacctagacatagcaaacttggctgttatacaagatgtccttaacaatggggaacagattgtgttagcagcagagttcaagtcaagccttaacacttatctgtcagacttatcctactccccagttcgttcacttgcagatataattgctttcaacaacgcacatccgattgaggtcagctgtgtagctcctaattaaccttctggtgttgattctctcacagttccacattgcacatatcttgctagaatttttttttgttttctgcaaatctgaagaaaatgtacatatttactttactaccttatatattatataacgagacttcggaaaaaaaatgatatctcaggatacacttaatcaacttgttcaacctttagtaacgtatataaaatcatgtatacatttttctagaggcattttctaggggcatacctaaaccatgcatagaattttcaacagaattatcacatccaatttcatagtattttcagatgacacatgattagaaaattctcttttggattgacactatcaattatcaatgaggtctaagatgaaaaatacaaaaataaaaaatcaaatatcccgaatacataaaactgataattagcaccactactcttgtataccaaactctttgtgcatcaaggtatattcatgttgttgcagattatgaagttaatatcaccatagtatattgcacatcttattttgttgaagattatgaatctttgtatgtaatgtaatcagcttaaaattaaaaaaacagtcagaacagctagctaaatgatattgccaaaaatgtgtataacaggagaggctaaagaattttgggcagctcatcttcctggtagctgagaatactactggcatcggtgcactcgagggagctgtgatccgtcaactaaacgagctttcagctgacggactggagaagctgatgcaggatgagcagcttgatgcaattatcactcccaatgacctagtttccactgttctcgccattggcggcatgccggcaatcaccgtaccagctggatacggtaagatgggagtccccttcggaatttgctttggtggattgaagggctatgagccgaggctaattgagatggcttatgcatttgagcaagctaccaaggtcagaaaggcccctaagttcttgcacggaacattttagcaacatggcagacatgtttttaactagtaaaaagtaattcattgggctgatcgtttatcgcaactactattgttgagcttgggaatgcaatttaaaacactgttgcagtgaaaacttagtggattgtgaaaaaaatattggagggagaggtatccctccaaacattgtctccggactcaggttgaaaccacacacccattgccactgtactatcaagtgattatgatctttatatggaaagccaaatctttatatgcataaaccttgattttcatgacaccttttgttttccatagccacatatatggcctgggagaggtgattcctagaataaaatgatcttgtaaattttctatgaaggataactcgcagagttccacatgtaactccatttgtccccttttgaatccagaagctgacaaaaattaattttgacttgaagagtttggaactgagcatatgcttgctcacagagaggaaacctgaagcagacttctagaggtttagagcatatcctatgtacaaatttgtttctgtaggaccaaaaagcaagaaccaagccaaccagaggagattgaatggttgtagtacccaaaaaccaaaacttttagtggaattgaaaattacgaattcgatgatgactggagtaaatgcgccggtctgaccacacaatgatctctagtctgactgacgtagtagctctggtctgatcgcttaatacgccgttgtcgcctgtcgccgccgtaggtctgactgcgatattcccgccggtttgaccgccggtgtctagtcggttagaccgccgaacctgagcaaacacaaatcgaagatctatcgatgtagattcaaaccctaacttttctataaacttggctctctcaaaatcaatatcgggagaccacgacctccctctctatatatacctatatatacttgaggtaggcagcctaaagccacgaaccaaactagtaaaaaagtcccactgctggggaatccgtttttagttatggttcgcaaccctatttgatcccgggtatgcaaccgggatgcccaatccgggatcccggttatttcaatatttagtcccagtgatgtaaccaatagggacaaaagtttttttttcttttttttcattgttttttgctgtttgcatattgattttgagccaaactcactaacatcacaaattaataaatcgaatgaacatcacaaatcaaattgacatcacaaatttacagatcgaatgtacatcacaaattgacacaaaaaaaaatcaaaggctcacggctaaggaacaagtttatgcttagtatgaactgtagctaaacaaatgcgcaaatacaaactttggtaccattatggtttgagtaagcagcaagctctaaatccgagacctctcaattcaccatctcacgcaaatccagcgtaattcaccacaagtgattcagcccctgctcaaaacttggcggcgattcgggaccaagcccgctgccgcccgcccaccgccacctaccgcctcctatctcctcccctcccgccagatccagcggaggagagggcgccgctgcctgctgaatcccgtcccgccgtctcctcgtgcgctgccgtcacccaccacctcctcgtgcgccgctcgccggcttccttgctcactccgcctgctcgccagcttcctcgctctgctgcccgctcgcgcggtgagatagatggatggatgtggccgaggggaaatgctttcagatggatggatggatggatggatacagcaagagggaagagaaagagagagagaggagagagagaaatgctttcagatggatggatggatggatggatggatacagcaagagggaagagaaagagagagaggagagaggaggaaagggaggaggaaaagatgaggacagggtttacgaggaggaggagaggataagtgcgagggattatatacgacgcgtcgatctttagttccggttgctaacagacaggggcctgacactttttgaattgggactaaaattgatctttgctcctggttggtgttaccaaccgggactaaagatcataaagtgtcgttgggcttttaaaccggggtaaagaacttctttagtcccggttcctatttaaaccgggactaatgtgattttttcaatcccaacaaagatcacttctccagtagtgctaatcccctaggaaacctttccgtacaagaaacaaactttttacaaacaccaattataccaaatttagactccctccaaatttgactccgcgcccatacacacacaatatttccatcgtatgtcatatgaaatcttcaccaaccacatgcaatccgtgcacctcaccctttacgtcattccttcaatgcaattgtccatcctctccaatagtagcacaagttctacagtagtctcctatcaaggattgaaatttcggtccccctctccacagcaatcaactatctcagccaaaatttttggaattttccaaaattttgtgaatttggccaaaatatattcaaatttagtcaaaatttattaaaattttaaatagtttcgtgcaaaaaagtaccaaaaatcccaaaattcacaaaaagttacgtggttttcaatagtgtgaaacctgcttctaccttgtcgaaacagtattggccctactcaagtcctctgctgctctggcaaacctagtagttctgggtgtgtttagttcacgctaaaattagaagtttggttgaaattgaaacaatgtgatggaaaagatggaagtttgtgtgtgtaggaaagttttgatgtgatggaaaagttgaaagtttgaagaaaaagtttggaattaaactcggccagagtacagtggaggaaatttgaaaactagacatcgcaaagtgtgccgtgctccctgccagacatcctccctccttccccgcacctcctcaacagctatcgcactgccaccaggtggaggaccgttcatcagagatgcaatcgatgatggtgagtggaagaagatgaaggaatagaagatttcgaatccagtcgcaatcgttcgcttcgctcccgttacaaccgagggggaatgttagaagtatagatatgtcggttagagataagagtcagatacaaattatagagataagatataatcctagagataagatagagtcctagagatagaatcctagagataaatatactcttagttgtattgtactccaagtctctatcccctatgtactccgacatataccccatgagaggatcgatgtaatacaacataatataacaatcagatgtttccacagctctggtgtgtgctacatctatgacggtgtaactcagttgacacttggctagggtgaagtgctagattttgtcttggtctattattgtctattgggcctggttgctttggatgttttgttgatcatgtcactatcttcatcgatggcatgtctttatccactgcagtttcacgacgccattgcgtattttggtgacaactccatggtgccttacatctgcccacgacattatttgcctttctttcatcatcatatcttcatcatcaacaccctattcagtccgctagatcaactattattaccttatgcatggttgcactaaccatgactactttatgacattggcttcatgtatcttgactaggacatctaggacataatggactatcattattgagcatgcacgatgtgccaaaaataaaatcatggttggcattaactaaaattaaaattgctgtccacttcttcacccacgtgagtggtgtgtggaagtatcaattcaatactaatctcttgaaaatttatttgctcattatttctcctcaccattagcatcctgctaaagcaagctgacatcatcttccgatgctgcagtgggtccctaccttcatggtgtgcccaaaagcacaaaagaagcatatacacgaaccacaataagaagaggaacaacaacaataagaagaagcaccagcacaagaagggtgaaggtcgatgaagtcatgggcaaggtcaacaattcacaaaggcatgccccagcaatgagtccagcgtcaatacatcgtggccaacaatatatagttttttatatttgagtaaagtacaccgtcggtacttaaacttgaggcgtggtgtcacttaggtccacgatcttgtaaatccaatatttgggtccgtaaatgcaccattcaggtcgaaaagctcgcctgactaggtttgagtgcaaatatggcagtacagcgtggccgtatttttgcatttacccccttcgtgagcccgtctcccccggtcaccgctggtggcggcatcggcaagggtaagacataggcattgtgcaaggccattgggagagacacatgtgccaaggcagaggtggctgttgaagtgtagcatcttgcacacgatgagcagcgggaagaggacgtcgtgctgggtagccgaagatgcggtgtaggtcagcgctggtggtggggcgtcactgacaagctggtcgggaggcaataagggatggaggcgggtagtgaggatctcgagtagggtggacttgctggctttgccggggcccatgatgagcaacacactgctctagacattaaacggatgaaagagattgcgccgaagaggttccggttggacttcgcggtgagccgagagcaaacgtacattgctggggagaagatgtatgaatagacgcgaattgcttggctccattcttgtagagtctggttgtcgttcttgtcggctcaaagacagggggtcgatggggtcatgaagggggtaaacgcacagatgcaaccacgccggactgccacgtcggtggtcaaacctagtcaaacaagatttggacttggatggtatagtaaaatatgattatggacccaaatgttggatttacaagatcgtggacctaagtgacaccacacctcaactttaaggaccggtggtgtactttactatttatagtttcttttcacataagcttatctacttcgtcaattgtaatcaccatacacaccataaaaaatgatccatccatgttgcttgcatagttttttcataaaaaaagagggagttgttttatcctaaaaatgtagatattatttaatgatataaagtactacaaatatctagaaacttaatgaaaagaatgccaattgtcttgatctaatgttgtgatgcactataaaaattgttgacgtcaatttttatctagaaatgcatatgtgttgcgactgatagtttaaactaatgattagtgtccgagttgttaattttatatcaaaataaatattatttctatagaatataatatatatagtttgtaaattaacttgttaatgttttttaaagtgaatagagttctatttttatgagtatgactataaatctaggaccagagattctatataaaatctgtttgcaagtattacgtcatgaaatgccaaaacaactggaaggactataatgtggtgctcctagtttccactgtgctgtatcttttcaaagattgttttatttggagtacttaagaaaatttgtttcattatgtgtgaggtaaacaggcttgatactatcaaagcttagatgaagacatactatgataaatatgaaaaaaaacttgttaacacaaatgacacagaaccttatagtgctacttaagcatctcataaaagggttcaccagttagtagaaaaaagaaacttaaagatgaattttaacaatagagttcaacaataataaatggttattaaagttaaggttcaaagttggtgcatcgatgatactattattatctaaataattaaattgatgatgttttactgtgatggaagcacaatgtagaaaataccctatattgtcactcatagccagggattttcttgtagtaccacttagtatagtgccatctaaatttgcattttagctctgctcgtaaaattcttgtgcatactcggagctcatttacacatgtattgttagagagtttggtttacgcaaaagattatttgtgtaaaccttgaaaatgtataataatgtctccttttgaattattgcaacctttggtgaataactttgggtaggtgatgaaatacaatcgtttggttaaattagacatgttaatatcatgtattctactctttactagtactgcaataaggttgtgtagccttctgaataaactttccaaagagccaaaatttatcgaaaatgaactccggagcaacaagttatgaccttttttttttttggtgctatcaaggaaagtcagaatttttgggcccttagcccagaagtttctaacagaactatctgttcagcctatgaaactgctaggaagtcctgagcctcaggccagaaagttccgggctgctgtttcttgagtaacggcttgtttttgggcccgagtttttaaacccctccattctctcctatgtttgctgctaggtttgggcaacaatatacttattcaaagccaaataacacctatgtgacatcttggactaactaggataaggcctgtgtggcccatgagagctatgtgcgcatgtttagtaccaccgtgctaatttagcgaggatggaaccaacttataaggcatcttccctccaaccatatcactctatggatagcatcgggggtttgtttcatgatccgttttatgtatatttgccacttatataggtagatcacgatatataaatacatcaagttagatcgatctcgattaaatttcatatttggtgatcggttgttattttatatattaagttagatcgatctcgattaaatttcctttttggtgatcggttgttattttatatatttaaattgatttgttaatataatttgtattggagtactagccaatatgttatctatgtttgctctaaacaatgatctatcagctatttccataatactgtcttaaagtgattgatataaacaaaagggatgatattacaactgataggacatattaagggttttgttttacttgtccatcagaaaaccgcagccgatttggtctaactgtatcggttgggtcctgacgatacgtcattggctctatcggccgataaactacctttcatctaattacggtttatgtttttcgttgctggttgcaggatcaaaccagctagcacgctcttgacactcgaggcacgccttggacctgcattggagtgaagcaaatctcccaggtcgccgtgttttctgtcaacaatggcggcttgacttgtcaggccgaggtaatagccgaccgaatttgttgatggcgtcaacaggaccatctggctgtacatgacatatccaagatctacgggttagtttgatgggatatatggaaatttgtcaggattgtgatatccggatacattgtaacatactggatcaaggaggagcacatgtaatttgtggcttgggaatgtagcatgtaggctatggctgaacctttttaacaaatatcgtacctcggtgtcatgtttggtattctatgaatatcgtatgtttatgttcattttaacaaatatcgtatatatgttcattttatgcatttggttcccgatgtatatataggagccgattttacaacttattgtcaacaatcctattcctcgtctaacaataaggcaccgatgtatgtagatcataattaagataaggcaactagcaacagatcatgaactgtaaaatacaaactaatcaaccatgatagcttctgaatcaggatacatcctcaccaattcctcacggatgtcagctggacaagtggtggcgatgtcaagatggagagcagtaccgctcagttgatctatggcagcgtggatcactggcgattgcatgatggaggagtggctgtggtggagcggtggacgagcaacatcaaggtggaggagcagcgggatatgcccctgggatctatggcgatagcgtggtggatgatagatggcagttgcctggacaagcagtgtcggggcgagtggtgcctcctagtctatctgtatgtggcttgcctgatcccttctccccacactaaaatttcttcatgcacaaaattttgattgtacacatttgaaccgaactatgtctcattcttgaagatggtccttatgacgcccatttttcctcactttccttgttattttggcgttatgagccaactctgcgttgttcttatgcgtagagacaatgtttatgtgaactcctctctctttcctccatgtcatcaaatcagtttacgtggcaaccgagagggcttgctaaaaagaccattgtacatgaccttataagttagagaacttgatatgaagaagtgacagttggatgcaacaatgtcacacacaactccgtggcctctagcgttttcatcatcaatagcataccatggatcaccataccggcttggtatgatggtcaaagtctcaaagagtgccatttggcatgtgctgcggtgaaataccctatgcttttgagcaagctagaaaagttcaaaggatgagtcacttgaagccctactatattgccaatttgccattgcatatacatgagttcaagcaataacttgacaacattagttagctaggaaagtttcatgctgatcaaatttcctatttcactgaacgtggaacttgaattgtatgccatcaaattcaaaatttgtaatccagatcatcaagtcgtacaatggcatacgccacatgggagctcatcgaacaaacttcagttccaaaggagttatcatgatttgcctagtggtacggggagctgaaggaagttgggtgaaggctttagaaggcgctctgcatccagtctggtcggaaggtggcctccccttcctctccttcctagcaccacctgcaaactttgtgggcaaaggaagcctttgctacaacgtcagcgagagataaaggtcggcggatcacgcgcgcaaaggagcaaggcaaccccgcgtctacgtaagatggggactgatgtgccccagcacccatcacatgaacactcaagacaatcatttgacttagccgctgataagagccaatccattacaccatttcaaggaccgattacacgtagacgtgcaaagaaactacaacaagagataaactcgctactagctgaaacatatttcaatattgacgagaattatatactacctaaatcaagtactttgctattgcttaggtttacacatgcacaacacatgatgggcatcgacaacgagctagaagatcaaagtgacgatgggttacgtgaagacgacgactgtttatgtcatgctgattttggagtgcactgtctccaaacatttgctccaacttccaaggaatgtgcgacccaaccagtcaactttctccatgcttaatatatatggttggaaagataatcaagtttagtttcacctccaacaaacggctcatcatttcgacttcccaataaggagtaatagacaaatcattgatgactgctaggaagccaaacagacgcgcgagtcttctcgggaattcactttttgtgacctttgagctagcctatgtccagtaaactcccaagacctttcattcctatataggagggttgttcctggtataaatattccctatgttttatcatttggaggacttttgacaatgaaaatatgaaccccttttgttcagctgtgtgctaacaaattcagggagaaatctctacccctctgcttttgtgattttcttgtgagagtacagaagcggcgttcgacgccccccaattggtgctcctggtcccttcgaggtttttccttgattgattccaggttgtgttggttggtaaacttagagtgtggttaggcgaaccctcgattcaggttaccgtaatagagacggtggttggcttcgagtacgatcgtcaggttgcactgttatcttggctgcttgcagctagttatcttggtctcttttaggctagttatctattcgtgatcctacgccgtgaagatcgggacgtcacccctaccggggtcgcatcagggacgaccgtattggggattgggacggatgggtgtgggatacatgacgccggtgggtttgtgtgttagtgtgacatatgtgtgagtctcacttagcagcgcaaggtaacagggaggtgtacatgtatctctgaaagacatgccacactattaattatcatgaacactggcacatgaatataaaatgaatactagtataggaatttaaaataacattagattcatgacttatatcggatctaacatatcatgcccagatattaaactaaaattatattagatactttcttggtatggattaatgtgaaagtgaaatataattgaatctggttaagatgagaatatagggatagaaaaattaaacaataaatggttatgaactaatgattgattgcgatgtaggagagtaggagtaggtaagacttgtaagaggtatatatatatatatatacacacacacagaatttaaatttttaagattagtgatgtaagtggggtggataagtggttttttttcctgatagtcacaattttagttactttttctttcaaattttatactatgaactgaaaaataaactatgaaatggatttttacgtgagtagtgagattgctcacttgtatccctatttaccgcaattgactttgaacacaaaagtttaatcatatgtcttactttcacgtttaaaatatctttaataataaaatatgtcacaacaaaataaaggcataaatatttatgactataattgaacgagcatactgatggagagatcaagaatccaggtagaagagcatcatgtgcgctttcttttcataaaaagacattgtgcgacaattaataatggcatcactcatctgtcgtcactcgtcacgcatgtgctcaatccgaattaacaaagacataaaacaaagttattaggtgaaaccacctgcgctgcgctatggctcagctccggctgccactggccgcggccaccatggctctcgccgccgccgccgccgccgccttctgctgctgctgctccgccgccactggcttcgagttcaacgaggccaccgtcgacgccatccagctcggcttcagcaacggcagcctcacctccacgacgctcgtccgcttctacctcgaccgcatcgcccgcctcaacccgctgctgcacgccgtcatcgaggtcaaccccgacgcgctcgcccaggcggcgcgcgccgacgctgagcgcgccaccggtcgccgctgcgggccgatgcacggcgtgcccgtcctgctcaaggacaacatggcgacgcgcgaccggctcaacacgacggccgggtcgctggcgctgctcggctccatcgtgcgccgcgacgccggcgtggcggcccgcctccgcgccgccggcgccgtcatcctcggcaaggccagcctctccgagtggtccaacttccgccctgtcaaatccggctggagcgcccgcggcggccagacggtggtaaccaccactgccaccacacatgctctgcttctcttctctgtttggtcgtgtatgctcacaaggtgtttgtgaaattgcccatggagaatccctacgtgctctcggctgacccgtgcgggtcgagcagcggtccggcggtggcggcggcggcgaacatggcggcggtgacgctgggaacggagaccgacgggtcgatactttgcccggcgtcgctgaattcggtggtcggaattaagccgacggttgggctcaccagccgggctggtgtcatccccatctcccccagacaagac

SEQ ID NO: 69218 - DNA, 59274 bp, Oryza sativa
tccaggattgcatcccaataacggttggagggcacttcggacaattccccttctacaaccgtcataactacctctatataaggagctcactctcttcacttcacacacatctcaagcaatagctctctcatttctctcaagtttaatttagtagtatctagctggtggaatagaaatagaataggaatcaggagtccggaagccttcggaagagttcaggtatggctctagtagctttcctttcctcttttctaagctttgtacttttattagaatatttttctatatacatttatggtattgaaaggctttccaagtatatgagtacctactttataatatgttcatgttatgctgaatatacggctagcttatctgggagatggtttggtgcgggtataatgtttgcatatgcaattgctctataccatgacgatgatattatagtagtatctggtaatttaggtgtggtgtctagattacgagatatcattatttggggttatatattgcggatgagaggtgggccgctgatggtgacaactcaatacgggtattccttcgcgcctatatataatcctaagttaattccctggggagggtattcctccgtatttagccccgattgtatggtcatgacgggctgtcgtaaggaactcggcaatcaggggtggcttctcaaaataccaggagggcatcatatagagggtattagctagtatatcagttaactataatgtatgtatactatgtatattataagtatatgaatagattctctttctcttttctttcctcctagcttagattatttattatgagaatgaattgttaatgcttgtgtgtcactttacccttgaattatcttaactcttgcttagaatatgattatcacaagtaatatataaactattagtcaatctctctctacatgatctttccacgggataaaataaatacgatacccttggaatactctcgggtgaaatgctacaatggtatatccgtgcgcttgcggataaactctgcaaccataatataccagaagtatttctgcgccattgctggaaattatatttctagtaatatcgttaagaaataccaacaaagtcctaggtagagtcctgtcttataccccagttgagcgccagtgaagatggagccgtaggcccgctagtccgctactgtttatttgtgtttgtcaggccttaagtgcctttgtaataatgtaaatattatcgatataataaagatgtgtcttttgtatcatgtttgtgtggtgtaccttggcttttcaaggatggggataaatacactaccgttcaggaaaatgtatttttccaggcgcgacaacatgccctttgtctccactcttgatgaaccctgagttcctctcgacactcaaggctgttgttggcccgatctttcggtgagttgtgataactacgatttgggagaaacgttgacgatccgactacaaccgtacgagacgtgtgttgcgccttagcgatcgatacacctctccgtgggttgttgatcttgccggtgcagatcaacccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaaacaagtagcaatggctaaactttaatctaacaaaaccccccagaaaccctgaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcatcttgtttcttcagttgctgccgactgagatggaatttggcaatgaggcttgatgcattggaaagaggactccgagagctttccatcaagtactcacgggccgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatgctccccttcttcacagaaaaccgtcctcggtttttccatatggtgttcttcatatagtccattcaaaataacctgtttcatccaatcaaaactggagaaactcgaagtagtgtgattagcaataacatgtttctctaaatccgaacaaatgaaaactatatgcaccaaatatattcctctatcattatatttgccaaagatatgaaaaatagcattagttggacatagcaaatcagacttagcaaataatttctccttcaaattatcgagctcacaaaaatcatcaaactgaatatagcccaaagtatttaaagaagatagcaatttacgttcctcaacttcattagcaatgtgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaatgaattccagaatttggttccactaacggttgctctacttttgcatgaaaagtggacaaatttacttcgttaacaatgcactcaccttgattagtttcagtaccatttactttaccttggatgtcctctttagatgatggaggtgtctcgaacttgagtgtgaacaatggaattggtggctctttcatgtctctctcctccttttcgtgattacgcacttccagcaaatagttagtaattggaggcaaagacatagcgtgtttctttttcatatcctcctctattttactttcagcattgcaagcaagttgtaacaaatgagaaagagatctatacttttcacaagcaagcgtgtcctgaatttctttgttaagtccacgtaaaaacctcaattctgtagcttcttcacattcatctaagccacaacgtaataaacaagcatgcatatcataatagtatgaagtaacacttttggtatcttgttttaaacattgcagtttgttgagcagaatatcagcataatacatgggaacataaacatctctaaaatatcgtttcaggtctttccaagattgtggtattttgttatgcctacaaagatgtttccaatcattagaagcatgtttaactaaaacactagaggcacacataaccttttgtttctcagacaagacatgcctttgaaattcactatcaaccgctagctcccaattaatgtaagcataaggatcatagtttccctcgaaataaggcagtgcagatttgatcttacctagaacatcgtcacttacctcataaaggtcatgttgatcactcctcatgtctcgacgaagatgtcgatggtgagcatagctatccccaattatcgtgcgtatccctgccattgttagtagaaaacaagaaacatatacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggctaacacttgttgtacggctgcaatcaaatctgtggagctctgggtaggcttaaatatgtagcaaaggaatagcaaatgctcaaatcagagaatgcaaagttgaataattgttcaaagtcaagcaccgtgctggtcctaggctagaacgtactagagacgcgagcctagacacaaacgataccacaagatagcactaggaacaactcatgcacaactctgatatatgagttcagctcaaacataacaatattttctcttttctttctttcttctttcttttttttcctttccttttcttttcttttttttttgggtgcggcttttcttttcttctttttttatgcaccattctgccttttttttctttcttttttttttgattttattttacaaaaacagattaaaggacctcaatgtaagattacagggactcaaacgtaaatacaaaatttacagggactcaaatgtaaaagttaaaacccaaaattagaactatacaaaaatggaatcctctcgtcctgtaggttccgtttttgcaaacggattttcaatccgatactcgaaaaattttcaccaagcagtatgcaagatcacggtatagattgaaaccgtgaccgagaggagacactcggactcggcctggtcgcggacccggggcggtggtgggtgaggaaaggaaggatgcggcactacctaggagtccggttatggtgagagaaaaagggaaactgatttcaatcaatctgatctactatttctttccagattaaactctcgcacttccaaaaacagatttggaaattcttcttcctcctctctacaccggcaacaagcacaggccgatctattcacgggcaaaccagaaactcaagcaaatcctaaatgcaactccaaaactgaccgataaaaaattctgaaaactacaaaaacagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaagtaatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggataaacgttgacgatccgattacaaccgtacgagacgttgtgttgcgccttagcgatcgatacacctctccgtgggttgttgatcttgccggtgcagatcaaccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaaacaagtagcaatggctaaactttaatctaacaaaaccccccagaaaccctgaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttctttagttgctgccgactgagatggaatttggcaatgaggcttgatgcattggaaagaggactccgagagctttccatcaagtactcacgggccgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtgacatcaactcttcaccaccaccaactcatttctccatcaaactctccactcgatctcctctccgtctctaccgcttctcttttttctcctctgcaccattgtcatcttgtctcctggtgctcgacgaggcgtcgtctaatagctggaaaaacaaaaatgctttggttacttacccaacggtgtcctgtcgaggggtgatcgggatgacgccggcccggctggtgagacccaccgtcggcttaatcccgaccaccgaattccacgacgccgggcagattatcgacccatctgtctccgtccccagcgtcaccgccgccatgttcgccgccgcggccaccgccgaaccgctgctcgaccagcacggggtagccgtgaccacgtacgggttcttcctcatggacaattcgacaaacactttgtttacgcgatgaaatgctggggagatgacatgcacagagttttggggttgccactaccaccacttaccagcgtctcgccgccgcgtgcgctccagccgttcgtcaagggacggaagctggaccactcggcggggttggacttgccgaggatgacggcgccggcggcgcggaggcgggccgccacgccggcgtcgcagcggacgacggagccgagcagcgccagcgacccggccgtcgtgttgagccggtcgcgcgtcgcgatgttgtccttgaggaggacggggacgccgtgcagcggcccgaagccacggcggccggaggctcgctcggcgtcggcgcgcgccgcctgggcgagcgcgtcggggttgacctcgatgacggcgtgcagcagcgggttgaggcgggcgacgcggtcgaggtagaagcggacgagcgctgtggaggtgaggctgccgttgctgaagccgagctggatggcgtcgaaggtggcttcctcgatctggaacgctcggcaggcggtggcggcggcggcgagcgccatgatagcggcggcgagttgcagcggcaggtgagacataatgcacgtgcttttagtgtcagtatgtttttatttgcgtttgttaatcgagacacgaacggcatgagtaagagtaagcaccgaacagggaatttataggtatagcagtggaggagtatatgatacgacacatatgccatgacgccactattactaattttcgcacaaatgtgctctttagttaaccaaatcccacgaatgttcgtaggcaaaatttgctacggaacgctaaaaaatacaattaactaagagataccgtaaagacataaattaactatggaacactgtaaaatagtggtaattagctaatagacaccgaacacactattttattatttttataaaaacagagagagaaagagctgcgttttgcttttgctgaagtcgcaccgatgccgctgggatctgccccatggcagtgagctgccacgccatgaccggactaaacaaatgggtgagagaaagagataagaaagagaagaagaagaaaagagaaaaaaaatagaaaccatgaaaaaggaggaagaaatggaaaaaaatgaaaaaggcgatgatggagtgatggatgtcgcgcacgccgccaccgcatggtcaaacggcgtcgtcgcccggccccaacagccacacatgggcaaagccatcgccctgtcgcgcctgcgcgaacccatcgcatccacccgcgccacagttctcggctgcacctgcgcccgccgcgttgccatgcctggcgccccggccgcgctcaccctccagccgcttgcagcgttggccattcgcgacgtcggccgcccaccatggccatctacccgctccaccactcgcagcgtgggcatccatagcgcccactgtgccgcctcacccctggtgccggctggaccatgcctaagtattaattacttctctaatacttgcgcatgaacttccttctctatctggagttctaatactatagcacttagtacgagtactaaacaatgaacctgtaaagatgtaaatctatctttcttagatgaaataattaaataatattagaaaggatcccgaatacttacttaatagaagacctggactcttacagaattactcctaggaaactacactcgtcgaggtagaaatcggaaagagcaccaaacttccgagcacttctccagagctttccctgactctctacctatctctaatatacaaaagatacaatagatcctcttgtaattcagcttaaagttgtgtgttctaaaaatgagatgagctactccttttatttgctccatatgatggttataggtatgcgaaatttccaaaatgccgtccaaccatctttgtaaagttatcagtagcatacacgtggaagaccaggatcaaaggcgccagtggtggttcggccgaaccctgggccccacctcctagcctctcctttagctaggagattgagtggtgggtcctgatggcagttacgacagttatgacccattccatgatggtttcacttgacttgtgggtccttcaatccgtgtacttgtgtctaattggccggatgtatgttttcttatatgactggtgtgttttctccttaaaatacctgcatactcatatttcaccaacactagtggaaataattagtaataatccctactactaagttggatatcatattttatattattatatgtagacattgacggtcagatattatgatttaaggatcgttaacagtaccttttttaattaaccggtacctataatatattgtaggtgttattttttaaaaaaagttaccaataatatcagtgatgatttttctttataatcgacacctataattgctcaaaagtgccatttgtatattttttaacctgcataggtggaaaaaggtttatgagtgtcgattttatcatttcctgcatctatggtaccatcctttttgtgtgtttatatggtagtgccttaggcccattggatagaggtccaatacaagcggtagaggagaccttgccttcatctctcccgtctatcttggctgtcgcgcagattaaacgcgtcgtcgtccatgccgggttggtagcacagcggaaggataagttgtacttaagaaatagttcgagcaagtaaaatatatcttttttttctttctagctactttggaatggtcaaaacatccttttctggcaggacaattggcttaatggagccaatccgagtctccgagagttaagagtaggagaacggtaacagtttaatttagacgaggtgttttataatgatctcttgcagtgataaaatctatccaaactgtttatatttggcaaaatttactggaaggcattgtgattttgtgattttagctgctgaacatgataaaagttaatctatctatttttagtagaataggagaaagaagttgtgcgaaatatcaaaactgcccttagccccttcctccatgtttccattctctgatcggccccgaggcgagctgtcggtggctggaatttttacaatttggtctttttaaaaaacttatttcacaaatagatcccaaaagaacttacctaaaaatgatcctttttgggtgccagagtcgctggcgccgttgtcgtcctccagccaccgtagctggtcggtgccgaggtggcagggggagcgcactaatgtggctggcgccgcccatccccccagcccgcccaccatttttcctctcctctcctctctagtgtagatgtgcaacattttttattttgtattattttttttggtattttcttcacaagaaccaaccatgtgacttgtagatttcgaacattcttgggcctttttttacatcttttatatcctataaacacaaaaagttggggtttgtattttttttgttacatttgggtgccatttcttaaaacaggcgtaactttctcatacggactcggaatcaggcaaataatatatccacggtcatttacaaattagaacctccaaatttcgcttgcaagattgtgttttcgaggctagaagcttttcggtagagctttagaaaattctataagtcacatattttgtccatttgagtttatttttttatggttggttcttgtgctcttaagtgtgaaaaaatataaaaaaactaaaataaaagtaaaaaagttgcatctatgtagagagaacaagattgtagaattagagggggggggggggcgccagcatgcaaaacccttgggagacaaggttgctgtaaggtgacaaggatttgatgtatcaatgttccacttttatcatggtaatttagtaacgttgactagttaatttattgactgctggaaaatattgttcaagtaaattatggctatcatttcatgtagttatattttgaattagattaaatatttagtaacgttgactagttaatctattgagcgcattatgttaatctaatgtgttcacataaaaattctattggccacatattttattcgttcgagtttaaaataaaaaaaaaggtcgcaactccacggagagaaacaggattggaggggggcgctagccatgctggctccctcctcctaccacgtcggttcacgtgtgccacagtggcgggggactgtaccaatcatcctggcgctgtcccgttcgaccacggcgacagccactctggcgccatcaaaagaaccattttttagataaatttttttaagggtctatttgtgaaataagttttttagtaggatcagattgtaaaaaattcagctgtccgaagcgcaccaattcaagctctccaacctgcacttcgtcaacgagcacgtggcacgaaagggaaaagggagtcctgttgttagtgtgcggcagtgtggcctccatcctcgggatgtcagatgagggcttgcgtgtggcatggcgccacctgacgtacgcgctcgattttctttagaagtaatactccctccatctacttttgatatagttatatttcatcttggcacacagaataatgataagtaattctacttatcatccatttaaatatgatactagtcatttctcgtaaacaagcgatttattaatatttataattcttaagatccatatagccaatcaggtgtgtaagaatggagagtcattaattaaatccgagaaagtcattaagatgataggttgttgaaagtagatggagggagtatgatttaatgaaaaatcataaaattatatgtcggtcaagtgaaatcgtaagtttagcaccctatcgaacaaccatggttcatcgacagggacctctcgaacaacggctgtttggtaggggctttgtattaagacctatcgaacatgggatgttcgacatgccccttgcatgcatgcactttttattactccctctgtctatttttgatagtcatatttcatattgacacacagatcaaggataagtaattctacttattatccatttaaacatgctactagtcatttcttgtaaagaagtgattcattaatatttacatttctcaatgcccatgtagccaatcatgtgtggaagaatggagagtcacacattaaattcgagaaaatcattaagatgataggttgttggattgaaatatacctatcaaaaataaaactttcagatttaaaaatataactatcaaaagtagacggagggagtattattttcctgagcccatgatcctgtcgaacaacggtggatcgacaggtcctattgaaccaccattatttgacaagcgttaaacttacgatttcatctgaacgacctatatttttgtgattttcattcaaatcgtattatttctaagaaaagttcctctctgcaccgtccacctctcaacagactagcaagatcgatgaacagcttgtcgaactcctcacctccacagcgccggcagcgcccacaccggcatcctgcaaactcttcttatgaataatgggttaatatatttttttttctaaaaaatattatttaacaatttaaaaagtgtacgagcggaaagccagggagatgaacacaaccctcacataaatcgcctgttcgggcacaagcacaatgtccacatccacctcgcctacatgcctccactgaccactgaccactgcttccttcaacctcaacggccagcagtgagattgtctctccggtgaccactcaacatccatcaaagtccaagaggactccgcgaagacaccgatctgccacaacaattactgacattgaccaaggttgagaggatgattttgctgtgcgtgaagctggcgggtgatggtgcatgatctgaagacaaggaaatgtagagatttggggaatcagggaggaaagaaaaggaaggatctgaccagtgggactagctagctaggggcgttcttggccttttatattttctctctctcatattcaaacaaaaataatattttaatgggtgcggtgtttagtaacaaataaccatattttgatccaaagattgacttttgtcatgtgcaagaactaaaaccacgaagttacgatgattacggaaaattttgcctttatattttctactccttccgtttcacaatgtaaatcattctagcgttttccacattcatattaatattaatgaatctagacatatatatatatatatatatatatatctagattcattaacattaatataaatgtgagaaaatgctaaaataacttacattgtgaaacggaggaagtactcaatatttcgcttacgcatgtgcttgtaagacaaattttaaattttaaactttaatttgtaagacaaattttggtgttgatgttgtagtttttcaccattaatgttggtgttgatgctatttaaggacatatttaaggacatcaaacttcgaattactaaggacatatatataaaagttttacttataaattattttttacttgctacttcctccgtttcacaatgtaagtcattctagcactttccacattctagaatgacttatattatgagacggaggtagtaataatcagttgggatatgcatatgcataagtgaacagaagtgaccggtagtacttaaatcataccaatttatactaccaattcaacttgtttggtttgaatatttcttctagttagttgcagtcttgcagatcttatagatcaatgactgggccgactggcggccctttaatgttgttgttggacttctgatcagctacgacagtgcaatctgttaactccggtccaatgtgccttttggcgaccaaaacttggaaacaatcgcctccctgccgctttcattagcgggaaaaatggaggatcttggacaccctgatagctttggataatacggaaaggaaagaacaatcgggttttcaaccgggagcttccaacttggcctgaagttgtatctcaaagctacggaaaaagccaagctatagtgaccaggtaaactataagtcgcttttctggtcgtctcgtaggttgtacttgtttgagtcctctattttgataacgtgagatgtaagattgttgttttattatttgttgtccgctctatgtaactgacagggtgtcactttgtctgtttacttccacaattctctatatgtctaaattcattagtatctaaatgaatgtgggcaatgctaaaaagtcttacattgtgaaacggagaaagtataatatagacaaaggatacaatgggttgagaacaatggaaggaccaaataagtatcatgtataggttatttgcacttataacatgcctcaatgccccctcacatgtgcacacgacattctaattagcttataacagagtatgattagttataatgtgttattttggccttgattcacatgcaccggacaaatttgtgcactgaatcaagcgttttataagttcgtgtactaaattgtatcaacctattccctgcaaaaaaaaaaatcaaagtatcaagttcgtgtatcaccaatacaatttactcatataaaaatgttattgggatgtctgaaaaaatggttttaaatactacctcagttttcatttacttgtcactttgaccacgttttaggtttgcaaatacttgacacaacaagcttaccaaggtagtgattcctattttgtccttgctgagcctaagataatactcccacttaactaggggcattttggtcattttaaacttgattgcattagtatgtggcgtggccaaaagtgattcataaataaaagtggaggaagtagtgtataacatctaagttaagaggctgtgtgcatgctgtaggtgagatccacccatacacttcgccctttttcctcatgataagaggcactagggctgccggtagcacaggtgaatggtgaaacgaaagttttatagtggatatgtagatggggacatagatatgtagatggatgccggtctttgtttgtgggttagatcacttatatgcaccacactagtatgctacagaaagcagcgtcccaaccaaaccttgacgctatcagcgttagcgtccatcctttttcaaaataggatatcctatttaccagatatttaatttttgaattataaattattataatacattgaacatataatactctggactaccaaatttttggcatccctgaattggacaacaaaactagatggctatttagttccatcaatttatttgggcaaggatcaaaaagctccgtgaattatataacacaaattttatatacactacatcttgaagccaggcatcattcgaactttggtagcttgctcataagcataggccatttcaatcagccttggctcatagcccttcaatccaccgaagcaagtaccaaatggcactccttgactgtcgtacccagccggcacggtgatcgctggcatgccactgacggcgaagaagactctcccgttgtcattgggcgtgacaatcgcatccaactggtgcatcctcatcaacttctccagcccatcagcagacagcttattgagatgttggattgaagctttctccaccggtccaatgccgttggtcttttcggcttcaataaaatagggttgtccaaaatctttaagcctctcctgtaacaaagcgtcatacaacactaagttcttgcgtaccttttttttttggcaattaaatcgtaattaaacaagagtgtgctcaaatttaattttctgcattgggttgcaaaatttgcactttcaagaacaaattcatatctaatcttataatttttcaagccaagagaatttgtgatgcaagattaattaattaattcaagtagctcccatacatacctccaccggatgtgccttgttgaatgctatgacatctgcaagggaacgaactggggaatacaacaagtcggacaaataagcattcaagcttaacttgaactctgctatcattgcgatatgctcgttggaaaaaagaacattctgtacttcagtcagattttttgcgatgtcgatgttctcaatcaccatggctccatgtttcctttcattaagaagaaatgacgttttttagaacattaagaagatatgacttaataaacgatgaatgctagtataattcattttgagctattttagccaacattttaatggttctgcgctacacaatatggcacactttttattattgtataccactcaatttgcaagactatatccagataaataaacaaaataatttgttctatgttttccacatgcatattttcctactatatccagataaataaacaaaagaatttgttgtatatgcgatagtttttatcatattattgaatcgatcatttgctgattacagtgcttaatatgattgactgagtcttactttcttttctcatttttatgccagattgccagaaacaaacaatattgactataacattttattatactttcaaacatcatagaaagaatattattttactgcaacaatttctttcttcataaatgatgcttctaatacgaatatcaccaaaatcttttatagactgaatgcacatatgctagcatatgtattatcttttagaagtgctttgtgtttgtgtacctcattaattgaatatgtttttggtatgccctcagctgtttcttctcaaatatttcttgagtgaagaagccgttgggaataccaatcctcttgcctttgaatccatccatccttaagaattgtccatatccaccattaggaatgtacttggatgctgctccagtggcttcagcgtcaagtgcatcatacccaacaatggcatccaacacatggacagcatccgacactgtccgacatattggcctatattttgtcagattaaaaatgttaatagtatataattactgcaaaatgtccactcattcatacatagtcttccatatataacacctatagtatgtcacagtcctagttgtttttctgtgtagttaccatgaagtaaattttaatgcagtaacttttgttaccaaataataaaaagttaccaatagttaaaactaaattagcccgaaaatgtttaagtatctctattttaaatatatctggacaaatactgatatacagatgccgtaacgactcaatgcacacgtttttttccttgcttagaatgtcatatccattgaacgtgcgtgcgtatataaaatcagtaaaaaatgatgacaaatctagaattaaaatgtaatggactagatacacaaccgtatcactaagctacatagtttatggaaaacaaacatgtgttagttatttctcttttgaactgaaatagaacccccacttttcatgagctctacgagatttgtaaccagcaaaacatcatagttagtgaggttatgaggctaggtgacgagattttaacctttagtcgatcatttggtactccagaagctaaggtcctgggaacatttgaaaactgtgattgaatctgtttggtttagtaagagtgaagtcaaaattgagtttgttgatgcttttgggcacttgaatctgtgttaatgcttaaattgtactccctccgttttcttaatatgtgatgccattaatttttagcataacatttgatcattcgtcttattaaaaaaatacataaatatttttaatacatgacaccgttaattttttacataatgtttgatcattcattttattaaaaaaattatatcaatgttatttattttgttttgcatgttttaacattaaaaacattaactatgacctatactttagcatatttatattaattttttgaataaaacgacaatatatactttgtgctgttagtggagtagagttgtttggaaaatatctttagctaaaccgggagattgtttcatacaaaagcaacgcctttggcacttggcatcaaaagaataaaaagctaacaaataaccttgtgttagcacttttttaaccagaaaaattgtgttcatttttaaactgaaaatgaaacttgtgattacccaacactgtcctgtcgaggggagatggggacgacgccggcgcggctggtgagcccaaccgtcggcttaatcccgaccaccgaattcagcgacgctgggcacagtatagacccgtcggtctccgtccccagcgtcaccgccgccatgttcgccgccgccgccaccgccgaaccgctgctcgatccgcacggggtgaacgagcgcacgtacggattcttcatggacaatttcacaaacaccttgtgagcttatacgatcaaatagagaagagaaagaagcagaaattgttggtgcggtggttggtgttaccagtgtctggccgccgcgggcgctccagccgttcggggcggggcggtaagcggaccactcggtgaggctggccttaccgaggataacggcgccggcggcgcggaggcgagccgccacgccggcgtcgcgggggacgacggagccgagcagcgcgaacgacccggccgtcgtgttgagccggtcgcgtgtcgcgatgttgtccttgagcaggacggggacgccgtggagcggcccgcagcggcgaccggtggcgcgctcgtcgtcggcgcgcgccgcctgggcgagcgcgtcggggttgacctcgatgacggcgtggaggagcgggttgaggcgggtgatctggtcgaggtagaagcggacgagcgccgtggaggtgaggctgccgttgctgaagccgagctggatggcgtcgacggtggcctcgtggaactcgaagccggtggcggcggcgacggcggcgagagccatgatggcgagtagcagccgccgctgagccatgagtaaagtaagcagtgagcagtgtctcagcagactcgtgtttattttgcgttggttaattcagacacgaacgccatgagcccatgagtaagcacactaagtagtggaaaacagtgggtttcttatagcagcggagcagtgggacgcctgacgagtgacgacgcccccatttctccattattaattgtcgcataaatgttctcttctctttgctcgaagaaaaccaagtagcttttcgatattcggtattttttatagatgaaaaattttaaaatgcaagtgcagtataatcactactacagaaatggtcaaaaacatattttcgcaaatggccagtggcttgcctccccaagatgtttttaaaaagccaatactttttcaagcgggcagcgcaatcacgcgtgtagaggccgccgcagtcgtatgtgccgtgcgcaagcggttaagttgtgccacccgcctacaataaaaaaaatcatcaaaaagagaaaaaaaaaatccaaaaattgaaaccctacctccggtttacttccactgagggccattgtcgtcgctgctctcatgctcgaccgccatcgtcacctctgccaagctcagcgactacggttccgttgctacagaagccgatagcggcagatccacgctcccaggatgttgaggtcgttgtcgccgctcccattcctggcggtggtggatccatgctcctgaggccgcggctgttgccgtcgtcgctccttcccgagcgatgagggattcacgctccagaggtcaccgtggtcgtctgtactgctcccgtgcccaacagcggcgggtccgcgctctagtggccaccaccggatgatctacgcactaggaatgggaagtgattgttgacggtcattatcgaccagtttcgaccgtcaatattaccaaaatagaggagaactagtgatgtttgcaatgcatatatatgttagaataataatattccactagtattaggttcactaaccttttgcagagaataaccataaagtggaggagaatcgacatcaactcaaacgataaatcaatcggacgatgtcgagaaccagacttatgtataaatgggccaagaactcagaattgacatgacaaactgggctaaaaatcacaagtctgcggagaagaacaacagaggagtccgccagccaaaccatgggctggttgggccggccccaggttcagccgaacctccctcgtcgccgttggatgcagggcttcttctggatggtgtggattagctcccaatgacggttggagggtatttccgaccattccaaccgtcataaccgtcattgggaggctatataaacccctcaccttctcacttcactcacacaccttaagcaaagctctctcatattctctcaagtttagtttagttctctcatattctctctcataggaatagagtataaatcaggagtccggaagtcttcggaagagttcgggtatggctctagtagctttcctttcctcttttgtaagctttgtacttttattagaatactcttctttatacatttatgatattgaaatactttccgagtatataaatgcctactttatattatgttcatattatactgactatactgctagcttatctgggagatgctttggtgcgggtataatgtttgcatatgcaattactctatgtcatgacgatgatattagagtagtatctggtagtttagacgtagtgtctagattacgggatatcattatttggggttatatgctgcggatgagaggtgggccgctgatggtgacagctcactacgggtattcctccgcgcgtgtatataatcctaagttaattccatagggagggtattcctctgtatttagccctggttgtatggtcatgacgggctgttataaggaactcggcagtcaggggtggcttctcgaagtaccaggagggcatcggatatatggtattagctagtatatcagttaactagaatgtatgtatatatactatgtatattagaagtataggaatagattatctttctcttttctttctacttagcttagataatatattatgagaatgagtagctgatgcttgtgtgtcactctacccttggattatcttaacccctgcttagaatatgattatcacaagtaatatataaattattagtcaagttctctctacatgatcttcccacgggataaaataaatacgatacccttggaatactctagggtgaaatgctacaatggtatatccatgcgcttgcgtatgaactctgtaaccataatataccaggagtatttctgcgccattgctaggaattatatttctattaatgtcgttaagaaataccaacagtgatggaaggaagaggtcgttggttgatcaacccctcccattgtcaccgccgatgccggatccttcctagctagggccacggccaacggatctgttgcctttcgtcaccgccaccagatttgcctcagccgacgaactccaacctccgccggtgccaccgccgcatcacagacctgcatcgactatgccgagggtagagtgagaatgagagaatggagatgctgagggtagaggaggagaggttgaaaataagaagctgaggaagatagagataaaatagtgagatagaggagagaggttgggtgatatatagagagaagaagagaaggttgtgttgatcaggtcggtccgtgcgcctgtacgcagtaggttaagatgtctacctgtgagaataggtttgtttttttagactgacctcttaatacgcctgcctgtgagaattgattttcgcaagtgggttaatacgggagacccgaaaatttttacatatgggttttcttttggcccatttgtaaaattaaaaggggttgtctgcatacatcatttttaagaccgtcagctcatccgcctccgcctccgcttccgccgacgatgcggacgccgatctcgcggcgccgaaggaggaacacggcagtggtggacacggcgacgacggagcggaagaggaacacggtggcgctggagcggaagagaaacacagcagtggcgcggaagaggaacacggtggcggcggatcgggatttctagggctacagtctgttctcactgcacgcgaagttacgttttagcccttccacctcagttcttcacgtggcactgcaccagggatagaattggtactgcccggtaccaaactctaccagccgttggattggccagatccaacggctaggattttggtaccgagcaatactggtaccgaccgctgtaccgtaacaacgctccatttttaaagtagtgaattatagtatagttacataactagtttataattaacatgaaaataccttgcacgaccagttggttagctccataggcttcctcacaatctgcacgaaacttgatgtgaccgaatccgaaagtttgtggaaaagaaccacacaaaataataaagcaaatccgatctgcacacttttttctctctcgatctgcacgaatctattggtagatttgtcttgaaaagcacttttatatatactttaatagcttttagaaatagttgtgataaaacatttgcattgaagaccttgtcattgtacaacacaagtaaaaaagaatggaggtagaattacaatagattatatacctataagattggtattttaaataactaactttaacctaatctctttttctctcacttatgtattaatttgtgtctctataggagcacgtgcaagggtgattgttgcatgatagtcaatgttttccttttcaccaatttcgtatttataattactgatagaccttaagcttcggcaggacttgagctccctggttctcagaccaccaaattaagcttcgtagaatcgtagcggcttccttgtcatccaccccgggtaatggtcaaacctcctatccttttctaggaggacagttggcttgatggagccaatccaagaattaggaaaaggagaacagtagcctacagcaaaaacacaatggaccaatgacattcctggtgcacttggactggtatgctgggtggctatatactctaatacttatcaatttggagatggctacaatcaatcggtctcactattactaaaagacacatacaagctggcactatagatgtcggaatagctaaaatcgacacctatagtacttttctcaccttcaaaaggatgaaagaaaaactgacacctttaagcgaacgtgttggttttaaagaaaaaccgacaccactaatatagatgtcgatttttaaaataaccggcactattataggtgtcggtttattagaaaaacgacaaatataggtgccgatttttaaaataccgactccataagatcaacccgagccgacgggatgcgaggggatatttttgacccagtggggcccacacccctatggagaggataaggccacctccagcctctcgatccttccctctctctctctctctcgttcacccaacagctgtgggatgggcagtggtggcccgatgggaggtgcggcggtgacccgtcctccctagtagcgatgggaggggcggcagtgcctcccctctgccagatctaaccgggaggggagtcaatgacggcccgatggcgccctatcctctgctagatccggtggtggcacgtcttccttggcagtggcgagaggggaggaggaggtggtggcgcctccccctccgctagatccggctgggaggggagtcaacgacggtccaatggcgccctcccctccaccagatccggtgggagaggaggcggcgacctgacgggacgtgcggtagcggcccgacgggaagtgcgcggtggtggtggcgccctctcacccggcagcaggaacataaaggattgatgtgttatttatgttgatgttgtgtttttgatgtttgtatgttcttgatgtttatgtgtgtgttcatgttgtatcttgatgttcttgtctatgaattaaatgtggtatataatatggtcaagccgatgcaatgagtaactccccatcaccccaagccgatattgttgttgttcttcagtctccccccccccccccggcgcgagctggcgtctttgaacaattaattcatcaactgttccattgatcaaatttcacaatgtatccaccaaaactccagattcatcaagcaaagcacgacgaactgcttcatcaactatatcttgaagtgtttcaatcatcggattgggaagacaatgcttttgaaaatcagccactgaatcagcccttgttgcgttatgacgaaacatcgaagacaatgcttttgaaaatcaggcactgattgatccatctattacctttgttccaccatcaaattctccattgcgaccaggatattggcgttgacttattcagacatgtaggtgtaaaactcgtgtcccaccaggcatgccaaaagagtgttgacaagaaatccgtgctcggccgatagtgccaggtctatgttgatacaaactaagtcgacaaacacaacggcatgggagatctgcttagctctagtgcatgtccaaaggccgatgagatgcaagcgtgctagtcagtttgatcgtgcaactgacaagatatgtaaacagttgatcaaatagccgatcggctgaccagctgatggagcaattccatccgatgccgatactagccgatagcgatagggttttgagctatcggctatatgtttgatgtagattccgacactttatgcaaataaagacaatcggctgatgatgataaataacaataatataatcaagtacaaaccaatcggctaataatgataccatagaacaagtattgatccgaaggttaaagcatacatcagttggaagtccgatgtcataaaatccacaagattagataaacattgaaaccttttttgcgatcggctaaatccaacttgtatgtaatccttataagccgatggaacgtccagataactcatcggctgaaaccctgataaaacccttattggcaatcaaaagcaggccagagattatgtttctaagcacgacttagtaggtcaaatgtactgatgcagcactaagtatgaaaagaaacataatatctagacaatcaagcccttgactaattttcagggtggtagataccttagctaatataatctggtaaagcgatttagccgataccggcataaacactaaagcgcatctcaaccgatataagtaaatcgaactaccaagctagattaaggccccgtttgtttcagcttaggattattataatctggattattaggagtaagctgaaacaaacatatagcttattatgatagattattataatctataagccagattactataatctagtaatccactttaaaggtgcttttttagattattgggtggctaacacctaacaactagctaataatccaaagaaacaaatggctaacaacttattctatatcggcttagtataatccagcttatagtactctgactcaataatgtagagtacaataattttaagctgaaacaaatagggcctaactaagatatatgatagataggtgcttacattgacgagatcagattgtcgaagccctagccccgccgatgcaaacaaccatgacaagtataaactcgtcgaaaaaagttgaaaaataaaaatggtggtgatgcgccgaatttgtattgatcgagagatagtttacgatgaccccgggtgtacatatttatacccatgggtagatacaagtccttattggacaagaaagaaatcttcctaaagataaaaaggaaaacataaagtccttatcggacactaaacacactttcctaaagataaaaaggaaactatcggactattcttaattaatagataacttgccatatctcatcctccttaactcggttattctggataaacttccttgaatagatctgtttcctgaactgaatcctccaagaatccggctgctggtgacttgataactcccatcggccgattctagaactctgtagacgatattgattttaggaagatgacaacttctgggcttaccaaatttcgccattaacatcttggcagtggttatttgaacatggaggtggcatagcagttttacaatgtaggggaaaaatagtcctgcagtaacaagagatatcagttttagtagcgagacgaaaaaaaactacagtaacactgatgggggacaagttgtaacatactagatttttcatggtaaaaattttgcgaaaaatctttaaagtcactgttcttcgttgtttcgaattggagcctcccaatctatgtacttgttaacgccaaaatttggtaagccctggagtcatcatcggccctagagtcagtatcggcttaagagtcctagaatcgaccgatggaaactatcagtcgccagtagttgtattcggttaaggaaattggtcaattaagggaagcttatctagaagagtccgagttcaagaaggatgcggcatagcagattatctattaattaggaagaatatgttagtttccttttatctttaggatagtgtgtttgctgtccaataaggattttatgttttccttatatctttaggtaagtttctttcttgtccaataaggactagtatctacccatgggtataaatatgtacaccaggggtcattgtaaactatctctcgatcaataaaatttcggcacatggccaccttttacctttctactttttcggcgagttcttgcttcgagttagggcatcagcttcgatcttatgataagaggtatgacttgtctcagctgtttgcgttggcatattagggcgtcgctttagatattctaatctatcttttacagcagttggtatatatcttagttaatctagcttagcattttaatttgatcatatcggctgagattcgttttagggtttatgctggtatcgactaaattatcttgctagattagattaagtaaggtatccaccaacctgaaaatcagtcaaaggcttgattgtctacatattatgtttcttttcatactttgcgttgcatcaaccccagtcgtgtttagaaccataatctttagcctgctttttgaatgccaataagggtttcatcggggttttagccggtgagttatctggatgttgcatcggcttacgaggattacatacaagttcaatttagttgatcgcggcgaaggttttattgtttatctaatcgtttggatttattaacatcggaccttcagccgatgtatgctttaaccatcggatcacttattctatcataattattattagctgtttgatttctactggattgtattattatttattcaagtatcagaatatacattggatatatagccaattgttcaaaaccctatcggcatcggctgcaattactctatcgggttgtcagccgatcggctatttgatatttattttatatatcttgtcagttgtaggatcaaactgactggcacgctcgtatctcatcaatttttagacctgcactgtagttaagcagatctcccagaccattgctcttgtcgatttagttcacgctaacacagatctggctctgtcggctgagcgcggatttttcgtcaacaatattccttttgttccctctgagtttccaccttccacataatttcttttagcttcctctccaagccaaatccaagatatcacagagaaaaattcctaaaaccatcagagagctcgtgtttgttttaagttatctcggagtcaccgtgcaaatattctaaaatccccaatctcatcgtttcctgttaaaaatatcctgccaaaattctatagaaaaatctcttcaaaaattcaaatagatcgctgtgtttcttctcgggccgaattcctagcaacccagcccatcatcgtccaccttctccctctgtttgggccgtgctggcccatggctgctgttgggccagcaaaggcagccgccactcgcgccgtcctttgtgtacgcgtattcaaacttcatgtcccgtacgtatataaactttgtatatgtatacgtgatgtattttctatatgtgtatataaaatttgtatcccgtacatatacacactttgtatatgtatatgtgtataaattatgtatacgtgatgtattttctagtttttttaatatgtacatatataaaattaatttgtatacgtcatatataaactttggatacgtatatcgtatataaactttgcatacatgtatatttttttataaagaatatatttttattgtagtagtatagtagtagtaactgtagtatattactagtagtactaggctgcgccgcgcgtggggctggacgcgcgcccagccgcccattagcgcctcgctcctggctgctctcctccgcacgccgccacgcgcacgaaggaacttgatcagacggtgcagtctttgttgcaccaatcttgaaatcgagcaagcaccactgccaccaacaatctccatcttcactgcccaaccatttaagcaagcatggtacttgtttgcccaagaagaaatcaaagtctccagatcacccctatctccaatttcttcaagccacgctgccgtggtcgtgtgctgatccgctgccgctagccaccagcctcttcctgagccggtgaggccatctcctcatttttttttcccctcttctccatgcttgtactgagctcctcgcatgctcctgcccgccaccatggccgccaccatggtcggcatggccagcgccacatctctatcaactaaccataaaaattgaatctcctcgtccgggaatacgttttgactcgctcacccgtctgcgttcgcttccatgcctgaggtcaacatagctctagatctggaactcgcgttccggctagctctgttgtcttccagcccagcgtccacgtccgatcctgcggggggtgtcaggctgtggaacacatcattctaccatctctgtcgctgtttcctcactggagttccggcgtccttccctcctcctctgttgctcacgtgagagctaggggaagaagacgaacagtgccggttggcactgtttcctattgaacccaaccaacttcatcaaaacccacttaaatagtacctaaccacaattaaaccagtccaaactattatatattagagttttcgttcggtttacctccgattcaagcctaaaaaaccaaatcgatttcagttttcacctatgttatctatagcgttaatcccaaagtgcaaccactacttcacagaccatgaatcataacgctaggataaatcttttgccatccaaatcaagttaactcttgattatcgttttcttttgttcaggctccaattcacaatatttattttatcgtatatttgtagtatctattatattattaaaggaatagaaaaaagagcctccacgttcgctctcatgacctaaaaattctcacattaatcggagaaaaagaaaaggcagaatccatatagaaatacaatttagaaatagctgaaattcagaattaaaaaataaggaatattagaagaggagactagagtccatatagaaatataatttagaaatagttgaaattcggaattaaaaaataaggaatattagaagaggagagtagagttcatatagaaatacaattaggaaataaccgaaattcggaattaaaaataaggaatattagaagtagagtatagagtccatatagaaatacaattatgaaataacttacattcggaattaaaaataaggaatattagaagtagagtatagagtccatatagaaatacaattaggaaataatatagatttggaattaaaaataataaatattagaagtagagtatagagtccatatagaaatacaattaagaaaaaaaaatagaaattcagaattaaaaaataaggaatattataagtagagtaaagagtccatataggaatttaaaactaactaaaatttagaataaacataataaaaattaaagtagagtttagagtctgtatgaaaatacaatttacaaataactaaaattcgaagttaataaaaacatgggaagaaaagtttaaggtcaatataagaatacaaatataggaatacaatttagaagtaactgaaattcgaaattaaaaattaaagaatattgaaagatgagtttagagtccacatagaaatacaattagaaataataaaaattcaaaaataaaaataaataatattggaagaagagcatagagtctatatagaaatacaatttatagaaaattcggaattaaaaaaaaagaaatattaaaagacgagtctagagtccatataggaatatatataatttacgaataactaaaatttgatattaaaaataattaataactaacacatatataaaatataatatgaaaatttagaaataaaaataaataatattagaagaagagcatagagtctatatagaaatacaatttacagaaaattcggaattaaaaaaagaaatattaaaagatgagtctatagtccagatacgaatatatataatttacaaataactaaaacttgatattaaaaataattaataattaacacgtatataaaatataataggaatattacacattagtagttttgtaaagttattgcaaaaattaaaattatgttgtcattttaatatatttcaataatataataagaaaacatatatgctattatatgagaaaagtataatgatgctagctgcgcaatctgcgcgggccaccatgctagtttttattataggattatttggtcgtttattcgtatgtgtatgttggatcgtgtcggagatcccaccggacctgcaggaactgaagtggacctagaaggctacgttgaagcttcagaaggccacgttccacaaggcaagacacagttccaatctttgatcatattgaaacctagtagagaaccacttaattattttttgcattgagtatttataaaattattttgcgtatgatttatttttgaataaatttgttagtatagttattacccattattacgttgttattattggccaaacccacgaattgctatatcgtgtcctttgataacctaggtgtaggtttatatacttcacaataacattgtagtggataagaccaccaaatatctataatcatatacttattttacccgtcgtcacatggtggcgtgtcgagtgacataaaattggttatttgatataagtcactcccctggagtgatatggaagattaataccgtgtgaagatggatgttgtggtttgtgaggccgtgcatattattataattattttgtggaatgtgtatatttacacttggagtatgcatgggcctgtgttagctttggtggctttccccggatataaggactaccctcttatgccatggaaaatgttgtaattttgcgcccatccacaggactaagtaatcagacttagactagtacattgtcccactgtatgaaagactgcagggttactctatgagcaggtttggggtggacttgtggaaggggcttccgccaggttgacataatccataacagtacgaacccgtgaaagcaatgatcatctagcattgcttaggcccagcaagtgcccgactactaggacagatcaatatcccgctgggcagtaactagtagtaagtgggactctcgaatagctatgttgtcctcagacttgcgaactattgacatcatgcaggtaaagctgggcagtctctgtagagatgagtcttgaatcattcgtatgtgccgtgcttccggttaagaagctgtgtcattgggtgattcctatttatcatggtatgagtagcttttaaattaaaacatatgaaatatgtagaagatgaggatgaatggtgattaatattgctaccattttaaaatgacgttttacaactatttgcaaatgaaatgttttataaagtagggaaatactatttatgataggcttgttatgaaacctccttgataaactatattccttgtaagcccagtgtgtgtctgtgtgtggcgctacgtgaagcgacacaaacggtgtgtgccacgttgctttggtggagcgactcgcaggagcgccccgtctgtgttttccctttttttcatacggtcccatcgcctaacctcctgattttccgtttttcccatgatcgctccccctgacccggtttcctgattccaagcgtatatcccctttgggactacctgtatatttattgacaaattttctcctaaaaatttgatagatgtaattatagtacaatcgtagtgtaattacactgtaacttatatgtaattacactgtaacttgcatgtaactacagtgtaacttatatgtaagtttcacataattttgaatcgttagatctattacaagatttgtttcggtgaggaagaaaacaaatcatagcacacacatatgtgaaagaatttgttcccacgacatccattttaccgaaataacatgttatggacagatttttgaaagttacatacaagttacactatagttataatgtaattacatgcaagttacagtgtaattacactacgattgtactgtaattacatctgtctaattttttggggaaaatttgtcgacaaatatatagcaaaatcgatcccgtttctattctaacgagtaaaaaaaaaaatcatccggaccctgtttggttcatgtagtaaagaaaaatattccttaagttaaaaagttactaggccatgaccactagtttctccaccagacttgtgacttgagtaaaaaaattactatgtctctgttcagttaattaggttcaccagatttgtttagtaaaaaattgactatcaaccaacttctaaaagtaaaaagtttactacgtgtcatatccatttttatctgctaagaaaatttgtcctctaagtaattaaatcgttttattaatcttttgtatttttttctcccacattcatccggtagtagttcagttaaaagattcctgagcgaaatcaggcgtatatctacatgtagtaaaaattttactccatgcaagttagaggtcgataatacttgtcaaggtcagaaaaaattcactcccttatacttttcacatcactttcggtgtgtttgatagtaacttttttactaactgaaaatatgacattgtgaagggaataatttatttactgaaatattcaggttgaaaatctaattagtaatatatttactccgttctacgagacaatattcagggttaaacttttgcactgagaagaataaaacgatcagtaacttatttacaaaatatattattacatcgaattatatgattgcaaaaagttttaaaaaataatacaaatggaacaagctatagcaccgcctgtcttgttgacggctgccgtggcaatccaaaccgtcaccattctcacattctagaggagacagcaaggcagcatatatacaagtacatacatagcactgtcggcaacacaacgagaacacacgaaccaccatagaattaacatgaaaaataacgcatagcactacgccaagaaaacatgaagctagcatcgggagtttgggatggagcaggtcgccgggattattagtagtgcctgaaaaggattgatttagaaatcaccatctgaaatgcattattagttattcatttagttcagcattggtgacaatattttttcagatcacctgtatgagtgcacttcatcttctgatgcacctgcatgtgtcattgtttgggttaaaatatgctcctacaagatgaaattttgctctacactatgagtaggcaggattagtggattgaacaaatattatgaggctatgagcattgcataggataggcgatgcttacaggttgaaaaaacaaaaaaatcatgaaaactcatagaaaatctagatggggatttcatggtgtatattagggtgaaatgacaaatgttgatcgtatgaatcaggcataatctagttcagtggacaatcaaaattgtagcaatgacacgcaagatcatagttcttctattgttttcagaagcttagaacaaccctgcatgcacgcaccagaatagtcagatgatcacacatatatagcaccaatgaaacgaccagacaacaactcgtgatgtgtattattttaggtacgatgtatctaatctactcactgaatcatgcatgaatatatggatacacttcaatatatagatcaaacaaccataatgcagaaggcatgaatctgttgggaatcaaagcaactcatgtgaacacagtggacacaaatcacacttacacgtgaagagtacaaggaagaagaagaacacaacacacagagtatttgtgacaccacgcacaacttgtgccttttctctttcttttctttactccacacactaaacggttacaatgagcagctatttataagctactaatgcacacatacactggatgagctacttgatccactttcttcgcacacgacgccccacttccttggccgcatctcctcaaggcctggcgatatgctagctgcatgcatctaggagaactaatccaccacgtgcaggcctaactaactaatccatgcaagactcggctaatcacttgcccacaattatgcatggctaactaactaagctacatatatgtgctctcatctcctggctcttaatttattggctcactactcactgccaaccactactcactgagccatgcagcacagcagcacccacgtacatatagctagctctccaggccatgcaacacacacatgcatatagataaacatgctgaaattaacaaacgacaagattaatttctaacagaatcgacgatcagtcacaacatcaaattgatttgatagttgccaagatattgatgatctattggatcagttgagaggtgccaagatattttctaagattgagctgagatcaggatattatcaatagatgattaagaaagaagataggcgaaagacaacatttacaacaaggtatggactgtaccaattcacagttatgccatttggagttaccaatgctccagctgtgtttatgagattgatgaatcacacactgttggattatcttgataagtttgtcattgtctttcttgatgacatccttatccactcaaaaagtaaagaagaacatgtgctgacggtcgttatagacaaatttcgaccatcaatatatccaaaataaaggggaactagctatgcttgcatgcatattttgtttaagaataatctatctccactagtacttgaaattttatttgtttgaagagaaaattacgtaattggaggagaatcgatggaaatcaaccgaacaatcaattgaactccattgagaggtagacttataggttgatgggcttataaatccagtgaaataacaccaaatgggcacaaccaccacaccacaggaccgaggaatctacaggaggcacaccttccaaattgtggtccatttaggccaggctagggttcttcgcatggaaagcggtagaggctgatccgtagctttggtcgtcgcactctaatccgctttagaagaagcagccaagttgtttcttctcccatgctggtcctatttttaactatacattggttacgcaccaaggttatactaaaaagtcgagctcacgggagttggttactgttgcgtgtctacacttgcaggagatggcgaatgagagtcttacctaggtaaattggtggcgatttactcttggtactgatggtccttaatgcttcttggacctcccttcttttaaattggttcgcatgtgttttggctaagcgcatccttgttatagagacgtcgagagtgttcttagcgtagttgtatgactttgatgtaatagaacaagtttaatagaaccttccattatctaaaacaagtaacctgttaccatggccatccaccaaacacctagctgctcgctaacgacatgttattgggagaaatgcgcggtgacccatagacatggcacatatgcattcaaccaaccaatttatgaccacaaagctcctacgccttacagactatttaaagaaatcacgtcccactttcataatagcaagcaactcatcgatctaggttagctagttcttgttgcattgaatcatccctcatcaaatcattaggatatatacttcatgatggccaaggtcattgcacttatgcttgtggttattacaatgtcaaccatgttagcctcacccgtggaatgcgccaacaagattgctggtatcatccctatttcggcatccgcttacaactttacgacaatgattgatacctttaaagtggccatgtgagtgccaacggaggattgcaccgccaatgttgacacatgcataagtaacacatgctcctacatccgaaaggccctcgatggtgttgttgctgttgcactaccagcaaataaggcggaaactttggaggccacgtccaagcaggctacggttgctgcctctactctcaacatggccaaggctacaggagaaacgaaacaagttgccgcggtttccatcgtctacatgattgctgctgatgcggttgacgcagccgtacccgctgcaagcttagggtaatggatgaaacatttaaagcagccgctgctccaatcgcttgagcgagcaacacctcatctgatccatccatcaacgaagatggaacatgctaccacaactaccaccagatgcaccaaatagcatcacgatatattcctcatgtaatgcttttattatttaaactaatgtaattgccgttttttttcatatagtcttactcatgctaatgacttggtcacattggagaaaagcgttgttggtcgagccatatggctcgataagacctactgatatgttcaattgtctcttctattttgtattgcaatttacaaattggatgtttatatatagttgctccgattaaagggctttgcatatgtatattcgtacatacccgcacatatatatacattatgaatgttgttaaatatgaatttaacatttgacaactatacattgtatttgtatgcaacattaacaaaactcacaaacccatcatgcaagtcaaaagaaaaaggttaatcatgagaaaatgtttgtgtgatcctgaaccacacaattttactttatgaggttaccttcatgacaaataatttattgtttttttacgattaacggtttcggacaaatataaatgtttctaacagagcatgtggacttcatatgcatcatttctaccggagctttgctcatctccattgccatgtcattggaacagcaaaatggtcatatgacctcttgttcatgccgttggcacaagaacatgatagctgggacccaacttggcttcagccataggtatcaacagctataacaaaagagaatgctatgcttggacccaaaggaaaaaaaaattgaaaattggaagcaacagattgctctagattgtccctagaattggtatcggtggtggtgcgcgaggaaataactagaagtgtttcctttgggattaagccgtggcagaaatcaagttgtttgtggtgacgatgttgctgattgaaagcaagagcaatagtgatgtactctaggtgaggatggtcattcatccatgagagaataagaatactccttgcataattaattattagaaggtaggtgtgcaagagtctcacactaactcgaccttatactataaaaaactgtaagttaaacatgtaaccatctatatacatttagagcccattctaataatgatttctatgttacttgcgtcacgggacacttgtgatcctaaaactctgcattccaatttgcaaacctaagtactatgttgagaatggattataacaacctgttaccaatagtaaacataggaaaaaaaattcttatattgcgaacttgtacaatcacccaagtcttatattaccagcttctacaagcaactttttagtcaacctgaggactctcattttacagcggatgaataaagaacagaggattgtcctaggttacgaagttgaaaaatgagttccttatgacacctttacagaaaaatatgtccgggtagctgtgtttgggatagaacataataaggcccctagaccggatggtttttcagtgtagttctataaaaacttttggaatatcattaaagaggttttaatgaatatattaaacgagttttatgcggaagtcctcccactgtccagccttaattttacggtaataacacccctttcgaaagttcaagatgcatacataatacaccaatatatagaccaatatttttgttgaatgtcggtcttgaaattttcaccaaggttgcaactaatacagttaattctctgactggtcatgtcgtgagctccacataaactgccgtcatgcgaggatgcaacatccaaggtggtattgttaatctacgcgagacagtacatgaattgcatcacaaaaaattgaattttgtgatattaaaggtggaacaaaacgcaactggcaaggcgatcaaaactgttatttctctaccaataaggaggcaattagacatcttttcttttaatgttgctcagcctacttagtttgttccatcatttatatgccatctagaattactccacctgataatgtttcacatgtgttcacactagttggctgtcaggtatttaaaaagatatgcaaccatatggggtggctaacacgtgtaggttggcttgcttatgcaggaactatatggtttcatgaccaaagatactcggcttcctcttcatcaaatcacgaaaatcaacccttagttagctgcaccaaaactagagcaggcccaagacaagcaagaacagtcagtcagcaccgcttaggcaggaagcagatagtaagctaagaatactcgaagaaggaggtcgctcagccgaagccctagttcaaccagaacagtagggaaagcgatagaggctgctccgtagctttggccgttgcactctaatcagatttagaagaagctgccaagttgtttcttctcccttgatggagctatttttaactatacattggttacgcacctaggttatactaaaaagtcgagctcgcaggagttggttactgcagggagtctacacttgcaggagatggcgaatgagtgtcttacctaggtaaattggtggcaatttactcttggtagtgatggtccttaatgcttcttggacctcctttcttttaaattggtttgcgtgtgttttagctaggcgcatacttgttatagagaggtcgatagtgttcttagcatagttgtatcactttgacgtaattgaacgagtttaataaaagcttcgattatctaaaacaagtagcctattaccatggccatccactggacacctggctgctcggtaacgacatgttattgggagaaatgcacggtgacccacagacatggcacatatgcatgcaaccaaccaatttatgaccacaaagctcccgcgccatacagactatttaaagcaatcacgtcacactttcataatagcaagcaactcgttgatctaggttagctagttcttgttgcattgaatcatccctcatcaaatcattaggatatatacttcatgatggccaaggtcatcgcacttatgcttgtggttattacagtgtcaaccttgttagcctcacccgtggaatgcgccaacaagattgctggtgccgtccctattttagcatccgcttaaaactttacgacaatgattgatatctttaaagtggccatgttagtgccaacggaggattgcaccgccaatgttgacacgtgcataagtaatacatgctcctacatccgaaaggccctcgatggtgttgttgctgttgcactaccagcaaataaggcggaaactttggaggccacgtccaagcaggctacggttgctgcctctactctcaacatggccaaggctacaggagaaaagaaaaaagttgccgcggtttccatcgtctacatgattgctgctgatgcggttgacgcagccgcgcccgctgacaagcttagggtaatggatgaaacatttaaagcagccgctgctccaatcacttgagcaagcaacacctcatctgatccatccatcaacgaagatggaacatgctaccgcaactaccacctgatgcaccaagtagcatcacgatatatccctaatgtaatgcttttattatttaaactaatgtaattgccgggttttttcatgtagtctttctcatgctaatgacttggtcacattggatcagagcattgttggtcgagccatatggctagataagacctactgatatgttcaattgtctcttttgctttgtattgcaatttacaaattggatatttatatatagttgctctaattaaagggctttgcatatgtatattcgtacatacccgcacacaaatatacattatgaatgttgtacaatttgaatttaatatttcacaactatacattgtatttgtatgcaacattaacaaaactcacaaacccatcatgaaagtcaaaagaaaaatgttaatcatgagaaaatgtttgtgtgatcctgaaccacacaattttactttaggaggttaccttcatggcaaataatttatggtttttttacgattaacggtttcggacacatatagctgtttctaccagagcatgtggacttcatatgcgtcatttctactggagctttgctcatctccatttccatgtcattggaacagtaaaacggtcatatggcctcttgttcatgccgttggcacaagaacatgatagctgggacccaactcggctttagccataggtttctatagctataacaaaagacaatgctgcgttgaacccaaaggaaaaaactggaaaattagaagcaacatattgctctagattgtccctagagctgatatcggtggtggttgttggaggctgttaaatgtcgattctataccgccaacatatgcataaagttcaaatactaaaacatccaacatagtgatagttgtttaatctcacatatttcacaagtgttggtgtatatttgtatgcaggtgttaaaccccgaagttgggaagaaatctagactaaagtgaggagaaacatgtatccatacaaggatgggttgtgaactttatcaaaatatcagaaactcagcccaaaactccgagaaatgggcagaggagggtcaggggagtccacaggccgaaggccaggccgggagggcccagcctaggttcggccgaaccccgctggtcacgtcccgtttttcgtgtcttctaatttgcttaattttgaaaattagcattcgcgtttattcgcctaaaatagcttaataaaaatttcataaatggaaaagggtttaatttgactaaataaattaattacgccacccttttattttatcgtttgtaattggagttatttgatttttatttggcttttggaagtggagctcgttctcatgaattctgtcaaatccttaaaaaaaataagtcccaaatccagaaaatgtcaaaattccaaatccttccaagttcatacttttccataaaagcatcccaatcgttatcattttccttgctttctatttttctttttttcgcctattcctttctttttccatttcctccttaagtcctggttgatacatcccttgtgtgttctaatctctcgttcaatctaatctctcccgcgatctctctttctctgtctgcaccagggcccgaccaggaggagccagcccaagcgccgctcacatgtgttctgccccgcacgtgtttctgcttcgtcttcatccatgggcatttctacctctccatcaaaacagcagcgcctctttcaattcctcacggatctcttcctctccttcatcaattttctccactaacactaaaaattgaaccaacttgtcgatctgaatccgtttttgcaattcctgatgacttctgatctcccaaccactcacctcctcctccacacgcgcatctcgcagagacgatgaacagccgcgtcaaatgcaaacgttagccatttaatttctagttgattgcactttccatccaccatgaatttaatcatctgttgatcatcaaccaagaaactaaagcagaccaagcaccaaatcatattacactacattatctccaattgaatcaccatgaccgagacaaacctgtatttccaattcccagtcaattctctcaactctccatcttcgtcctccctcagccacattactgatcttccgggaaactgagctgtctcctcgagttcctcctcccactaattaatctctccctctccctcaccaatctcattatttaacaccaaaaattaaatcaccttcatgagcatgagccatttttgtaaaagccagtgactcctcatctcctggctgcttagctcctattcttccctatatatagctgcagcacccctcctcctttcctctttgtttaaccagcgcagccaccgccccgctttacttccacgccaaccgtgacacaccgtgtgtgtgcacgtagtgccatgtgcagccaaagtcaccacgttggctactgcttcatcttcaagcacgatgtttctgctttgctatatatgaaggtcatgatgcttccctcaattccctgctcgtcccttctgcccctcatctgtttccattcatcaataccaaaaatcaaatcaaattgatgagcttgatctgtttttcgaaatctcagccacggccatgtcttgctgttggcacggagatatatcaaaccgtcaacgcgagaacgagcagctgcatgggaggatcatgttagtgatatgccctagaggcaatcatagagatgattgtatcacatactatgtttacatatttatccgactttgttccttgaaatagataactcattattggttaatgaatatgtgattctttcatgagactctttatgttgtgtgttgctatttctaaaggatcactgatcaaatattatatgtggaacaaatctatactactttctataaagttataacccactaactctaaagcttaacatgcaaccatgccacatcatcacatgccactaacaataattacatattcaacctcatgcaagcatgcaagagcatctacagtctatttaattctacaaattatcatgcaagcatattcaatcaccacctctcacatcatttccacaatagttttacaaatctctctatcatttttataatatttaatatatacttatcaacatgttctacattaaagtacgaatttcatttgtttcatgataaatattgataagccctaagatttgatttttttttctttttactcctagctgaattgtaagaaaaaaataatattgaaaattacttagtaattcacgcagcaaagcgcggggaatcccctagtatgtttagatgatcaacacatgtattaattgatgttcatgtctcatggatcatggtatagagataccaaattaataatgtggacacatgttggtgaacatgttgttggatagacccaacatgagacactgcaagagccatatgtgttgtgtcatcagttatctcatttagtgttggtgttgaatccttagacctgaaattattatagttcccaacatgtgtagtagcttacttagggactgctaaacgctactccgtaattgggtaattataaaagtagttttcgggtatgctatgaaacatgtagtgggatatgaacaatcaagatgggatttcccctcctatggagagatatatctgggcccctcgatgttgtagattatggaagttcatggccatgccaaatttgattgaggagtcaatcagaagttatataatcaatcaacaggttcgagtgaatgattgagctattagaggatggcacatatttagccttgagcttaatcgatatcgtgaggcaaaggggttcatacaagtatacactaaaagttcagcagatatgatcttaatgtatgcccggtgggtcaatacattctgctagaggccgctgttgacgcatggaccgaaaaggagttttcgggttacagccgagtgtacatgaacttataaggtcgcacgcttaatgggccggaataaggggattggatggagatccaatatgagcttaattcggatagggatccgaagaggagtcctacgggccttggaggcccgagtgatggatcctatatattcgtgaggggtgtgaccggcggaggtattgcatcacgtgagaaaccctagttgtcagtcccctcccccagcaaaaccctagccgtgcgcgggtgctagcacatctgcgcgtggcattccgttcctgtacgtgtggataccgatagaggcgccgctggtttgcggtgctgattggcatgggaatacagcgaggagaacgcacgaggaggagaaggtcgagccggtgcgaccgactacttcctctacatcgacgcgcgctacttcccgagaattccttcgacttcttagcgccttcttccactgcatagcgcgtcgagtggtaacgatctatgatctagtacttgcatggttcctggtttacgtgacaaaaaaaattgatttatgctatcgtagtctacgcgtatcccaacagatcaatcctgcaccatcatcttcctgctactaccgtctcctctttgctgctcacatcggaaagttgtgctgcctcttctctgctacggttggtaagcagttgcacaccataaaaaagtctttcatctgctgtgctcatccgttcatcatgtggtgttcgcataggttgggacatcgtgtccccctgctgctccgatctgtgcaaccaggatgttgagttccgacaccacgtcatcgtcgtcgcagctgtcatcagtgaaccaacgctgctccttcgtcatctccttccaaacaaacttctgtcaccattaacgccacttgcaagcaaacaagtcatcactgtccttggaacccaagccgttgctaccatgtcgtcatcttgttgagaccacatctacaagtgagctcttgatgttcatcctccattatttccttccatttttatcacccggtggtagcactatatgttgttgtttcgtccatcacgaaagcagcccctgtcactgtcaaccttcctcctttatatgtatttaacagagcccttatcttcttttcttttcattcgcacatgtccaaatgctgtcgtactgctgctttgcctcggccaccatgcccacagtgtgcatgtgcgtgcaccactgttaatctctctctttagatgacatatgaaccacaccagttggtacacaaaatagttccaatcaacctgaaaacgcgagagaatattcctttctatcttctattaattcaatcttccattcttgctgccacctctctctcttgtgatcataaaggtggccgtcagtcatcaccgatctgtttgcgcaccacgatggtcgctgtcacaatggaacccgagctgaaccacattgtcaccattacgttcctatgaatgtcgctgcggtcggtaagctccaaggccctagcagcaccactgctcttatcctccgcttccattgtcttccctgcctccggcactgtctcttgtcaagttgctattgtccgccggtgaaaccacctcaccgttaacgatccaccgttcctaccacttgtctgctgtggtcatgatggttccattcctaaatcactgcaccgacatccctgttttgtacaccggagtagtccatgccatgtggctgccactactcgtatttcccctactactccatgtctctctgccaccaagaggtcgagctccaccatgccattgccttgccgttgtgcttcaactccacagccttcaccaccgctgctgctatctttcatgagcccgacgtcatcttctagcccgctgtgcttttgattctccctacttcaatccgctgcttcattgttgtcacgttgatgagatccattttgtgtggcaccacgtcacatgcgttctggtcaggctagcctcctaaaacccaaaatcaatcaagttatctatctcaacaaatagatctcagccatcctcgtaattggtccacaactctcctccttgtaaccaattaaccgtaggtcatcctaccgacaggtggaccacgcccgccagttcgtaaaaaataatccttttggttcagaaattccagagaatattttctaaatatttctctttctttattcatggttttccaataattcaatcttccagaggtcacatctctttcatccaaactccgattcggcccgttctttttcctaaattattctaaaattgagctctacttcctgatttacttggttatttcatttgatgttatttttttctgccttttctttttgtttatttgtttgctcctttctgcgatcgtatagacgctgttgctgaggaggttgttgttgcaggtgaaggttccgtctaacgatctcgtgggtaaaggcaagtgtacccttgaacatgttgatcctaacttgaaaaattatcttgttttaaattatatgcatgatttgtttcacaaactatcgtgtggatagttatgacctacttgttaattattccatgccttgaattattgttgattatccttgattatttgtcaccctagactgtatgagaatcaaacatggggtattggctcggggtagtagatttgcttagccatgctcacatttttacaagcaaaatataatattgactaatgatctacttattgcatttatttacataaactgtgtcgttgtgcgctatcttcttggtggcatgtgttgcaccatgtagtaattaactggtggaaaatgttttagacctgggcgatggtggatctgtgtgaacctaggaggtaagccatctgtgtgtgtgcttaccgttgatatgtgtggtcgattgagctgtgtgctccctttttgctgtgtgcttgaggtccttagtttaggcaagtcgccctggtcagttaaggacttcacttcgtgcgccattgatctgagccttaccgtgcaaccacatgtccttatgggaaggacctagcttagtacattgcttagctctggcactggcggcccaggtggctagatgataggtttttggattgtaccatgggacctttcacctgtgtggtgaagggaggaccgcccatgggggaagccggtgttagggcgaggtagaggaaacgctttgttactctttggtgtttagcggcaccgaactgtatcttgtgggtaaagttgtacaacctctgcagagtgtcaatctattcgaatagccgcgtcctcggttatggacatgctcggtgatttcacttgacgggtagatttgtgaaagttttacttttgggaaagagctatgtgcaggataaattaatgaatatagctgtgtgctcctgtgtggacgcaatatcctttttgggttggttggttggttaaaaataccgtgattgcaaatgttgtttaaatgaaatttatatctatttactgtatttaaattcgcaaatgcctttatgtaaatgaaccctagctttcctttgaagccttgtatcatatattgcatattcccgtacacttgcgagtactttatgtactcacccttgttgtctcacaaaatttcagagaaggccagttgttttagaagttatgttgctgaggatgtcgaataggttgtgtgccccagttgactgcctgtggtgtgtcgttggtgcctctcgcttctttttccgctgtttatctctgtttggccctgcgtggcaaagaaattgtaaaatctggtcataagaccaatgtaaaaattatatttgtttcctatttattaatataatcatgatgtagttgtgattttatcttttgttactgtgtgtgctagcgttgatctaggactagcacattatatacaaagggatcctagtttgggtcccgacaggattcgataccctttgaaatactccgtaggggaagtgctacatcagtatatccatgcgcttgcggattttatctgtgaccgtaagaattaccaacagtggtgcacgagtaaataactagaagtgtttcctttgggattaagccgtggcagaaatcaagttgtttgcggtgacgctgttgctgaatgaaagcaagagcaatagtgacgtactctaggtaaggatggtcatgcatccatgagagaataagaatactccttgcataattaattatcagaaggtaggtgtgcaagaatctcaaactaactcgaccctatactataaaaaactgtaagtcaaacatgtaaccatctatatacatttagagcccattctaataacgatttctatgttacttgcgtcacgggacacttgtgatcctgaaactctgcattcctatttgcaaacctaagtactatgttgagcaaggattataacaacctattgccaatagtaaacataggaaaaaaaattcttatattgcgaacttgtacaatcacccaagtcttatattaccagcttctgcaagcaactttttagtcaacctgaggactctcattttacagtggatgaataaagaacagaggattatcctaggttacgaagttgaaaaatgagttccttatgacactttttcagaagaagatgtccgggtagctgtgtttgggatagaacataataaggcccctagaccggatggttttcagcgtagttctatcaaaacttttggaatatcattaaagaggatttgatgaatatattaaacgaattttatgcggaagtcctcccactgtccagcctcaattttacggtaataacgccccttccgaaagttcaagatgcatacataatacaccaatatatataccaatatttctattgaatgtcggtcttgaaattttcaccgaggttgcaactaatacagttaattctctgactggtcatgagctctacacaaactgccgtcatgcgaggatgcaacatccaaggtggtatttttattctacgcaagacagtacatgaattgcatcacaaaaaattgaattttgtgatattaaaggtggaacaaaacgcaactggcaaggcgatcaaaactgttatttctctaacaataaggaggcaattagacaacttttcttttaatgttgctcagcctaattagtttgttccatcatttatatgccatctagaattactccacctgataatgtttcacacgtgttcacactagttggctgtcaggtatttaaaaagatatgcaaccatatggggtggctaacacgtgtaggttggcttgcttacgcaggaactatatggtttcaagaccaaagatacccggcttcctcttcatcaaatcacgaaaatcgatccttagttagctgcaccaaaactagaacaggcccaagacaagcaataacagtaagtcagcaccgcttaggcaggaagcagacagtaagctaagaatactggaagaaggaggtcgctcagccaaagccctagttcaaccagaacagtagggaaagcgatagaggctgctccgtagctttggccgtcgcactctaatccgctttagaagaagcagccaagttgtttcttgtcacgcctagaaattctcgaatagaatttcaagcagaatgtgcaataaatcccctgtccaggaccggccagggtacacaaacgacaaaattgacatacagatgcagcggaaaaataaaagataactggagctaagccttgacttggattacagcgtgaacaccactccataggcatcctcgacggctcggacgaagcctactcctcggagaaaccaccatcggaagcatactcgaactctgagggttgggaggtagagcaagactgagtactacccactgtactcagcaagtcataccggaacggagggtatgatgcaagatataaccaaaggaggctaaaaggggttcatttgcataaagctagcatttataaacagtagttgaaagcagaaaagcagatgtagtaaccaccacctgaagtaattagttccattaagctaaactagggtgggactaatcacggtgaatctggttgaccgcccataaccacgggcacggctattcgaatagttttactttgatcagagatgtacaactgtacccacaagacacagccccacaacatgttcccgagcgcatgcatgccaccacgacataccggaaagaggccgtgataggacccttcgcataaccccctctaaccaagcacaccacacctcaggtttcaaccccactcctcgcaaggcagcgggcaatcccctctcgtgcctaggtgaatccgaaagccgcataggccgtcgcagggcccatccgaactccatcacgcccacccttgcctggatgcgtcagctagaggaaagctacactacaagcccagcctttgcccacgctggcttgtggtaagtacgaggaattcttccagagtatcccacgaaccggtccttaattgccatgggtgcgaccatcaaaactatgcacccacaacctaccatttaatatattttaattaaccaacaccatagcggtgggcactaatccaacatcaatactagaatctgaagtctatgcattaatgtaattcccctattgtgtactagttgaactaagcatggctaagcaatccctaatccaacatctagtcatcttacaacccaagctagcaaaggaacatgataacaaatagtatggctgagacaataggtgatcatcccatagtaacattataaaacgatgcaatatttaaaggaaaacattagagcatttgtaatatgggatcaatatgttcaaatgacaaacatgacttgccttgctctacggctggaggaacttcggcaactatctcgaagtacaccggactgtcgggagagctagaatctatgcgatatacaaggcaaacaatgcaaacaggctataagactactaaaacagagaacaaaaccatttttaatggattctttgcatttttcttgatttactgagacttgaatgggcttaaacggagcacagatgaattttctatgaattttagaagattcactgtgtttttactataaaaagaaaaaccttaattgatttattgcgcaataattaaccctggtgacatcagcacatggagggggcagcgccgacatgcgggccccatatgtcatcggctcggggacatcggtccatggtggaccgagtccatgggaccgggtgaggggagcgccatgtggcgcacacgtggcatcgacgtggtggccacgcgggcggcaacgaatgggcccgatctagccgagggtagatcggacggtggaggcggcacgcgggaagcttaagccggcccggcggccctaacgcgcggcggtgagacacgaggcggcgacgcgagacggcgagcggcggcgacgcggcggtgacgcggctaggcggcggcgcctaagggatgtagctcagaggtctatgtaattcatagaatcatgtaatacgtattagtaggactcgtaggcactactagaaaagacgtttttccaggcggtcaaaacacgttttcacgggcagacaaacattccgcctgcatctaaacgacggtaaaattcctcgatttttaccggtggaccaaagcaccgcctgcagcagtttcgatcttctcaggcgccgtgggtagccccgcctgcaaaaatactcacggcgccaaaaaaaactttcccgccaaccccaccccctccataggtttcaaatcacaaatcacaaattctcacaaatctcatccaagaaacaaagtccaatcacaaacatccatacatcaacataaagcaatggattcaaatccacagcatcaatttgcaagttatcatcaatcaacatgcgatgttaacatcaatcaaacttaagaaaaaaaccgtagtcgtcgtcggcgaactcaacttgcatgcggtggccgccgccaccccctcccccccgggccggatatgggagggagggaggtgtccgccgccgccaccgccctcccctctccttgtaggggccggatctaggagagggaggggagggaagccgcatccacgccgctgccgtcgcccctccccttcctctggtcagatctaagagatgggatggagagagggggagccgccgccgtcgtcaccctatctgagccgccgttgctccccctcctccaccagatctaggagcggggagggagagagggggagctgccgccgccgtcggcctgtccgcgccgacatcgccgtccactccaccgctgccgccgtgtccacgccgccaccgtcgctccccatccggcggggagggagggagggagggagggaggggagggaagggggacgagcccggtgggtaggggtggaggagaagaagtgttgagggagagagagagttgagagggaaatgagtggtggggaggaggtggaggagaagataaggagttaagatatttttttctgggtaggtacgatttttgcaggcggacttttgcaggcggaccacaaaaggttcgcctgcaaaaatcatatttttccaggcgccgcttaagttgtccacctgcgaaaacaggcggagagcgaacttcaccccgatttatatttttgtagacggtcattttgctctaagagtcatgtccgtctgcgaaaaaaagacccccacgttgagaaaaatgctttttctagcagtgagggttgtcatcattgggaatgttggaacctacatatcaaaacctatgatcccctgctggctaaagaaaaacctatgatccccataatgcagctgcatgctgtttcagctctcaattgtgtttcatatgcttttgtgaataagtgcagcacatgcatataaaacagccgtacatcacgagtatgcactacgcagtgcgcaaataaccgcaggaccagaggtactacggcacatgcatgatgtctcaccattattaaaggtttcatggactttttatcaaactaggaaggtggcccgcgcgggcactttcaatacttatattattgaaaggtaagattattgtttgttcaaaaaatttgtctcatagatttagggcaaaataatgttattttataataatttaaggattctatttttcttaaggtattttagaaaaccattcacaaacttttgagtaggagatgaatttagtacttacaacttttgaatcatgttttttttctcgagtaaataagaaactattggtagttaattatcatacagtccatctatatacataccgtgtagtatggctgcaaataaaaaaatgcgagtgcaagatacttaaaattcttttgattaaatcatctcatgaaggcgcatgatataataataaagggagggaagcatatgcatgggaaaaaaagaagaaagagaaaaatgaaaaaagggaggggaggcgtacgaacccgcgcacgtaggtgcgcaactatgctgaggtgggaccctgtaatatttagtttgttctaagatcaatttaatataacggtttataatattggacctaccgatttacgtggcagcttgagagcattttaaggaattttaaatgactaattagaatattaactgcgcaatatatatgtattggacatatggtaatatttgttccagcttcatccatgtttatatacatgtagagagaaattaattttgtggctagcaagccattagatgtctaattaatagcaattaattttaacacctatttacaattgttcagagtaactcttacatattcatcttatgacttcgatgatccattgatcaccaatttactaatcaccatgacttgcatgaaaaaaaatatgtagtaaggtttaggatagctgaaattgatgaattatataatttatgtgatagctaactgagggtataaacaaatgaattgacttctaaaaagttaaaatgttatttaaataagacaccatttagaaacttagaaagcgtgcaaacaaaaatccaaaatatggaatcaggaaaataattaatcgctgcatcacacctttaattttcttttcatgttattaacaaaattaatcatctccatatataatttgatatgtggcaaaacggtagcgctacatcggttgtgatcaccttagatgtctcagacactacgctttgttacacgtgcgaaaggcaaaaggtgtatacgtgtattgtgcagcgggcaaagagaatttcggacgctttatttattagcaaacaatagatccgatgattataataatatgtccaccagttctagtgtaagtgtaattagttaatatagattttaaattgttattttaatgggtacacaacataatggtgtagaccttactttaaaacagtgcattacttgagaataatagaccaatgtaataaaaagtagatccgatgatttatataatgaggccatcagttttagtgcacgtataaattagttaatatagatatcgtttatttgataggtacatgatataattgtgtaaaatttattttaaaatagtgcattatttgaaaataatagtataaagtaaaaagtacaccggtttaagttatatgatggtagattctttgtttgtaaaattatgattaattatttaaaaatatatccattataaatggaaaaaaagaagaaaaaaagaaaaaaaaaggaaaaaaaggggggaggcgtacgtatgtacgtacgtatatactacatctgctaatgtgcgggaataggataggtgggacccatggtatttagtttgttttaagatcaattttatctaatggtgtataatattggacccaccaatttaagtgaaaatcaagggatagatgttttgcttttttcttagaatttctaggattttctctattttattagagcgccacgtggcggtttgagagcgtttataggaagtttcatggacttttagtatataatataatataatataatataatataatagttttaagatcaattttatctaatggtgtataatattggacccaccaatttaagtgaaaatcaagggatagatgttttgcttttttcttagaatttctaggattttctctattttattagagcgccacgtggcggtttgagagcgtttataggaagtttcatggacttttagtatataataatagaagatagatagatagatagaagatagatagatgtctgattctgttttatctatcaacattttttttcaagctggaccagtactatgttacaattcatacttactcttactgatatcaacaagaaattcctgattaaaaatacatctggaattctggattacatcaggaaataaaaaacgaagtaaatgaaaattgcaaactgaagcagatccgtacttcttttgtcccaaaaaaatatcaaacctattattagaggggacacaatctagtctaacaaatctagacagaagcttgtccagatttattgtaccaaatgatgtattctccaattctagattggttttttatgggacggatggattagttttatagtaattcgctaacttctgtttcatatgcatttctgatctcaaacaggtgacccgtgagtgagcacagcacaaactcgtggtatcgcgccgcgccgccggacggccagggccgaccgagcggcaagggcgtatcgctgtgttccttgacgccgtcggcaccgtgggttctgttgcggcctgggggcctcggttgcctcgcgcgcgagcgctcggccggcaggggtgacgcgttcgcggtttgttttggtcagggtcaagcttgcaagttagaagactgtcgctgtgtgggtacgaccccgcgtcgctctcgcgcgggcaggtcggggggcaaaaaccctagccgcccaggcctcctccccctctcccctgcctcgctgccgccggagctcgccggcggcaaagccggcaacgagcagggaaggcagcggcgaggtccttcttcctcttggcagctccctcccggcgcgacgtggacggggcgacgccgatgaggtaccccaccgccgggagaagtggaggcggcggggcggtgtggggtggcggcggatccggcaccccccatggccggatctggcgcagcagcgcggcccggcggtggtgcgcggctgggggcggcgacggtggcccggcggcgtgatgcggctgggggcggcggcggcggcccgatggctgggagcggcacctggcaaggcggcggcggctccggcggcgccccgcccggatccggcgtccccgaggtcggatccgactcccggatggctagggtcgttatggccggcgtcaccgacgatgggaagacggcgcgtgcggaaggacggcgcatgcgcgacgggaggatgccggcgtcgaggtcgatgcgtgcggcgccgtgcagcgggccgacgcggcagtggctggcgccagcgatgcttgccgccggacctcgtggatgaccaccggtgggggctgctgccagatggatggctgcgttgtgggggacccgactgggacgccggcttgcatggcggcggcggggtcgttgcgcgtcgctcgtgtggcggcgctgcaggtgttggccggtggagatgccgccggtctggggtcgagctcggattcagccgcacagcactgccatcacgaccggcgatgacgaggggacgccatgtgggtgccttctcatctccttggagctcctccccttcttgaccgcctggtcgtggggagctcctttgcgagacggtgaaggcggcggcaaggttgccccaggttgttatcgatagtgatgggcggtggcgggcactctctttggaggtgacggcatgggaggaaggctagctggtcgccgaagtgcagtggtggtttggtcgtgctcattccaacgtgtagctgtgggggtcgcgctggtagcaggttaggtcgcttggagtccagccgacggaggggcgtcgttgttgtagaggccacgtgctgacattgcttgggagtcggtgaggtagcggcaagaggggcattggcaggtgctaggcgaaagccggcccaattcttgggcggcaacggcgacgtctttgggcgttgcaaccctcttgagggcgttgttgaggtgcctccctccccctcttcaaggatcctctaggtgaaaacctcatcctttcgggatgggcgatggcggcgtttttaatgtcgtgaccttcttgaaggcatcgttttggaggtggccgtgtgttcctctcggtgtggtggtgtgtaggcacgtggcggggtgtgttttctcttgtccggttcccctgtcccctgctgcttttgcttttggttgtaaatgtctgttttactcctcttaatgcaaaaatacgcttctagcgtattcccgaaaagcacagcacaaacaacagtgctggcagacatgccttctgcctctattattaatttgtcagagaattattggccaaggttgttcgagctcattcaagcgacgatcttatacctggccgagattctcgttctctcagtagtaatatacattttaggaagattttcaggatcaaatgaaacccatggatctgctgttcatagaaggtttgagtacttgcccgctcttcaaaatggaggagctagcactgccaatgcattgatatatactccctctgtttcacaatgtaagacttttagcattgcccacgtttatataaatgctaatgaatttagacatatagtagtagataagaatgttgtagagtttgctcttcttgaacaaattgatatcagtttgtctgtaccaataatgtaccactaagtttatccttcaaccgtatcaatccgtaagaaaggattaagtatgcgtcctgctgatataatgtcttccacttctctctctctcaccctacattgctgacaatttattttggtacaatggcagtcatcagcaatgccaaattattaggccatctatggcttgaagctgggcatccttcgaactttggtagcttgctcaaaagcataagccatttcaatcagcctcggttcatagcccttcaacccaccgaagcagataccaaatggtactccatgaccatcgtacccagccggcacggtgatcgcgggcatgccgccgatggcaaaaaagctagatgcatgagagttgggggtgacaatcgcatctagctggtgcatcctcatcagattctccaatccatcagctgacagctcgttgagacgctggattgccgctttttccactggaccaatgccattggttttttgagctgcaatcaggtcgggctggccaaaatcttgaagtctctcctgcagcaaagattattttttcatggcttcttgtttttcatatgaaaggtattcaatactttttagaaaatacaagtgctggtttaatttttgcactcgaccgtgcactgtgcataaagtaaattcgctattcttgttaatcggtaacctggtattctcttctttgccaataacctaaacctacactattattgtataactttcgaacgttgaaggataaattatttgacattccttgcaactagctagttttataattttgaaggcattagaactcgtgatgaatgattaattaattcaactagctttaatacttacctccacaggatgtgcattattgaatgctaccacatcggcgagggaatgaactggggaatacagcaagtctgacaaataagcgtttaggcttaacttgaactctgcttgcaatgcgatattctcgttggaataaagaacatcctgcgcggcagacaaatttgttgtgatgttgatattctctatcaccagggctccgtgtttcctttattggagaataggagttattaaatgatgacataatttactatatactagatggagtctttcattgcgagttctaatatattattattccacaacatatacgtgaaatattttgttgatctatacttaaaagaatagattttagctatcattttaatggttcaatgcttgattagtttcttttacaaatattttgaacacaataaatcagtctacagtttttgtaactaaaattatttgttcaccactgaatttctatggggagatgaatggattatcttaagacaaggagtttcttttcaatcatggatggataaaataaaccggactggctacttataagataaattttattcatatgaaacaaattaagaattttactgaggaaatgagaaaaaaaaagaaaaggaaactggcctttgtgcatccaaaaggtggttgaggcatgggccaacgtgctcatgcctagtagtcagtgatctattttcattctatatgtaaaacagtatatatggactattccaattatacattcgaacacaacagaaaaataacagtatttacaaaaaaaaattttgttctaatcattattatcttcatacttttttatacgcataatttttcaggagggctttataatttcaaatacctcatagtggaaagatgtttttggtacaccctcagttgtgtcttcccataggctccttcagtgaaaaagccattggggatgccaatcctcttgcctttcaatccatccatccttaagaatcgtccatatccaccactagggatgtatttggatgctgctccagtcgcttcagcatcaagctcatcgaacccaacaatgacatccaacacatgggcagcgtccgacaccgtacgacatattggcctgcattttgtttaaattaacaaaaataaatatgttcaaaacagtatcataaacattcagagataattaatcaaaagaaatggaacatttttttacgaaaacagtggaaatcacatgctcatcataaaattgttacttacccaacagtgtcttgtctgggggagatggggatgacaccagcccggctggtgagcccaaccgtcggcttaattccgaccaccgaattcagcgacgccgggcaaagtatcgacccgtcggtctccgttcccagcgtcaccgccgccatgttcgccgccgccgccaccgccggaccgctgctcgacccgcacgggtcagccgagagcacgtagggattctccatgggcaatttcacaaacaccttgtgagcatacacgaccaaacagagaagagaagcagagcatgtgtggtggcagtggtggttaccaccgtctggccgtcgcgggcgctccatccggatttgacagggcggaagttggaccactcgg

SEQ ID NO: 69219 - DNA, 937 bp, Oryza sativa
accccccaaccccccgccccctcctctcctccacctcctgacttgggtattacgtttccttgtatattacggaacggtctaaagtcctggtttgataatattgtaaaatagatttaggaaaccgataccgtattggttaagatttctatcttgtaatcctgccctccatcctatataaggtgggcaggaggccctctagggggcatgacacacaacctgatcatcagatcaataacacacccggcggattcaaatccccaaacaagagtagggtattacctcattgagagggcctgaacctgtctaaatccttgtctccgcacccatccacttttaggtctcatgcgctacccccttttattattgccgaattcttgtttcgacacccgtcggcagagcgcggcggcgagggcagcgccggcgctgggacgacgaggcggcacacggcgacgaccccccagcccccgccccctcctctcctcccaccggcggcatgcagcggcgacgaccccgccgcctcctctcctaccagcactcagatctggcgccccccgtaccgagcagcggcaacaacgtcgaccccgtcccgacggaggcgccgggtggagggacggcccgagcagcgacgacaacatcgggtggccctagtagcgacggtgccggttgcagatcgagctcgccggcgacctgccccgcggcgccgccgctcctctccccgttggctgcctcgcccctcgcccctctttcctgtagcaatgagtgtggggcccgcctgagagcaggaactcatagccaaagttggctactcggacttgagaaagccacgcggttggatgatgtggcaaggaatattcgcttttaggggttgagactgaatgccatgtagacccattgtgaatggcctaatagctctgctacactaaaaattatcagaaac

SEQ ID NO: 69220 - DNA, 594 bp, Oryza sativa
ccatcgggctggcgtccacggaaacagcagtgatcgcgcccacgagccccatgtgagcctgtgcgacgcgcgcgcatgtacgcccggttctttcatagcctttcggctctgtctcacggttatttcaacaagctttcggccttcactcacatcctgcagctgctactgatttactgaagtgatcggtgacgatggaatgctcatgcatgctacattgctaacgacgcttcgatcgagttaattctttatgtttgcacgtacgtatacgcttggacgaagtttgttatgttcaccgcctcaccggttcacgtggttgatcggttcgtgattacgtacagaccgaaaggagggagaggagtcacgttaatttttttagggtaaagagagagctttattaatgcttaaataaagggttacacttctaatttaataaatctagaattcttgcgaaagcacacaacctccactccgcgcaggacctagaacacattgccatttatgctaaaacatgtgctaccctatttgcttatctctttatcgatttaataaatctagaattcttgcgggagcacacaacctccactccgcgcagga

SEQ ID NO: 69221 - DNA, 628 bp, Oryza sativa
tactttgtcaagaactagtggaaataggttatttctaaatgaatatgcatgcaagcatttctagttctccattatttccaacagtattgatggtcgaaattcgtctataatgaccgtcaacaggtaataggaccataaggttgtagtcgtggagacgtggatgtatcgatggtgttgatgtcctcatcatgagagctcatggagctggagtcgccaccgggccgtcacacgagatccgccaccggggatgccgctcgagatccaccaccggtcggcagcgtagagatccaccactggggccgcctctcgaagcgaggaggaggatgactgtcacatcctgattttcgttttaggatttataaattatttaataaattattattagaatttatattaaatgttcattaatttacaagagaagttaaatgtgggaaataaaatttcctaaatataaagcatggacggatttattttttattaaattctccatggttaattatactctctggaattttctcggatttttcggagctcaattcctaattttagccatgcaaagaacatttaaaaaaaaatccacatattaaattaatcattaaggggatcctctagagtcgacctgcaggca

SEQ ID NO: 69222 - DNA, 715 bp, Oryza sativa
aggatcaatggattggatcatcaattctaatcagtgagaaggatcaattctaagctattgggctaaatacctatatagggtatatacctggatcggagcctccattttggctgggccctaggccatcgcccttatggccctgctccagagccggccgtccggcggggtgccagggacggtgcaattcagcctgccgccgcagtcgccggacttggagctggcctgggcaaagaccgtgttgccactgccgctgagggagcatccggtgctcgccagatggtgacgccgggggaacacgttgacggcccacacgagccctggggtgaggtgagccattagccgccgacgattgggagggcgcccgcgcgcaccgtgaaggtgcagttgttgacgatggtaacggtagcgccgcaggccaatggctggaggatgagcggcatcgagaaggtaaccggtgaagttggagactccatgctgtgaactaccagtgcgagctcaagcgtagtgctagcgtttgttgttatggatttggccgtgattgtgcaagcgtttaaacggtgtatgtgctgaccaagagctggaacatggatatggatcatatgccgtggacctgaggttgttaccgttttttttttttgacaatttggtccttttaaaaaacttattttgaaaactaaccctcgccaaaaacttcaaccaaaaatagggctgcagg

SEQ ID NO: 69223 - DNA, 660 bp, Oryza sativa
atgcagcagataatttatgaatgtactaggctaaccgaatacgtgcacgtatgccaaaattgacagcctgaatattcgggtgtgtgtgtctccagcagtagttcttctcgatcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtcca

SEQ ID NO: 69224 - DNA, 660 bp, Oryza sativa
gccctgattatataatcttcctcgttaatcacagtttctaaatcttagttaccgaatgctaattccacttacaatcatttttatttctttacaaaatgctaattgcgacacgcactcccgaatccccgccgctagtctcgcccacagaagattcgaacacatacagaattacacggaccacaatcgtttggttaccactaatcacatattctaattgatcctgttcctgatcatgtaccgaacacctgccatgccatgccacgtacgtggagtggccaccaaaccccgcgccgctcgttgccgccggcgcgagtggctgtgccggtacacggaagacgcggcttccgtgcgcgccccgatgcgggggtggcggaaaggaggacaagcgttggcagctagctgcgcgcctccacgttgttccggaacgttccatcgcatcgttaactgaaacgagaggcagtattaatcccctagttaaactctggctaagtatagcagagacgccggccgagaggagtggggggagagggaggaggaggaggagagtggctactagtactagctatctttggagtgggcgtttcttggccggcggcgatggagcaggtgcggcggaagagtagcctgaggtcgcatggctcaggcaagtcctcgccgcgg

SEQ ID NO: 69225 - DNA, 724 bp, Oryza sativa
tatatatccaatttttctatgcgtgcttacaaagtaattaatgtatgatgaagcaacatatagttgtgaaattgttttacaattttgtacggtaatttggattatatgcaaagtgtaatagtgtggtccctagataaattactcctttagccagtgagtttataaattcttatcctaataccgtcgatctaatttcgctatgaaattttgtggaatcactgatttaagattacataatacatgttcatttattttaatgttgagtaaattgcattggtggtacacaaacttgttaggtgggtgcaatttagtatataaacttataaaatgctcgtttcagtacacgaacttgtctggttcgtgcgaatgaggaccaaaataacttggcaatgtcaattttatgaagttgacgttgattaggatgcgacgtgtatacctgtagcaagtatgcataggacatgcaatatttataaatttagtctctactttatccttcatcattgaaatgatgaattttatatgtttctaacccttatatcagtgctcgatattttaaatctttttctactatcacttagtgcctgaagtattgcgttaggattaaaattaagttttccctggttggtgtccttggatgaactggaggaagatctgaccacacacgttcccttggattcgatacccttagaatactccgtatggagaagtgctacatcggtatatc

SEQ ID NO: 69226 - DNA, 1294 bp, Oryza sativa
taagatatttcatatttcaaagggccggggcgtaagaatacatggctgaggaatgtacgtctagggatctataataaattatcggtaaaatcgagggtttttttgaaaaataaccagatcccacagctcggcgctcgctcgcgaaatctggctacctgggcttcggggcgcgacgtggatagcgcggcgatcgaacacgtgactccaaatcgctgtgggagcttcagttgggggcaggttttaatttatctgatgtagaaggagagcaggaaggagaagaaaggctacagagtgttttagagtttagtataccactcgatgtttagtataccatagcctatcaaattcgtgcctactcgatgttttattgggaattttactactgttctggtttgtcaaattccaatgtggcatcttgtaataatgaggctagtctcaggacctaagggtttagggtatccattaggtaaaacccacgttttatcatttgttccaagaaaactatgtgttgagggtaaagtgtcatatgctccctccgtcccattttaaatgcaaccataagtttccgcacctaactttgatcatccgtcttatttgaaaaaattttataattagtatttttgttgttatgagataataaaacataaatagtactttattcgtgacttatgtttttaatttttttaaataagacggacagtcaaagttggtcgcggaaaaccatagctgcactgaaaatgggagggagggagtataagtttgtattatcgattttgttagtatatctttgtataataatcatgaaaaatatgagatattatatatatacacacatatattagccacaatttaactagtgtcggttatcgtagtacgacgatgtgtatgtatctacaaccagttagcatgttattattattgactattgtgttgtattttcatacccatatagtgcgagagctaggaagataaagtacaggatatgtgcaactttgaccactatttttctattataatacaacaataatatctaataaactattatagtttaaaattacttaactaaaatctacccatatgatttttatgtttttaaattaaatatttttgagagatatttataattagagttttaaaagttaatttattataaattaaatcaatgtacccatatgatttttatgtttttaaactaaatattttgagagatgtttattattaaagttttaaaagtctaatcatagttaaatctatgtacgcatgtgatttttgtattttcaaactaaatattttg

SEQ ID NO: 69227 - DNA, 10131 bp, Oryza sativa
ttctatatgtgaattcgcatgttagatcttacttgttgatgaccaagtatgggattctggagatcgataagtcttcaacgagcaggaaaattcacggagtttactttcttgaaggagagtaacgttgacgtttacccacaactacagaaaagatgatcgatgctggttgggaaatgggaactgaccatacgtatcgaatttctcaactggcacctagtagatagcgggttttagaaggactcaatgataccagtttaggaaccagcacatttaaagttcaaggaatgaaaaaaaaaaggcatcatccgtaagatcatcatcatccaatcacagattaatcattaaaaacaaaatcaatatgagtacagagagcttccatcgctattgttgccgtcatcgagatagccacccccgtggttgcggcggcggattcggtcacccccgagcatgcaacggcgcatttagccaccagcaagcacacggcgccagatccactcactgtcggtcttgccaatggcaattgaggcggcgtcgatcgatcagatggagaagaggaggaaggaggggcggtggagaaagaatatatgaggaagacgcggggcggatgtggcgagttcacaagtagataaggacactggctcggtcgatcaacttaaccgattttttttaattatatgtgttagcttttaaagaaccaacccctataataatataggtatcctttttttaaaaaaaaacaaaatactaacctagaacagacacttatatgttctttaaagtaccgggtttttaatccctttcaccctgtggagtgggaaacggttaatagcactccattcgattatattacaaataattaaggttttataatgcatgcaatcgatgcatttatacttaaccattaactttgaattttacctcgcattaactttcaaagatagttatagttttcttaaaaatagtttaatgatatataatcaatgaccaatcatcaaactaatgtcttcgtgaccgcatcactacccaaaacatcttctcttttaaaataatgaatatcaaacttgatctttatttcactcgaagctacaacacacaaaatccaggtaaaaaaacaaaaataactagagtcgttgggaagcatgctaatgttaatgttaatttagaaggtcgttgataaaagagtgaggtgcacatgcggtccttaaacttgtacggatgtgtcatctatatctctgaactctcaagatgtatttctgggttcccgaacttgtcatgagtatcatataggtccaaacgaacttcaacccgctccgtaaaataacgtagcatgccacggtgacgcttacgtgtgaatgggatttacatgtcagtcacatagaaaaatataaaatttaaaaagagaagagagaggagaaaatgatgtttttaattttgaaaaaataaatgaaaaggagtggagaaaaaatatgttcttaatttttttctatatgtgaatgacatatgggttctaatgacacgtagtcgccactgtgacatgccacatcagcacaagaagcgggttagagcccgtttggatctatatgtgatccgagaaaagttgagggacctagaaatgcattttgagagttcagaaacctaggtgacatatccacacaagtttaaggaccgtccgtgcactttactcttgataaaatgagcgtctaacatggaatcctccggatattgaacctaagcacttttgcttcaatcgaagctacatccacttattacatattttttgacacaaataagtctaaatacaaaaaaaacaaaagaaaggttaggtcgttaagtcgtcggcaaacatgctttttcgtcgataaaatatagccacacattaccacaagtacacgacgacacaatcaacatatccacctcacctatgattagcttaattagctccaacgacaactaacgaaggcatatccatatgcatcgctcttcttctatctagactacaggtcaacaaaccccttgccctatttctactttttttgtcgatcacgccattgatcacctccaagcttagcttcgagctccagattgttagatgcgtgcatggcgatggaggcggaggaggaacgtgacacgcttctgcgccgggtgctgatcagggcggcgcgagcggcgagagccgcggttcgcatcgctgctactactaccgcatcgtctccttcttccccggcactggcggcggcgctgtcacggacgccgagcctgctcgactgcatggacggcgacgacgacagcatcttctacacgccggcctcctcaccggtggtcgtccactacccgaggcgcgtgcaggtgcagcagcagcagcagccgtcgttgagcccgtcgccggtggccgcggcggcggcggcggcggacgacatcgataggcgcgcggcggagttcatcgagaggttccggcggaacgagtcgctggagctgcggtactgcgcggtgtactcgccgctgacgcccgccaagccgcccatttcgccggacacgtacttcaagctctccggggctcatcaccatggcgcggtggcggccggtggctcgccggcgccggcgccgagctcgctgaggcccagaaggcccagtggcatgtccatcaagtggcccacggccggaaggcccactgtccgagtctagcgcacgtacggcatatctttgggacgctcctatgatagtttcgtgattaaattggtattaaacttgtagttttgtgataatttttgtttttaaatctgtagttttataatacttcttcctaaatcggtagttttacgataaatttgttgctaaatctgtagttttatgatacattagtttaaatatgtagttttgcgatagtttggtcgatgtatttgtagttttatgaaatttactctaaaaattagtttgcacttcaaataaattgtatattaataaaaaattagaatgccaccaatttttttaaccgattcattcatagcatttgctgattgatcctaagtactgataagtggtaaatcatactcccttggttcatacctccgttctaaaaaaactatgttttttatccaaaaatttgtctcagcaaactataattttatactgagatctaatatacctctttaatactatattattgttttcttttcattttatacctctttaatactattttattgttttcttttcattttatacctctttatactattttattgttttcttttcattttagctactgaaccagtactatactccctcctcttcctcctacctaatctaaatttgactagctaaaactataggctttaaaatattggcggttgttaaaccccattttgaccaccaaccttaaattgggtaaaaagacgttcaaatgtaatagtttggtttagtttaatctattcgtatagttttgtcgtgtgttagctattttaccgaagtcatccaaataaagctgaaaatgcatgcatttggaaaaaatggtgccgaacaggctaagaggcccgacaaactggatcgaccatgctgatcaggcgatccatgctgatcagccaccctaacacgacaagtgtagaaaaagtacatgtgaggtccctcgtcttgtcatcggattatgaaatcatcctcaaaccataaaaccagatatatgtcatcccttaacttataaaaccagatcattttgggtcctcaagcggttttgatcccggttttatccggcgtggcaactgagtcaagcgtgggacccacgtgggccccacatgtcagtgtccacgtcatcctttactctctttcccaccttctctcccttcttcctctcttctctcccttactcctctctctcactcttccggtcttccctgggcaagctggccagctgggcgtggcaaggtgggacgggaggagggcggtagcggccggtgacggccgacgtggtggcggtggcagccgacgacgagcggcgtgggagaaggagaggcagcggctcggtggtggccggtgacgggcagcgtgggagaaggagaggcggtggctcttcctaccaccacaacggcgctatccactactccctcatcgccgcgggctccagctccgattccctcccctccctcctccgctgcatccttccatcctccccatccgccgaatccctcctcaccgcatcctctccgacggtttgcttcccgaagtggataaggaagagccacacgaggctagcggcgcaaggcgggagaggagacgacgcgacaactggcgagaccgacactggcgccgcccgagctcctctagtgccgcccaacgacagcaacgctttcccggtcgccgccttcccagacgccgccgccgtcgcgttcctaggcgtctccggcgaccacgcactcaccgtgtcggcgaacgccgattccggcgggatgcaaagcttgggaccccatcggcggttggcgagacggaggtggtggtcgatgaaggtgtcgaaggagagcgcggcggcccaggcggaggagaggctgtgacactggagcactgacctgggtgggatgcgcgtgcctcgctcgcctccgacgaggccgatgccgtggcagactgtttagaggagtctgtggcgcgccggccccgcgcggagaaagaacatctcctcccctgtgtgtgtttgttggttccccccgcccccttttgtcccccaagtgtcctcctcttttcccgcgtggttcggggggactcctccccatccgtcggccggcttgcctgagaacaggagaagagaagagtgagagagaggagaaagggatagacagatgatgtggcagcctgacatggggggcccacgtaggtcccacgctgacttaggcgccacgtaggatacaaccaggatcaaaaccaccgaaggacctattgtgactggttttgattagttaagggacgccggatatcttgttctgcggttggcagacgattttgtaactcgatgacaagttgagggaccttcggtgtactttttccaccagtgtatacttttccctaccccctctatctctctcctcttttcctatttctcccgacgaggaatcaacggtagtggtggtcagcgagcgtgaacttgccaacccatccgcgggaaggcggcagctatgttacctcgatacggcgatacggatacggatacgcgatacgtcgatacagggatacggtatttttcaaaaaacaaggatatggggatacgcttatatatttttatatatattagaaatacaaaatattaaggatttttttaagaaaatagcaatataatactagtattagtgcagttgcagtccattccatgaccatcctctccaactctgctatagttgacgaagcgatttaaggctccccccccaaaaaaaaattgtgtgtaataaagcgcaagactacaaatagcatacaaagcgcaaattaatagttcaatcaacacagttgctcttgatggatgtgcatcaacattagcagccgcactacccttagaattgctagatgcactagcacagactgcacagtagcatttggaagttggatctaacaaaaacgatagtccttgactacttatcctaaaataaaataatagaggcattgcagatcaagcatggaacactagaggagtggatttatctcaagtagtgagggaaacaaataaaaagctgcatgggtgcttcgatgcagctggtgctgtcttgccttgggcggtgacggccctggtcggctgccacccggcctctaaactcgtggcggaggtgctgtgcggctgtgcatgtgttgcagagcaggtgctgtgctgccgggtgcggcgacgacgcagttgctacccaacgtgtggtggcgacatcgaatcactgcatcgggatgggagacgacgagacggcggctctgcatcgaatcactaatacgtacgggatacgtatcggatacgtccggatacgtatcccgtatccgtcacgtatctgatacggatacgcggcctagaagccgtatccaggtaacgtagggcggtagtagtggtcgagggccggcaaggaggggccgcggtagtccatggtggcataggagaggagaggagaggatggaggggagggagctggcgggtaagccatcccatccatggtaaggttacaacggaggtgggccaccatgaccaacgtgtcgccgtattcctcccgtgatgcgcctccctttcttggccaccatcgtcatgggccacgtcgcgtcggtagcaggctaatcgcctggtaatgaactcgacctgcaagatgaattagcagccagccaagaacatgtggtcaataactcaatatcaatgctaaaatgttgatcctattcttggcaattctttgaattaatcctcaaaagaagacaacaactcagaactgtatgcatgcattccgacagatcgatcaaaatatacaaagctatgcttatgagaagagaaatgttgggtttactcccacatcggtaattgatgatgggggagcacgacttaaaaggtggaagcggtcctaacccatcaaactagcctttgggggtgtgttgaacccaaaccttaaatttggggttttcgttgggcctggggggaagcaggtccaatgtgacctgggtggcccacgattggtgggccgggctgcgcactgtaacaagtaggctttggtggtttgacggattctgcggacggcgatggcgctagagaggacaggcaaggatccgttatggactaaaccaccaccaaaaccgttttgtgacacaaaatgaaccgatattagtaattgagagatgttgtatattccttttttgcgattgagggacaataatcgaactagacccatacttgagaggtgcaagtgatttagatttggttgcaacttttgtggcccaaaacgggttcgatatatccatggatttgcactggatggtagaacgggtttgcttagcccaaaatggtttccactcccattgttcatcaatccccaaacccttatgtcttcgtcgacagtcaatttcacgagtgtggcgcctcacatctcgctcgacgcgccgccgccatcaagtggctcgccacctccctcctccccacatcggtactgccttgctcaccatcttcctctccgtgcaagctgctgtcgccggcggccacaatgtcgccatggagtagtccatcttcgaggtgatcgagtctggccttggcgttctcgtcttctcgatgatgatgtgtgctgatcgccaccgacggccaacggacaaggacgaggactaagcgatctatgccggtggcacctagccacctggggcctgagcaaccaccggtggagaaaacatctttagccggttgaccagatttcacaatagtcccgattatattaaaaaccaggacaaaaacatatttaatcccggtttaaaagcttagaggtacttttttaaaaaccgggactaaagatctatttttagtcccggttggtaacaccaacagggaaaaaagatcgacatacacagagtggctgcgcgtggatcggatacatatctcctctccttttaactcctcctcacacagtcacacccttatctcttcctccccacctgatctacagcagaggggcgtggagggctggccggccggcacgcggcggctggcggcctcgcggcgcacggagggctagccggcgcggcggcggctggcggcctcgctgcggcgcggtgcgtggagagccgggcggccgccgcggaagcgggcgtagcagccggtgcggcagcgggcgtagcgccggcagccgttcatttttttctgagaatccgtgattcggatctgagatttgtgtgtgatgtgaatatatgatgtatttgatttgtgtgtgatgtgaatatgtgatgtatttgtgatgaattttgtagaagttgtgatgtaatttttttaagatgttgtgatgtatttggagatatcaattggagtatttgaaggcgattcggggaggattgatttgggattttgagatgggatagagtgaatcaatatattaaaaacaatgaagaaaagagtaaagtagcaactggatcaagcctctttagtaccaaccgggatttaaaaaggctctatttttagtcccggttgatgttaccaactggatttttactcccggtattaaagatagcgatctttagtcgtagtcccggttggaaaaccagaactataaggggattacgaaccgggagtaaaaaccccttctccaccagtgaacggggggttacgaactggaagtaaaaaccccttctctaccagtgaacggagatcgtgccggccggtggatgctggatctttcgcagtgcccgcatcgcaccaatgcaccatcgtcctcgtagaagtcgacctccgctcaactacgaacaatgtaggtttaaaatccgagaaaaatgaacgaaataaccaggaatgattttagagcggacttatactcctacttttatcggtttacaagccaatgcctgaaagcaggaagcgatgaataaagaaaaacatctggactaattcgaaattttgtttgaaaacttaaatttgggttgtagtttataagatgacaagctgcgcctaccgggttttcggtgcattgctgcagtgtggcgtacatgtatttctagcattctctgaaatgtgcaacagcggggtttcattcaacaggagtgaacggtacatttattcgtctcttcaatcccaactaattattaatggtaccattattttttctttgcagaaaaatatgaagtggttctttaatccatcctcactgccaagctgttgctggtaagtttgcagtcgattgatcttcaattgcagtttgttctgtcgtccaagcattgtttggtgggagcacgcagtttcctatttctgtaaattattgaacaagcactaataagataaccatttacttcttttactacttgaaacagaagtgtgcaatttttcctaaggaattaatatgtacattagtagcagtagggcatatatatcatgcacagtaaaatgagagaaaactcacttggttgctggttgacaatagaagcagcacccgcaaagtcacacgatccgctagcccgaccggtggtctggtaaaaattgttgaatgcataggtcgcgtgtgccaccttagtgtcaggatcaaagcactgtgcacctggttgaatggcgctgcagtccgcacagctaccacatgcatagtctagtgcattttgcagccgtgcgtccccgaccctccgatttcgcaacacaccaacttgggttcggatcacatatgcctatatttcgggaaacaattcacaaaacaaataaacaatgagatggaatcaagatatgaatgcacatttgcgaaaacctcattgatcttaaagattgagagcaaaacattacttggtgatggcttgaatacgatggaagcggcgccagagaagtcgcaagtgccgctagcctggcccttgcgttggtagtagtcattgaatgcgtacgatgcatgtgcgaccaaggtgtttggctcaaaacacacactgccctgttggatagcgctgcagtccgcgccgttaccgcacgcaaagtccaacgctgactgcaatgctgcactcccaacatctgctctcgccacacaccaactcgtctttgtaggacaagctccgccaccgccaccgccccgaaagtcaacctcatacaccttctgaccatttgggtagaacaagccaaagtttctctctatggttggtccaggcttctcgttttcattgaaaagagagaaaatgtaggcggagacgtcacgcataccggaggctccggatacaacacgtctgataagcccattgttgtacgcttgggcgttggctatcgtggccaccgagtccgtatcggctgcagctagcatggaagataggggaaatctacctccagaggggtgccctgattccgaagcttgcacactaaggattccatctcgtcgagccattgagaccgttaagctaccaccagaaaccctgtttatcgcggcgtaaacagcgtcgagctgagcatcaaagaggctgaagtacctgatgtcggtattgccatcgagcaca

SEQ ID NO: 69228 - DNA, 9463 bp, Oryza sativa
caccttgatgccggtgttcgccatcgcggccagcaccgtcgggtccgcgtcgaagatcctcaccgcggagatgccgttcgccttcagaaggctcaccgccgccggtggtcgatcaggtcctttgcgtccctcccgtagcacaccccgatctcgcccgcatctgcattgacgagcaaaaggaattttagcatcgtttggcgttgccgatcgatcagctactactagtccaaaatcgaaagcgtttctacgtttgccatggttacctgtacgggagatggagagcagcagcaatgcggtggcaaggaggagggagcagaggaggtgagtgagtaccatatgtgctctgatagtttgatcaagacgaatttgatggttgggacaggactgaggtgcaggaatttatagcaagctagaaattaaagcaacaaaagtcatgccacgacagagtagagaatgaagaacttgatacctaactgagttatgaaggaaagcacatatatgccattagcggggtagggggcataattatgtactgcttcagcttatcattgcgcttgtttatcatcattaggtgaaagccacatatacaagcataacgcatcataagcacgtccgtgcgggagtgtgtcactaacacatgctcgaagaaacccaaggtagcaacaaatgaaatccatccatttagcatagatcatttttttggaagaatctatatttcaccattgacagatcatcagttctacaacctacctttaatgacgaagtgaacgtagctgaactgatcattagcttccttgtggtggaacttgcttacctgggttcaagtcgtagatttgacacgggtgctcgcatttcactggtggagaaaccctttgtagtcccggtttgtaacccccctttagtcccggtttccaaaccgggactaccaatccgggactaaagatcgctatctttagtcccgagtgaaataaccgggactaaagatcgatctttagtcccggttggtaacaccaaccgggactaaagatggctcagccacgtggccggctgagccttaccaaccgggactgaagatcgagctgacccatttttttttacatggccctgttgctgaaccatgcatatatatgtttcaatacatatatatgcatacatatatatatatatatatatatatatatatatatatatatatatatattatattatattatatgtatatatggttcagtacatatgtacatgcataatatatatgtatttatacaaatatatgttatgcaaaggcatatgtgtgtgtgtgtatatatatatatatgaccaagatatatttacattatagaaaatgtgtacacatgcatatagaaacatatgtagtcatgtattaattacaatccattatatgtcctagctaggtacgatttcgacgtagtagtagtcgctagctcagaagctaaggaccggtgaattgtgtttccgtcatagtagaattcacccttgggatcaaggatttctttgttgatggatcccatgagttgtgcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtagtagccgcacaagttagttccctgcttttgctttgcgcactacaaataaatgacaaattaacggcgtgagatctaattgaatcggagaaatataaatgtagagcatgtgtactcacaggaaatttgaacctccgcctaagtctttctctccagttgccgcggaccaaatgacggaaccgataccaagccctacatggagtttaaagatatgattcgtagtagaaataattaacataacaagaatttcttaattaacagaggaacttatgacagtatatgtctataagttcgaaaaccttgtcaaacgtagactcttttttatccatttagtcatatacattgacggtgcaggccgacaggtcgaagagtaaaagcacccagtggatctgcaatgtgcgtgggatgcattacatatgaaacacttgcaagtttgtacgggaatgaaatttggtatgtaggaagacagtaaaattaaactaactctatgttgtacggcaacagtatgaacgtcttgtaatgctgcgtcttcaagagatggacgagtttgtcctctgtttcttgcggatattggtcgagcattgcgacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaaatataactgaacgaaatacttacaaatccagcaactcataatagacacgtcgagggcgtccagctggtatagttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcgggcttaacaagcggtttaccgagttcgtacatgtatttcagttccgccttttctattggttcaactcctagcaattgatcgtagttagaccggtgtcagtaataaattcttctatcgtcatgtcttccccggtcaccaacggctcgatctcctggtttggttgctctccaagctgagggactggtttggactttgcagaagatgctttcttcagcgttcactcatagtccgatagcttgatggcctccttgacaggtgcagacatacccctgaagaagttcctgacactcgggtctataggaatcttcttttctagacttcgaggcttgaattgtctcttgacttctgatgccacgtaagcgtcaagctcctcttgtgtagacccccatttttataacaggaatcaatcgtataaaccgtaccatttccctggatcaagtagtctggtacacacgaactcatagctgaaatatcaagtgcacatacacgagagtctagtacgaattattacatcataagcccgcaggcacagtcttaaatcatcggaccgagcgatccagaatacattccaaaaacagaagtaggtaaggcagcggagttaaggcagcggcacgccattgccacaggcaacgaccgtaactaagacctactgagcgccatcatcctcatcactctcctggtaataggcatagggatcctccgaagcttcatctccggcctctgattaagtttgaatattgcaagggtgagtaccaaccgtactcagcaagccaccacagcaataatgcacatgacagaggaattcaaaggatggctatggttcttttgcgcaaagcaagttttgtaattcttttcacaagcctaagacctagcatagactgatcaagttttaataccagtgttcacattaaacaacgatggttctgtccaccatccattgtgatcccaaggatagcttcccgccattgagtcgtcatggttttctgaggacgtccacattcccgcctctcaggaagtggctccgtcagcataaaaaaagtcatcatgtaatatcccatcccacacaagttaaagaatttagagtctagccaagtgtaatacatgtcccggtgctcaataaccgcgagcacggctattcgaatagatttggtttactcacactgcagtggatgcacactttacccgcactccgcgactgcccaacacatgagcctcgtcccaacatatgagacgcgtcatggcaaagcttttcgataacctcgcattggcagtacccgctccatgaacttaaatcctcatgcactctaggcgttcatgtttctagcagtgagaggagttctggcgctcctgggaaagagaagtctcacacacatattaaattatggttcaagttaagttctctctctcacacactcatggcagtcctaccaatggcgacaccgatgtagggctcgcctctcggccctacctcaacggctgtcctaccgtagcgcacctgcctcactcaggggtgaaccatctatgcagggatactgcctccgctcggctatctagtccgctaggtctatacccatacgagaagtgcggttgtacgaggggtcgtttcatgcttagcttcatggctcggtccttaattgaccggggacggtactagccttttccagataccacccaaatcctccgtccgccccagtcgaaaataattgtttaattttatttctcctttcacaaatcatgtcattaacatcatggcaatgtggcgctcatgtctccacatgccgcatctcaattaccatcccaaaggtaattgcccaagcatatagcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaatttcgcaattgggatcaacatgttcaatggaatagtgatgacttgccttgctcaatgttcttgcaggtcttgaccttcgcttggatccgcaactccctcggtctctatagttacgtgcgaaaattgatttgaattcggttagaattcaaataaaaatccaaataaattccaaatgaaagtcgaatgcgaaagtcgatttctttatattaactttattattcgcgaactaaggcaaacccaatttcgattcaaactattttgcgagtataaatattttgttgtcataagtttttaatttaatctacccgagcattatatccatataataggttagaaatttctatcgcgagctaaatatcggacggaatcctagaaatattatatgatttaatttagcctatgactaaccgattaaatataatatacgtctaaaattcctagtgattaaatcctaacttctaccgtgaatcgattacttatagagattatccaaaactaatctataatagtctacaaaaattcatctaattgtttagtcgttaattcttttagaaattaccaagaataatctataatttatattaaattttgcaattctatgcccataattaatctataattaaattctaagtattctagattgtcttaaactattaacctccttaatttcgtcttaatcctcgaagtaagtctcccctccgtattccccagtcgctctgctcggattcgttcgttatcgttcgtttctctctttctctttttctttcttttctctctttctctctttttctctctgccggcctctcttttcctctccctctctctctcggctctctcccacccgagcggcggcggcggtggacgcgagggggaaggagagcggcgatgacggtggcggcgacggtggcgcacggtggcgcgggagcggcggcacggcggcagggaacggcagcgcggcggcacgggaacggcggcgcggtgcacgagagcggcggcgcagtggagagggaagaggggaggaagggtgagatggggtgggggaaaatggagagagggggggtatttgtagagaggggagaaggagagggggaggggcggcggcgtaatggcgacgcgacggcggcgctcggggcgggacaacggcgacgcgcgggcggcgacgcgatggcggcgcggggctcggagcggcgatgcgacgggcggcggtgcggggctcgagacgggcgacgcgacgggtggcgtggggctcgacgcggcaatggtgacggcgcgcggcgatgggacggcgacgcggcgggtggcgagcgagcggcgtgacaggcggggcgacaagacgcgcgcggcggcacggggctcggtgcgatggaacgggcgtcgcggcagcggcgcagggcgacggcgaggggacggccgcgcggcggggcgcaggcgcgaggggacgggcgcgcggcggctctaggcccgagtcctacggcgacacgacggtgacagcgcggcagcggcggcggcgcgcgcaacgggcgggcgactcggcgcacgcggcaggggagggggcggggctagggggaccacgatcgaacacctatgccgcaatgaacagtaactttccctatttatcccgattttagcccattttctatttaaatatagccctataaattctaatttttgcataaatgaagtttactccatatttgtgttatcctaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccaacttgatttttagggtttattcctagttagttattcattattcgcgattaataaattccgagatcaaaatccaatgaaataggcgaataaaatcggcatgatgcaatttattacttaaaaagtttttgaaaatccatatttttggtgttttgatttcgttggtcgaattttcagggtgttacatcttgcgtgcaatcgtaccccgggtccttgttcttggcggcgtcaactttcgccttcttcgttgcccttgcgtgggcaggcggtggagctgggggggcccttgactttgaaggtgtcggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcatgagacgccgcttgtcacccagggaggatgatgtaccgcctgcgccatagaataatggcatggcttgtgtctcgtagatgcgtctcaccatctcctccagggtaatccagctcgaggtcctcgtacgcgccttcgaccaactcaacttcgaccttcgagtatcctgctggactcggcctgcagtggtaagtacctgaagggttcgttgggatggccatgcccgacgccaccttcaagttgtgagagattatttattagtaatcacatatataagcagcaactaccggaatggctaaatctaaaatataaactacgagcttacctttattgataagttcttgaaaggaatatgcagctcacatggtgtccgctgagtgatgtcatcaacgggacaggtcgattcgtcctgtgtttgcatggcgtccatgctctgtgatcctacctgtcccgttgaggcgcagctgctacggtttcctgacgggctcaccattgcaggaggaatggtcggctggggatcatgggactgatgtgcggccatgcattcatcaaccttccctgccacctcctcttgcatgctgagctcgtagctcgatacccggaactctagatctgcaatcttcgcctcggtatctctcttgctcctcatctgactcctgtacgtgtggatgtcctccttaaaaccaatcttccaaggaatcacccatttccctcgtgttcgtcctggatgctctggagtctgcagggcgagtgtcagctcgtccctatctctgtccggtcggaacgtgccctgagaggaggcttccactgcatctgttagtcgtcgcgcagcctctcgtatctgatcgccgaagactagtgagccatcagctaggttgagcgttccaccgtaagcatagtaccagaacttcgatcgttccggccaattggcggttgccggttcgatacccctctcaagcaagctagcctccatctcctcccacttcggcatcgcgacgctatagcctcctgaccccaagtggtgatgatacttcttcttgggggcattttctttgtttctttccatcatcgcctgcccttgttcacctgtcttatatgcaacgaactcgtcccagtgatcccttagctttgggaatgtgtcgaagttcggtgtctgccccttcaggatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgacttccactagcctcctcctcctggttcccctccacatccctttccacgtgcccctggtggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaactatcgtacattagaaccctacacaaccttacgtgctaagtctaattacaaatcgtgatataagctaagtctaggtgacgtatattatacaaccctagctagtcaataattatatactaagtctaattacaaataaaataatcttataataaaactcaaataatattacatgctaagacttaaatagtcatgtatgctaagtgtttcgtgcgtatatgctaagtctaattaagactacaatagtcaattgctaggagtcgcaccaattctgtagtcaataattacatactaagtctaattacaaataaagtaatcttatattaaaactcaaataatattacatgctaagactgaaagagctagtcatgtatgctaagtgtaactgtcgtatatgctaagtctaattaagactaaaattgtcaattgctaggagtcgcaccaattccgtagtcaataattatatactaagtctaattacaaataaaataatcttatattaaaactcaaataatattgcatgctaagaatgaaagagctagtcatgtatgctaag

SEQ ID NO: 69229 - DNA, 858 bp, Oryza sativa
  unsure (1)..(858): unsure at all n locations
gcgagagaaatcngttaacattttantggtttattttagtccnnccccgtannccactggacgcttttgtggggtttttggttttaatggtttatggttgattttccttatnncaaannnnnnnnnnnaatgtattgatgtcatgtagccancnacacnagagnnnaagacanngaagagcacgaaccagaatagtgttgttcgtatagatgccataggacacgatggtacaactggcatgtattacggtgccatcgaggacatatgggaacttgactatcgacctctcaaggtctctctgttccggtgccaatgggttaggttgactggtggaggcgtaacgattgatggcagtgggatgacaacgattgaccttaacaaggttgtcggactaaccttttgtccttgccaatgatgtaacgcaagttttttacatgaaggacatgtctagcaaaggaaagaagggcaaagggcctgacgagccaaagccccacgtggttctcccaggcaaaagaaaaatcgtcgaagtagaggacaagactgacgaggattacgatcagtttgatgggcaaccccctttcacggtgacaattgaccctagcatcctcctatcaaatgaagacaccccttactcacctagtgatcacaaggaagaaacaatagtgaggagaaactacgtgtggtcaaccgtcaccgccaatgtattgctcgaattgttgtgtacacgatgtaaactatttttggatgtattgaatattccattaaaattaataggttgaatgggaaatggctgaatatagatggattactagaatcttttacacaatttttaattcttgcatattgcttgcgtatttc

SEQ ID NO: 69230 - DNA, 1906 bp, Oryza sativa
actcttgaaggttttgggctttttcagcaggtgaggaaaccgcagccgcacaccattgcctactacctgcgacactattctggcttgtagctcgacagccgaacatgtcttttttcccctaaaattcttgaaaggagtttctttagtattgttacccgataccatacacatggcagtatatatatcatttagatcttagcgctacgaatgtaatttaaattttcgcgcgcaatttctatacattatttttttaaaagaatatttttctctcgagaaaagaaaagtaaaatttgcggggctcccaaaattgccagcccgtctccctctcctcgtttcctctacctctgtgactctcttctttttttttcgtcagtctctcctctattctctctcctgtgtttccggcggaggcacgagcgcacggacagcctcctccccccgcctccacctccgcgcggtcgccgccggcgaggaggcggcgccggacgagctcctctccttccccgccacgccgtagcatcctcctcctcccccgcgcgcgcgccgctgggcgagcaagtctgggggccaggagcgagcggcgcggcgcggcccggccaggcctctcattccaccaccaccggcgcccatctcggcggctcggatcgaattcagaggtgattcgagagagactcttctctcgtagcccctccgttcactccctcctcctcctcgttgtctcgtgttccggcgtggcgtagattggagacctgtattgattttttttttttttttgcgccttcgcacgcagtttcgtcgcttgctctccgacggcggcgatgatggaggcggaggaggcgttccctccgcagaggaatccccgccgcgcgcggcgccgcgacctcaacgcactggtttgatccgattgaccccctcagtttttttttaaaaaaaaatattattgttgttatataactccccatcggtttagcggccctgtggccctgtcattgtagacgtttgatgtatgcagggtttgaggttttactgtgaaatttgactctcgtttcgaggttttacctggaatggattgtctcgattttatggggggtttagggttccttacgtgactgaatggctgtgtgtttgcagtggttcatgttctagtaaggaattgtgatttcgggtttatatatttacagcggcaggttgtttgtgagtaaaggactcgaaggttaggatttttttgtagttccaatttgttcgtatttaggctttactgttttatattggtgagttggagtgacattttagtttcctgaggcagtttagttcaacccattatactagttcatcctcgattggttttgtgtgttgcaacctctgactattaggatttagtacttaacatagatgactgctccagctcttttaatgggccaaacgaggtatcatgccgtgccatcctgatgatcctaaatttgccaaacaaagtatcatgctgtgccatcctgataatcctaaatttaggacattctatatgtgcaagttcaacgagtagtgattccatttctatgttgtagagaaggttgattttttagtgtcatcaatttgtataagctggaagacactttaggttttgaacatgttgcatttgctatgttctgatgattgaggtattgtttcaggatcccagtttagaagagtctgatggagaggacattggtgttccagaagttggcatggtgtttaataaccacatggaggtcaaccgattctaccgaaggtatgctcgccgtgttggctttggggtgtctgttaggaggtcctcattttcacaagagggcacctgcttatatctggagctcatgtgctgcaaaggagggcggccacgttatgagccaaagttcaggaaacgggcctcttc

SEQ ID NO: 69231 - DNA, 1189 bp, Oryza sativa
  unsure (1)..(1189): unsure at all n locations
atgactgtttcccctccaccnnccnaagnnncggacctggcaatcctttggcctctactcttaagatcttatggacatgtaataattctctatttgtgtggatgtaatgacagttagatgctcttagctgctctttatttatattgctcttcatttatgctatgagtgtcttatttgttgtttgtgatgtgatgttgattttatccttttgagtgctcaccatgtcgtatcttttgcatatcatatttattcttactgctttttgcatcccacgaatgagtagggatgaaggaaactctcctcggttgctccgttatatatatgcatatgagcttcactcatattttccatatgcatacactaagggggagtttcattcacctctaaccattcaaaacaaaattattatcaatcttttgtaagctttaaccatgttgtcatcaatcaccaaaaagggggagattgaaagtgcattaatccccctagtgggttttggtgattaatgacaaatgtggttaagggactaatgagttcattgagtatctttcaggtgcattagtccaaggtgtggaagatggatgcgtggagaccccccaaaagtataaaatcaaagcggaccggaactcgagaagtgcataggatagtttattttttgcaatcgagtttttagaaaaaaccgtactattaagaggggttctaggtgatgctctgagatatctcaagtgctcttagtgtgaaccaagtgtcaagtttccctaggagtcatttttgcaaatgctccattggttcaaaaatgcaagtccggaacttactgtcttccaggtccggaacttcctgtctagtttccagttcaaatttgtgagtaacggctagatgacgtcacctagccgttatacatatacagctcgtttccagctcgttccttggccttccactttcactttttgaacctagagctgttgctagcctctcccaagtgtttcttgccttctccactcaatctagagcctaattcttgtgagaaagagagattgagagggagagaagaagatttggagatgtgtgaagactaggatcttgggtgagcacttggaatatttcgggggctgtcatctcggggctaattactcttggagatgatctcctaaacggttaggtgtcgcccacgagaatcccgtgcatattgggg

SEQ ID NO: 69232 - DNA, 5324 bp, Oryza sativa
  unsure (1)..(5324): unsure at all n locations
tcaagcaatacttgaggctcttctagattcaataaattatctgccaagctagttagccaagttaggtagtgtatttgtacatagaaaaaatcaaaagctttcttcttcgaccttgaaattcaaatccacagaaatatttcaaaagtaaaagcaatctggaaaagtctgaacactgtgctctttgaaatacatacctcagatggaaaaagcacatgatcaaataccgcgtctggccagtcgtgcaatgctgacattattttctccaccttcttcttgacacctgtgtagaatgaacaataacaaaacaagttatctcattatctgagcctactgaaagcaaaagggttctatggcatattgaactgcaggaagtgaactcttacgtttgtcttgactgtccttttccaacttctgagaatcattcccagtgaagtgggtgccctccaccccatccttagcccattcatgacattttgcggtctcatcagaaaagattacagtcttcttcactgggttcttggtggcctcatggctgcgaagagcagtcttcttcaagatagtgccatcagaaatgttgcgccctcggggcttggcggtgttggacacgtcctgcaggggcctccgcgtagaccaccggggcttgccaatgttggatacatccctcagggccttcttctcttgaagcccttgctntgctgctaatggcttcagtggcttggccttcaatccatcagccctcttgccagcaggccctgcacacatggaccaaacatgtcagtcatttaaccacaggagatcctccttgtgatgaattagtcagatcaaaagcagccttacccctatggatatgcaggttctcatcaagaaaaacagctgttgcagttggggcagccatcacaaatcagcaagcttttcttcctcaaacttgcctgaaaaattctaggtactgagcaaagggggaaaagacaaaattgctagagaaaaacaataagcagtatatattacacattttgttctacaaattttgcacaaggtcagaaaaatattagttcaacttgtagcataacaacatatggttgctgaaggaaaccaggatttcacatacattctgcatgagtccccatttctccaacagattttcagcaaaatatcagaaatattttgctttgcgttctaaactactccctccgtttcataatgtaagtcattccaccatttccaacattcatattgatgccaatggatctagactatatctatatagattcattagtatcaatatgaatgtgggaaatactagaatgacttacattgtgaaacgaaggaagtaacagattagacggcgcacctagagtcttcaagggacacagccgtttctccaacagatttgcagcgacagctcagaaatattttgctccgggttccaaactaacagattagacgacgcacctaaaatcttccaagggacccgagccatacgtatttcatgaaattagcaggagcaaacaaatccccaataacatgccagtttgcacgaattggaccggaatgttgcggataacctagggtttggattcggtcaccaacaaccatgaaacgagcaagatagggcaaaattttcctcgatgacgggaaaaaaaaattcaagacaacgcgtgaccaatccaagagaaagccccagtgcttacctaccaggtagaagagaaaccccgctccggatcgatctccgcctaaactccggcacagcggcgtcgaggacgaggaggagaagagcgcgcgggggcggcgggagaagggcacgatcgcggttcgattcggcggcggcgcttctcgccttggtcggcgtgggggttttgcgtttcttggcgtggagaggaaaggggaaatttttttgctttgcgcgtgggagagagaaggatcgggaagaggaagacgacgtaaaaggcgaggcgggcggtgcaacggtcggattctggatgggccgccgacttaccgttgtgacacacggcccatctacacgggctcctccggcccatataaatgggcttcaccggcccaagatggctcaccgaaaccctaaccaggcagccgccgcgactggctatatatatactcatacttgctcaggagtagagacaagcatcgccggccgccgctcctttcgaatcatatccattatatctctatcgtgtgctttttatcatcgtggtttgtagtcgtgtgcgttttattttcgtagtttgtgtaattggtttgattcgttgaattttcggggtggttttgagttgttcgtttctttcgatctggattttttttttgggggtgcggatttgcaagatcagcttcttgtttggatctcgagcacacgcacacggtccaggcaatcggcatatggtctgccatcttgcgagattgaaatcgagccagcttaaactcacctggatctgaccctcggtgattttctgggccctttcggctggcacatgcccctcgtcttcaaaatattcgagatttgtctttttgttcttggttattgatctcgaagcaaagcaaacgcactctgtcccaagacttgtcagtgttttgtggcaatttcttcgtttgcgagaaggatgttccgagaatctcgtacgccggtgaggtttcccgtgatctggccgaggttttctggatacattcaacgcggaaagctgcttttaattttgttccaatttgctgtctttgtaggtctgcaccaaattcgatctgaatgtccttgtgaagcgtgaaatcaaatttggaataacatagtacggagtagtgcagaaccgaaatccgcatgaaagtactctgtatctgttgtctgataaactgagaatttcgaataaaccggaacataagcattattattatatgaaaaacggagcattgaaaatttcgttatgaaaaacggagcattgaaaatttcgatgttttgctcgtctggtagacgagaagcttatttttcgaagatatatcttccaaatcccaattatgtttgcgcctaattcagacgctcccactccttgagggcttgccggctcgtttacctacattttttgatttaccgaattttattaaggtaacaaacttttgccaactgccagtgtcagtttgtcactatcaacatttggtatttcaggaagtttacttgtgtacctatacaaaaatttagaaagattgcaaactaaacacatctaacattgacaaaaaattattaacgagtctacccagattttgcactgtcaaattttaagaagattaatttatcaacaaactgaactagggcttaagtcatggataaattcactcgcactcacgggccaacattacgctcaactggcttgtgggcctaaattatggctgctggaattgctcgaactgatgggccaaaatgaagaacatttgtgggcctgaatgttatcatatcatccaagatttaaatttagaaagattttgaagttttttcatcaaagttaatgtttcagtctttgcttttagattattaataatacgtatataaaaattttatttacaaattacttctcgtttacaaatatgccgagctccgaatagctagagacgatccctcaaaaagaaaaaaaaattatagccagagacgaacatacaagctggacgcatttcttcaccacggagttgatttgatcgatccacagcattttcagcggaatatcgcatgaaaatggcgtttttttggcaacacaatcttgaaatgctcgaagccaccaagtcctccaccaatcgctcggcaccacccaatggcgggcagccaccacgcatgcacccacctcctcacctttgcaatgcccataagaggaggccagccttcacgccttcctccgccatcccaccaccaccaccaccgcggcctccgacgcctccctcccacacgctcccctgtggccgtacgtgcagccggctgcaccaccagctagcggcggcgggcgccggccggcggcgaggggatggcgtgcgaccagcaggcggagctccggcgggtgttcgagctgttcgaccgtgacggcgacggccggatcacccgggaggagctgacggagtcgctggagaggctcgggatgcccgtgcaccgggaggagctcgccgccaccatcgcccgcatcgacgccaacggcgacgggtgcgtcgacatggacgagttcacccagctgtacgagaccgtcatgcgcgtcgacggcggcggcggcggcggcgcctgcgacgtggatgaggcgagcatgcgcgaggcgttcgacgtgttcgaccggaacggcgacgggttcatcaccgtggacgagctgggcgccgtgctggcgtcgctggggatcaagcagggccggacagcggaggactgcggccgcatgatcggccaggtcgacagggacggcgacggccgcgtcgacttcctcgagttcaagcagatgatgcgcggcggcgcgttcgccacgctccggtgatcggcggcgtcatccacgcgagcgtcgttgtatcgtctatatacccaacgtacggtcgattgtttgttttaacatagcttgtgcatgacagtttgtatgagtgtactacgatccacacacgcgatcgaatttcgcagaaaatgtattgtgatcataagccgataagtttcggaggtggtaaaagcataaagcagccgctataattaagaaatttaatttgatttcctgatgtgcattttcaattacgtactgtttgatccacggcaggcctgcaagcttattgcgcataattttcacgtatgacccaaaatggaaaaatgatgttcctggcagaaaactgataatctattacatttgtaattgtactgaaactataactatgatgatataacttatatataactatgatttggttagctaacacccgcaatctcgcggtgtggaggttaggagttcgactccttgcatatgacctgaatctcaaggtgatctgatggctacagtatcacatgaaaaaaaaatcacgcattacatttttcatcactgttttaaaattcgacttaattattttcaaatttaagtatgtttctcaaaatccaaattaattatttccaaactccatgtgcaatccaatgttttgggcctgacaaggccgcgcagggaagcctcctcagccggcccattaacaattcacaccctcgacgacggtttgccctctctcccgagcccgggactccggccgccacgtgcgtccacctccccggcggcgccaaaaccctaggcaaggaggagagcagcgaagggaggggagagtcagagtccaccatggag

SEQ ID NO: 69233 - DNA, 793 bp, Oryza sativa
  unsure (1)..(793): unsure at all n locations
ttccgtaatatacaaggaaacgtaacacccaagtcatgatctgttacatgttccatatatataagttatcccctataactagtcggataaccatgccgtgtgggtatggggtacccataatctccacactatctattccaggcctncccttctactcccggcccacctttttcctcctcttccgcttgggccgcccctaccctatcccggtccagccgacctgacgccccaagccaccttcctcctcttcctcgcgcccctctgcacgtgcggcgcacgtgcgcgcctcgcgccggaccaatgggtacacccacccggtcgtcttctaccttccagccggctcctctctctcctctcttccattaacccttgcaccaatttcttccccgaatccggtccattcatgccggattaattcaaattgggtagagaaatggaatccacatcccttcctctctagttcccctaactttccccatttaattccatccccaatcgccgggatttaatcccccttctttgacctcttccgtgactggcacttccttcttggcctataaaacgaaagtcctcatctccctccgtacattttggtccctttcgagtttttagccaccttcacgccggcttcttttcacttcctagcaccggncgacttcaacacgccctggcgccgngtnagttaagccggccggccgtggcattcggcttcccccggnngtggaggtcggccttccctttccccggcattgctcttcgtttnccggcggagaccttcgcaagtgctatctct

SEQ ID NO: 69234 - DNA, 3202 bp, Oryza sativa
acctctttacttgcccgatcatatcttagatctgtaaattatgttatggtctacgttccactcatagcgatgtgcttgagtccaagggacagggggtcgtcttggggccagagagaatgaatagatagggccccacgagttgttaattggccgctggggaattcacatgaaagggaaggacttattctgaaccaaaaaagtgctcactaaaccgaacatgaaagttgttttccatcgttttccatcataaagctgttcacataacttcacttttgacttggattatatatcccatatatccaggtaccatattaagatgtgattggcatccctcggcaagcactggtatgtacttaccgtataataattgctccacaagtactagtatgtactacttaccgtataataatggattgatatgcatgttttttcttccttgtacatagacacccgagcacatgtcttgtgatatcttagcccaataagaattagacatgtgtagcccatgagagttgtatgcgcatgtttagtaccaccgaagggaggaccattacaaatggtatcagagccgaccctcgcggttgcgcgtatgggtcagtgtgagggcacatggcacatggcgcatgtggactttgcgtgaggcacatggcatggcatatgatgccaacactggacgttcgggcatgtgctaacagggggtgtgtttctatacctttgcttatatgcctgtgtagctatgtgggtgatttggaccgacggggacgtcgggtcctttgaggggggtgtgtgtcagacatcccgacccaataaggattaggcctgtgtaacccatgataactgtgtgcgcatgtttagtaccactttctagtttagcaagggtgcgcccttataaggcctcttccctcaaactatatcactccgggttaaccttttagacgaagtatggacaaaagtataagtgggatggtatgtgtaagtgggcccgtccgtcggatgggctggctacgcggttctggagggatgtgtgattgaggtgaagatggaatattagttcatgtggtagcttgaactactccatctaaaccataaaaactaacttctgctacaaaccgtacatagcctacatttatatttatagctaaaagttgaatttcttttatgggacagagagtatatatacgaagatagctatacatccatctaagattatatgggcacttctaagtgtgttaaatagcagaaataaatattgaggtaaatctctttgatgtacttggaagtttatataattatgtactctacttgactggaaaaatcacgcccaatgatgcaactatcaataattacctaatgatgcaactatcaataagtacaaatttgttggatgaattgaaaagtagtacactacttcacaaacgatttttccatgcgactaaaatcgattttcccagataggggatgacccgcctacacccagatgtccaaaaagtcagtatttttacatggggaagagcaactgcatgtgaaaatacagtattttcgcatgcgggcgcttaagctgtcataatgcaaaaagttaaatcgaatgaaaatgaacaatccaaaaccatagtgtaacgccccacttttcgcgagacgttaaaagctaatttattaaaaatcctaattgtgaaaatttcgttctttgagtgtttgagtctaagttgtgccatagatctcaattaaaaatccctcccttgtctgcataccctgttatcaaagatcgtctcctcaaaatttccatcccaatataatcccgaagttcgatcccttctattcggagttccatcctgaaaccccacccgtgatctttgtcgaatgcccgaaccctaacccagtccaatgattcacctccgagacctaaatactcccttgtttccttcaaaccgactctcgaattcgaacttaacctctcaatttcatctctccctctctctctaccttcccttgactctctttcgaataattgatctcaactcccatatttgtaatctccctccacctatcgctctgtcattcgttgaaaccatttccgagtatttgctccgaatcccctggtgcagatccatattgaattcctttttatgaaacccaattcccgagatttcccctctctttgaaaccccatccaagtaattctagaacaatccccgagtatagatctatcccaggataatatccgttccaaataatctcgtctgaacccttctattcagatttctcttctaaatcccttacccacatatctcgtcgagtagtccaactcaaactcccaagttacactctccttctctaaattatttgactcgtctccgaatattgttcccttccttgactccttcctattatcccgagaccaagtatcgacttcgaaattcgaatccagactccagccctaaaaccttccaattaaatctctctgtgaaagtctatttaacctccctcataggttggattccttcttcctttttcctggtccacttcttccttctattccagcccatctctctccctctccctaaagtttggacctatcaatctacctacaccaatccgagagttcgaatttccgtattcggattcctcttgtaaaaccctatccgcatttgtcgtcaatcctcaaaattcaaactcattgattggttcatttcgtccctctctctttcgatcgatctacctatctacctatccatcgacctatctgtctctcgatctaatcatcgatctctctacctgtcaacccatctaactatccgtctaccgatctctctggtgatctatctatctctacgatatccatcgggccgtccgtctacctatctatctttgaaatctatcccaaagaaataccgaattcccgcttggatgcattcccttgactcctccctgttttcctgagaccaagtttcaagttcgaaatccaaattcaatttccaaatctcgtttcctccccggcgccgaatcccgccgcccccactttgaccgtgccggcccgcgctccgcgttcaaattcgaccgcttgatccaccgacctcgccgcccaacgcatcctcgccgttgccgttttcgggtcgcccacgaaaccatcgccccaccgccagccgagcgccagctcgtctgtgatctcccccttgcctataaatcctacccaccgagccccaaa

SEQ ID NO: 69235 - DNA, 8289 bp, Oryza sativa
acaggtgatgttccatgaatgagctttgaatctcttcacttgctgtacaggggattcgtatgtgtacactcttatgaaaccatcatgatatccaaccacaagccattgcttccgcgcaatcaacttggctgcgctagctgcagttttggagtgattgatatgttagcatttgctgttacaccaggggtaaagtctatggctagcagtgagttaagtcaggtcaggaagcatgcctcttggtccaaatgagctttgaagcaggttcactgtttcctgtggacaaatatgtggaccaaccttagtcccagaacatccaacaccattcagtttgctaattataagcatggagaaacttacaatgaatttcactcgcataggcaaacattacaatgttaccactaatttttaagattaagagaaggtggttctttttatattcattatatcatcggtggtagttatccgatttacattgggtggtatacatatggtaaattcggaactaattattctgaaatttgtgttacaactgggttcagttttaagaaaatcaatttatgcagggagacatatttaaaagtagaaattgataagtattaaaatgggaaatgtgtttagtgttaatttgtatctttggaacttcctaatgtacaggtaccaaaaattaacactaaaaatagtatatacagcccactgggagtggtcacttacttgtgtatcacagttcaggatgtcgactgagccaaaaatattgcctgtcaaaatcctgcacacaagaaatttattatggtaaaagctggtaacagctgttttgcatatgctatgaaaggaaaagaaatgtattaggtgttcatcacatacatattctgaagtatctaaccttgattttgtgggctgtaacgactatgattatagtataacctaaccactagatgaagtaaagaattttcagcaggaaagagacaagcataaaacacaatgatcgttaaatcagaatgtactgaagaactaggactccctttttttcatgtaaaaagtctagaaaaaactcataatacctaatcttcactaaaaggagcttgaaagcaagtggacaatttattttagaaaaatgtagattttttacaaagtttattattgtaaagctggccaccaggtcatgactaatgaggcttttgaagggggctattttcttttcacgctttaaaataaaatgggatcatagcaagtaaagtaaaggatgataaatttatcgcttttagaaatgcaagaaaatcttggtttcaattatcaccatgagaacatgtagtttgtctcctcaaacaaaaagagatgacaatttcacgtaccatggctcagtgggatgcgcatctatgggaatgtcaggattttccattggaatgatctgatcaaatgaaacagcaaccaaagtagacaaaattataagatatttgtgaaagggtttaccgatgtaacaaaagtaagcaattggcatgattccaacagaatatagagataaaatttcacctgatgcacctctcggtcctcttctttctctttgaaagaagaaccgttatggtgataagcttcttggtttacttgggtgtcacttaagttcaaatggctggccaacctgctctcaagggtgataaactcgtcgctgtatgaggtttgcttctcgcggtggtcgttgacgaaccggacctctgagccatggcttatcggcaactaaatgatatagccaatgtagtcaattaaagaagatttacatgcagctaaaaagtctttcaaatataaatacatgttcctttttgagtaagtggaaatacatgtattgtaatgtgcagctatgaaactatatacccaacactgcaggtacataaaagagcaataattaatagggttcgaccattataaaacatattaaattattgaatagcctacttcacatgattaaaaacagggttgatgtagaaaacttcaattaattttacttcttttttgtgaaactgcaattaattttacatttttgatcccctaaaaggataattgtcaacaaaatgcaatcccaaaatacagcggaagtgttgtgagacagaaggatgttgattcctagaaatccctaacatacaaggagaacattctgaaaatgacgatcaccctagacacttagatcatctttgtggtattgcttttggtcgcggacgttttttcagtttcttaaatttgttatgtttgtatttggctcctgacgagggggttttctcctccgttactttcttctcttcttagtggaatgacgcgcaattcttttgcttgttcgagaattaaaatagtcattctttaatatataaggaattttacagaataaataaagaacatgtcgccgcttcatttaccaaagtaaaatcattccactttatgcctttatgaagagcttcgcactaggtttattttttaaaaaaaaaacatgccagtaacaatattgattaccttgccaatcatagtttctgtctcattaatcttattgacgatatccaaaatattgggtcttttgtgtctatcaatctccacacatttcagagctatttcagtgcacgtcttcacctgttggcgatatgcttccaatgaggaaccattccatgttgcttgtaacctgactgtccaatttcctagtacctgcgaaattagaatgtaaagctaaactattaatattcaatacaaaaggagtagtttttcagagatgatcactgatcctgataaagacaaacaacatttcttactagatcagtaaattcttgggaagacatttcagcacttctagagcgccctctaggtcctgcaattacgtttagcattacaacacccaagctgaatatgtctagcttgtttgagagtacattcttctctatgtattctggcggcaggtatccgctgcatatggacacatatgtaagcgcatccttattagaaaaggattcaatcaaataagtaattgagcttacactgtcccaattggagtttgtgtgacccttgttttctcttcggtgaagagcttggacaatccaaaatccgcaagttttggcaccatgttcttgtccagcaatatattgcccggtttaagatccaaatggtaaataggtggcttcagtccctcgtggagatattttaaaccctcacatgtccctttaataattttgaaccgtgtaggccagtcaagaccatgaaattcgtctgcaaagatacagaaaagaggtatcaacataataataaacataatctaaatacccaggattatttttttcttagcgtgctaaggaatatactagaactggagaaacatcgtacctgaaagatgattctcaaggcttccaccggttaaatactcgaagcagagcgctctatgtattattgcagcaaaaactattcttcctttgtactctgcgtatttatgttgtgtttcatagcagtaggcaactagccgtacaatatttggatgctcgagcctcataaggttctgaaattcattctcgaattgcttatcgtcaaatcctagagtatcattatgaagcatcttcactgcaatctcttttccatttctaaactctccctgttaaggatctattgtcagtacttaatacagcttgatttagcattactggtgaaaacatttgacaaggatgaaattgtaaagcatgtctttatttgctttgtagtcacagtatactacaattaagtatcatggacaataaaaggcggggcatggttaattgctcatcatagtaatataagtatgtgcaaacatgtagcgcatgcttattctttacaacccatacagtgctttgtcaagttattcgcaataaacaaatgatgccctcaacttaccttataaactgttccatatgcaccttgaccaatttttcgctcctcggagaatccatctgtaatttcttctaacaatcggaatgttatatccgttgggtccatagttgaatctggagcttgatgtcggtgtcctggtttatgctagtaaagaaggccttctgcatgaggacaatacaaagtaagttacgctgttaaagagcaagaagttgctactagctctagcactcaactcaacatcatctggctcttttttcttgccctttcattgttttgccttttgggttcctgatatcatccagattcaatcttgcattttgaagttgcgaagatggacaagtgatgagagagcagaaatttcacctgatttttgtagagaaaaaaattctgattcaccatctaaacaaatcattatcaattcaattttacccccaccgtcgctcaacaagtaaaaactctcagaataattgaaatcgaagggttggtccatcatggcaatggggtcaccactcaccacccataagctcctctcctcatcatcttcttcgctcatctttttctctttctttcttctcaccttccccggctatgtctcctcaagacgcgcctccacatcgggcgacggggctgcgccgccgccccgcgtagcggcgtcgccgcatcgggagcagcgaatcccgcaccaaccaacgaaccgtccgcgccgccaagtgggccaccgccatcctctccccctcgccttctgccgcggcttcgccacctcccggcctcaccgggaagtccggcgatgccatggtgcgcgcgcagcgcactcagcatccgcgaccgcgaggccgagccctagccgtctgcaggcgcgagcgccatggaagaggaaaacgacgttcgggtgtgtttggcgctacgagttgccagctccgactcttcattttccacccgcacacttcctaaactatcagattattaaatagtggtatactttttgtaaaaaaatataaaaattacttttaaaaatcatattaatctatatttttatttttttaatgtgtaaatcacagttttttacgtgcctagagaaaaagtattagcatccactccccaacgacctccaagagggagaaaatggacatttggcctcgttcaacacgtggtttcgctggaatgccatcccgaaacgtgtttcgttaaaatatcaatatagagcgcgtgctcatcgttagtttgccattttggccagtatattttcgaaatcatttttgctcctccaccgggtgatgagacaaaattaaccatcatgtcctccgcgccgtcgttgagaaagaggagctcgtcctcaccggccatctccatgtcctccacaagcagctcaccgtcttcctcctcgtcctcctccatggatggcgtccggagcagtgctgtctgggaaaggccagacgacgagatggccggcgggtcctccaacatcttcccctccctcaacctcgccacctccgtcgatggtgacggcgacgaccgagggaatccccagcctcctccaacaacggctgatgaccgtggaggaggaatccttcaaccgatgacggcgatgaccgtggaggaggaatccccagcctcatccgtcggtggcatcctcgatactgccaccgacgccgctgctccccaagcactagccgccgccccccgtccccgcagcagcagtcgcagccgcctgctccagtggcaacctactgatgacgacgacgggcttcgcctcctcttccggagcaggcctcctcacctcctcatccacctgccattcctcacggcggcgacctcgacagcagctgcggtcgcggctgccttgacgacgaacaccatatgtggctgcgtaggtcgaagtggaggaggaggcggtggcgacggtgctgcgcggcgaggtggtcgaggaagtcgtggtgatggcgcgggtgaagggggaggaggggggaaccatcttccatggctgcaaccgcgaggcccgctcgtcgctcaccgtcggcgagacgctgtccgcgcgcctccctggcgaccgactcacactcctctgtcgcttctctcgtggctccccgacggcctggacacaacggcacactgcctctcccagtagtcgtccacgccgccacctctcctcactgtgtcaaacggtggcggccgagatgcggtggcgaagcaagggcatttccgtcttatcatcgggtggatgagctaaaatcattttggaaatgaataaaatggcaaaaatggcaatattgcggtaagcatgtgcttcatataggcattttatcgaatcacgttttgagaatggcattctagcaaaaccgtgttttgaacgtggctaaatgttcattttctccccaagataggaggattagaagaggaaattccagggtatagcgaggagtggttgtttcaattattctttcaggatttgccctcacctttactgaattttagaatttcaccattgttttcgttaaaataattagattttttaaattttaagattcaggcccttgttttcactaaaacaattaggattttcagatctagagtagtgttataattgtttttaaatagggataagttttttaagaccttgatgagccttattaatattttcttacatgaagagccttattaatattgcataacagttatatcatcaaataatcttatacccttttaaagggcctgatgtcattttcaactataccttttttggtaaaattatcaaaaaaatatctacgtttaatttgttgctaaatttagtcaatacataagaaatcctgccaaaattttggcaatattgtcatcttaccaaaattttggcattaccaaaacttggtaagatttattttggcgacaatctgaccaggccaaaaatattttaatggtggtggtgagtagtgaatctatggcccaccaccaccttctacctaagagcaggtacaatagcaggcttagccagctataaaaatattttaaagagataaaggaaaagagagaagagcagcgggctacatatctgtagctagctgcagcactgactacaagacgtaatgtgtatatgacaggtgggactagatattgatagtatagtaagcaactattgtatgaattggctattacattggctataaataatttggagctagtagtgggctatactattaaacttgctctaataggggagtccttgttagggtgtagcatatgggtctgttcggaacccagggttcccaacccctctccattgtattctgcacgcacccttttcagactgctaaatggtgcgttttttgcaaaaagtttctatacgaaagttgcttaaaaaaatcatatttatccatttttgaaaaaaaagctagtacttaattaatcacgtgctaatggaccactctgttttctgcgcacactccggatggaaccaggtgatgcgaacacacgtctttcaaattgccatataaaaagttatctcagaagtagctaatttgtttggggcttttaaatggaagaataaccaatatggtccctaaagttttactcctgggttattttgggttattttagtccttaatcttttatattgtccaaacaagtcctttaaatttatcacataggctgatatagttcttggtcccaccaaattcaccacatggacatgccatgtcaccctcctatgcaaaatctatatgatttcttcaatttacccttacatatatcataggaaaataaaaaacaaaagaaaaaatttttaaaaaatatggtacatgtaagagcaaaaatatacgtcaaaaaggtgaaaaaaaaggaaaagtattttttcctgtggttatgtctagttcacccttacatttatttttctatgatatacgtaaaggtaaactggacaattcattatagattttgtatgaatgatgacatggtatatccatatgacggttttggtggaccaaggattattctaggccttttgataatgtttaaggatttctttggactatttaaaagattagagactaaactaatcatacaaagaaaactttagggactacaatagctattctccccttttaaaaggtgtataattaatgacttaattaatgagtcccttctcacttcaaattccgttacgatgcacgaagcatttagctagtttgttgacaaggaagctaggggttgttaacccactcacaaaacaaaaatttatcaaaacatcctcctacctacactggtggagaaaccatctttactcggtcgcccaaaatccataatagtcccggttcgaataggaaccgggactaaagatcatttttagtcccggttcaaaaaaagttattggaccgagttagaccccaattcttttttagtcccggttggtataaacaa

SEQ ID NO: 69236 - DNA, 1305 bp, Oryza sativa
tagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggcacacgacagcggaacagctagctcatggcattcggtccaagccaagtgcacctcatatgtacgcgtgacaaagagggtagcatatatgtctggctcaaacctcactagcaacgcccgagatacgaactcttttgcttgccctgttagaactcctattctattgcatatcaacatacttttgtttgccggttcattctatttatcctcgtcgacatcacatatttacatccttcagaaatgggttaaaggacggtgatatgaatcaatgaccaggtcgtcatagagctaggttagttggcatggagctcgagaagaacggcaggctgtttggttgatagtcgaattttaccatgtcaaatcttaggtgtagcgtaatttcttatacagtgtttgattgtgtgttacacttggagttaagtcacactttattagtatgttagctcacacattatatatactcttattttcaagacaaagtttatcacaattgtgactaaccgatagtgataaagttaacctccatccaaacagtctcagctagttaaatgaggaaatgaacatagatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctg

SEQ ID NO: 69237 - DNA, 887 bp, Oryza sativa
gcgacgtggggaagtcaatgccgttgtgcgggaagtttgcccgcggcacggcggcgccggtcaggtagttgttgttgccgacatcggccgtggagtcgccgaacacgtatatcgccggcaccttcgccgccgccgccgcggtgatacagatggccacagcaacaagcgcaatcggcggtagcatctgtccagccatgccggactgcgaggtgcagtccgctggctctgggtgggggctgaacggcaaacctatcccttgtttgcttttgggaaagggaggggccgcgaccggagcggcaatggcgcactttaaagggcgacgatggcgagctgcgtacggccaacgccttttattgagaccggcaaggcgtggcacagcacttagaccaagtagtagtacaaagttctttacttggcttagctttggtaaagagagatgtgaatgtgacctggtcacctggctatcgcgcaaaacgttgctcctcctcctgggttggtcatgggggtctcctggtcgaccaggagacaggctactactctcgtactcctacacgggaagagtaactggatatacagcgaagaaagtcgatcgatcaaggtatcctactatcctggctcctacatgtacttgtgacaaaaccaagaagatccctcagtctacttgtccagcaaaccccgtcaaatttactcgccacgatctcatgctccctggtggtcctacaggcgaattatatcggcatgatgttctaagtgcctttggatactctgtctctcaagagtaattactgctacttttcacagaaaatcgatccccgggaggccgggactgagtgggggtaacttagcttgatcagaaccgattacttggatcaaccccgttgtccata

SEQ ID NO: 69238 - DNA, 532 bp, Oryza sativa
agttatagcatcaataattattgtgagaggtgtgagactaatcacgaaaaacattgctcaacccgcccatgaccgcgggcacggctattcaaatagttttactctggccagaggtgtaccactatacccacaagacacagagcctcaaaacatgttaccatgcccttagtaccaccacgatacctcgaaacgggattgtgacagtacccctcgcacaacacaatccaccacagaggcatggactccccagcgacccccacggacttctcaccacttcacagtctggtgccccgcaatgagccatactatacaaaaggtaaagctgttgcccacgctggcttgtggttggcacgattaatgtctcacaacagtagctcgtgaaccgatccttaattgtcatgatcacgaccttcaaaaccatgtgctcacaacccaccattatcaagttttaattatcaattaattatcataacatgattaaccatcatgagctaccatttaatataatcataaataataatgtagtatgatt

SEQ ID NO: 69239 - DNA, 709 bp, Oryza sativa
attcctgcagcccgacgctactggcgcgagggtgtaccgcgagacggcgagatggcgaaacgcggcgaagtggagctcgacgcggtgcaggacaggggcaaacgacggcgacgtaaggtgcttgacaacgtttcttgatgtccagcggctacccggcttccccatggcgacggcggcagcacggctcttcctccactccctccaacctccagctccggccggggagcctcacaatggtgatctctagcggtggtgagagggtgatcgcaaggtgttcgatgaaatgcatacgagaagaaggctgagagggatgaggattttgttgagggcttcgcttaggatgcaagcaaactatggggataagatcaccagcacatgcctaggcgagctggagtactaatggtgatcggataagagcaatgaggtggatgacgcggataaggtttgatctcctcctccattaaggttatgtggctccatcatcgtacctaaagcctaaagtctgtgcgttctaactctagctgtggcaggaggctccgttttattcattgggcgcgaatgggggcgacggaacgcgcgcacatgggagctgtggcggagcggcggcttgctggggcggttttcccgtcctaaggtagttggctagggctagggatgacgcggattggcgttctggccgttatccatcggtggcgaggtgatgggtgat

SEQ ID NO: 69240 - DNA, 2805 bp, Oryza sativa
ttcctgcaccccctcaaaatattttctaaaagtgattctcattccttatttttcacttctggtgtttttcggacctgttcgaaagtgattttcggaatttccgaaaatggttgtgagccgaaattcggtactggtcattttcggacttgtctaaaagtgtttttttgggaatttccgaaaatgattgcgctcaaagttttggtactggtcattttcaaacttgtcataaagtgattttaaaatcattgttgatatttcatcgatattactagaaatataattcctagcaattgcaccgaaatattcttggtatatttatggttacatatgtgatccgcaagcgcacggatataccgttgtagcattttacccgggagtaatccaaggtatcatattaatttaatcccaaggaaagatatgataagaaagtactatgctaataattcatatattacttctatagagcaaagtctatgcaggggttaattaatgcaaagggtaggacaaggttgatacacaaaagaaagaaccaagatacttttcactaaaatataatctaggcaaagtggagaaagaataagaaaagaatcattcatataattcttgtatatagtttatttagtttacgcttactagtatacaatcatgcaaccaatacccctagctatgcccttctagtgtttctagagaccacccccgattgccgagttccttacaacaacccgtcatggccatccgaccggtaatgaatatgaccataccgggaaagtgtcttaggattatatattaacatggaggaatgctcgtactatgctgtcaccatcagcagcccacctctactgacctgcaacatataaccccaattaatggtatcgaataatctaagcaccacacttacattattagattatactcgacatctctgtagatgacatagatcaatcatttgcatgaacattaaactcgcaccaatgcatatatctagtaagctagctacacaattatatcgagacaagtacaaactaaagtcggtacttgagaaatgtgaataaagtaaaagaccgaaattatataaagtagaatatttcattatactataagtctcacaaaagaaggaagagctactagagccatacccgaaatctcctaaagactcgaggactaagaaaactattatgtattctattcctactccactcgcactagaacaataaactaaacttgagagagcttcttgatcttcttcttgatcttcttcttgaatgagcacccctttatattgcctctcaatgacggttatggcagttggaaatgctggaaacaccctccaacaatgacagtgcatctggagcgtgcacgtggaagaccaggatgaacctgggctggcccatccggcctccacttttggcaggtgcgtcttttgttgggctttattctccgtgatgtggtggttgggcctatttgatgttattttattggatatgtaagcccatccacccatgagtctacctctcgacgggcggtgattgattgttcagctatttttaaacaaaatatgtagagttctcagcaaacaaataaaattccaagtacaagtggagatagattattcttaaacaaaatatgcatgcaagcatagctagttctccttaattccggttatattgtcggccgaaattggtctataacaaccgtcaacaatcactgtgcatcgaaattttggatttgattattttcggacttgtcctaaagtgatttccggacttaatttttagaatttcagaaaataactctgcatcaaaaaaattgaaatgactctgcatcaaagtttttgatctggtcattttcagacttgtcctagagtgatttttttggatttctccgaaagtgatttttggatttttctgaaaaaatgtgtctttgctctagaaagcagttctaaaactactacagccatctcaaaatataggatcttttagtcacacactggtgttaagaaagtaagtataattaagtgggaaaagattagtagttgagaagaggagttaggtgaagaattcgaatagtggaaaattgtgattgattacgaagagaatgtaggtgaaaaaactattatattctaggataaagttttaatgttaaaatttgctatatttcccaaaaagcattgcaccttatttctttcagaatgcttttgatatttccatttgtataacatctctaaacatattagttatactagaaaaacgtcccgcgcgttgccgcgggatcgcatgagattagtgaggacactaaagcaatgggatatttatatatttatttcatggataaattattttttaggaaaaatgtgttcaatctaaatgaccatttgagggcttttaaagtaatcgacaaaatgttttttttctctttatatgatcttttttaataactaacgcctatctttttggcactaaatattcctttctctatattttttaggagttttaaagaacccaacattgacatattatttccttttatttgcatagaattgacattatacatgtgaatcatccaaataatcagcctcacacattcttgtgttcgtaatttacatgtttaatgtttttcgcccgagatgtgtttctacatcttatcacccagtttcaaacaaatagtatgtgttaaattcagacctctactctacaaaataagtttttcaagttctgtctcgatacctcgatcaccttttccttgtcaatactaatgcgatttctttacttaatttcctttcataagttcactacctaaatatataag

SEQ ID NO: 69241 - DNA, 2355 bp, Oryza sativa
aaatatatttagttttggactcgtttgttcctctcaccatcgaaaacataatagaatacacatattacaaactctatacgttatacatgcaatcatttcaaatctcaatggttatatgaccaacaatttattatattatttaaaaggaagagaagggctctttacaaaatgcaaacgccggccaacatgcattgtggtatttatatctcactgacaaatggcccaaactacaaaccaactgaattttgctttcaacataacagcttgcctcttgtatcactgatgattggtccaacctatgatggaccccttgtacaggctatggagccatgcaaaagccaaagagtttgcatctatgaagagggccaagcaaacggtaaagtaaagcatgtactactactaaccatgaacagtgcaacagtagaagtagctgtgtggatagctatggcagcttaggccgtacctctctaggaatatagatatactccctccatcccataatataagggattctagggtctgtccagattcgttgtactaggatgtgtcacatccacccaaattctcttatattatgggatggagggagtaggtagatatgtgaatgagctcaaattagttatttgttatttttgaaagcttttaaatttgcatggaatcaaactgtgaagcaaataagataaaaacaatgctttagcaatgaagcaatcgtcaaatgtagtatagataaaatatgtacctggaattaaaaacataccccacacagtgtcgggtgtattgtaaaacttacaaaatttttagaacttattctcaatgagtaaaaattctccaagcctgtgcttgtctagattaaaatacaaaaccttctttatttatttcctctcaccacggccttggcccaaatatatttcctgaaaccaaactctactagtcagtgattgtcttcgatctcttgcctggataccatgcatagaatgaactctcatctttccctttttgtctgttaagtgattattattattattattattattattattattattattattattattattattattattattattattattattattattattatcaactttcctttatttgagatttaaaacaacaaaactaggacttctgaagaaagaaatagaagataaaaagttgaacttcctaattgtgatattcttagtaaagaaagtgaaacctgttgaaacgcattttttttatataatctcagtatcaaactgaataatgtattagaatttcacatgcaaaaatcaaaactgaaatcaacagaaaaattaattgtttcatggttttaagtatttatttaaggactggactgaaacccaacgaaatggaagctttgcagaattggagcatgaaaatataaaaggaaaagaaatgctggtataacttgatcatcaaggaatgagtgatgaaccttatcgaagcaaacaacttaattagttaattccagaacttcatgatgaaaaaagtgaaactgttattttccatccatgattaaaatttgtatgatgttgggttatatcttttctgatttcactcacacatcacgcattgacaatatcgttgtattcttcactgataatttaccatataaaatctttgtacatgtacagatagagtaaattatcttttttttgcatgataattatggtgattaattgtgtacaaaataatatatttcaactcattctggtgttaaattatacataaattaatatatttataattacttttaactataggcaaggttgtaaatttttggagcatggggcatgtgacctgtgagggcatgtgcctactcttttcgtgttttagttttattcactatgctccatgctctgctgttttttctttaaagttctttctaatccatttataatttgtcacatatactggataaattgcttgcgcatctaattcttttatcttctgtttttttagatagcatagaccagagtaccatggcacttctagcacggtgtgactaagtagttccagatcttgatggtacaacttggcttctttttgcttgggacaaagatcatgccaccgtagctgcattcacactgtgttgcccccttcatcacctactagcaagtggctcttcttcaagacttcatagtgatggcgatgttcgtccctagcatattcgcctgccttgttgcgctatcggctcaaagctagccaccagagagttgtcagcgatcgctccatgagtgaggaggagattactggccctaatgttcatcgccaccgtcattttgtttgtgtcggtggtactcgtaaggttcttctactactatcttattgagttgaggg

SEQ ID NO: 69242 - DNA, 15705 bp, Oryza sativa
taactccaatggataggggaatgcgaaccaaataagcatggcaaggaaatgagcgacatgcttatgtgatgatcacgtttcattgaacttgttgaattgtggtcagcagtagttgttggaaaagacacaagatcaacatctagcgggtatgatttgatgtaccctgaacgcatggaataatgtgttttcatatactaggtcataactccttcattaaccatccattggattgcttcaaggctgaggccggttgccatggtttggtggctattttgactagcagaagtttgatatccatttccctagccagtgccatttgccaatttggtgcgaagactagctagctcatcttctttttgctgtaatgcagctgtgccctgagccaaccattccgggtgacagagtttaaggtcaacacgcctaataggaagcaaaccctgacgaatagataatcaaaacaatatgactaagccaagcttgagatggtgtgctcgattgatttgcaagggaccatctcaaaccaatggataatcaaaccatccttgcaaatctttgcataaaaccaatggatgttggcatctttgcataaaaatttaaaggtttcttcaagaccaaaacgcttgggggttctaaacattatgttcatcatcatgggtttccgagaaccatgactgtaaaatggaccaaggggcttttcgctttaccaccaaagataccaatcaaataaactccctccaacttataacatgatgaataggctaacaccacttcatataagaagggccaatagggtttgtgctagtataatgaacatataacaggttgtgctaaagcatatcgacaccccatagctatctaagatgccatcaccaatgccctaggccaaatacgtggccctcccttgatgacgacaaaactataaagccatagtgctagaaaagtcattttgtagataagtgaagattcaatatcattaggaagaggtggacctcccagacggttatgaaagtagtcacaccactcttggagcaacacctcaccccctacttgtaactcctcccataacttcagaagccatgataaacacttcggttttgggtacaacagtaaaaggggatccagttcatgatgtgtaggaataaattcctcataaatttttttgtctaatggcaaacccgcaatccgatgcatatctaagagtgttgcagtacgctcaccactctcgaacaagaaagtgttcgcgcctgggttccatctcttcaaaaaggatttcagcaaagaaatggagtagcgtcctaaagagttgaaaatagctccatagatacaatcagtaccttccccatccccttttagatttaaagagtgtttggctagaattgcagcacccactttgcataccccgaaggaattaggacatattcgatatcatagttttcccagccaaggccttctgatatcatccgattgcctagaggaaattctctcttagattgggatgtgggtgctagagggtagaaacggcggtctgaaattgttgacacctattttcatccacaagcgatattatccttctcaccttttcttaactcatattctatgactatgggattggcctcaatataagagagaataatgaccatttttacccatagggtaaaattgagagtttacacaatgtcatgttgcatcaaataaagtcggatgataaaaatgaaagctatttctattttccatcaatgagaaaaaaaatagtggatcataccaatggaatcagttgatgatccggtgggataaaatggatattttgggcatgctcacttggatgcctaaatcaatcttaccaaattttggcacattttgacattaccaaattttgatagtgtttgctttgtttgtttttatgcctttaccaaattatgatacagttttaagggaggaagcttctagaaatactaaaatttggtaaggtagcaatggttgaagtgtgtttagtttgctacttacagaaatttggtaatgctaaaattttgtaaggttgaaagtgacaactaattgaacaggccctttctttctctaacggttgactagtggcaatggcatataagggcataaaatgagttattctatggcatattatagaactgagttttgttagtggcatattatagatttcttgctttgtcgatgatatataacagattatctagtttatttcccactccataggatgctcactttgaacctttttgtgtctaatctccctttctttttgcattcttctctcgtgtttcgccccataggaagaaaggagaaatgataatttttacccaagggccttttcaagttttcacgcggaacgcttttgacattttaggtttccatttgtataacatctctagaaatattagataggttaatgagcacaatttatttatttatttatttttgcaatttttgattgcatgaaatcgaatggtgaacctaataagttggatgtataaaatacttaccagaaaaataaacaaaaggcatcccacattgtttcacggtaggcatgaaacttataaaagtttttatttcttaccaccctcaactcttgcccttcgtcgaattgcatccatcaaccacaaaatcgggtatattgcctcccccaagtgttaaaaccagtgcaaaacgactcacttggtggtttttgacaatggttttgttgacgtggcagcttagttattgaaaaaataaaaaaaatatgtgacggcccacatgtaagttgcatttctattattcttcctccaccaccgaggaatcttcctcaagccaccgccaatgtctcctcccatgacgagctcaagcaccctgacactaccgctgagtagcagccatcactgtcggcagagccgaccatagaggaggcatcacggttgatgagcccctccccccgcgctcgccgtggcaggcgaaccactaggttgccacgtgagcaaaaccactgtcaaaaactaccaagggagttattttgcactggttttaacacctgagggagacaatatacccggttttgcgattgagggatgcgatttgacgaatgacaagaattgagggaggtaaaatagacttacttcaattgaaataaaattgaaaaccttctttactctcatcatgggctcggcccatctgcttaatttggcccacaactctagcgactgaaaccagcttgctcaaatcctcctccttatctggctgccatcagggacccattagtcagtgcttgtcttcctcgacaccagtgaactctcctctgtccttttcgacgattaaggaattactatcatataatataaaacttttttcccagatttgaactttataaaacagcaaaactgaactttatataccatgtattctttgagtgccatttatctaaatttctttggagagctatacaattctcttttggactttatcctccatatagtatatctcatatgtttggaaattggcttgtggttgttagtaaaaaaataaaaaaaacttattctttttggagcttccattgtatgttgggctctttagtttagtagaaataatatggtttttgataaaacaacatcaaaatcctatttgcagatgcttttcagggcaacgtattggcttcggggatgggctcaattacaaaggcatgatgaaaatatcaagctaataaatgatgaatgttgtaaacttgagacgacaattgtgcatttatttgccaactttgggtggaggttctataatagaattcactaattaggggatctttttcttctgttggtatctattagtttgtgtttgcttagctttctttctgctatcgtgaaatttgtgtgaatttttttcatgtgagttctataataatttttttttgaaaaggaaggcaagaaatttgccttatatattgatagagaagtagagtccatagatacaagaaaatgggagttagggtcatcccagaccaagggagtaaaagggattactcacataacgagtagagctctgttaggcactttgcccccgctattacccacatgtgtgcttcctctcttatttttgccatgatggaggccggagtgtttgcaaggttcctgaagatccttgagttcctctccttccataattcccatgcaacaagtataattatcgacttgagagctttctttggcatgttttgtgctgaggtgatttgaatccaccaatcttgtactgtttcaacattggcccattctgatggttggatatgaaggagtgaccaatcacgtacagcgtcccatattcttttggagaggcggcagtgggctaagaggtggactgctgtttccggctcggcgcgacaaagcgggcatatgacttggttttgccagtttcttgcttgcaatctatctgctgtccaaactctgttttggaagattagccacgagaaaaatttgcattttagcagtgctcatgcgtcccagacgattttcttaaggagtgttgggatagaaccttcaaactgtagccaataggctgatttggtcgtgtagtggccatgttctgtgagccgccatcggatcgtatcttcggtgtccggttggagttgcagtatatgcagggctgcccaaaggttgataaattctcgaaagtgctgcgtagttgtgaagagctgtggttgcaggtctgcgatccacttgttcccggtgagagcatcttttattgtcctattttttctcctggaaatctgaaaaatcagcggcgcttggcttcggggtgattgattattgagccagttagagctccagaacttagccttagcgcgccatttccaatagttatttccgtcgccacattgaagagctttctatcagtctcatcgcagggcaccggcagtcctagccagggtctctcaggctcttgccactcaaaccaaagccatctgacacgaagggcgtgttggtatttcttaacgatattactagaaatataatttttcagcaatggcgcagaaatacttctggtatatgatggttacagagttcatccgcaagcgcacggatataccattgtagcattttacccgagagtattccaagggtatcgtatttattttatcccgtgcgaagatcttgtagagagaactcaactaatattttatatattacttgtgataatcatattctaagcagagattaagataatccaagggtagagtgacacacaagcattaactattcatccccataataaataatctaagctaggtggaaagaaaagagaaagagaatctattcctatacttctaatatacatagtatacatatattctagttaactggtatgctagctaatatcctttatccgatgtcctcctggtacttcaagaagccacccctgactgcagagttccttacgatagcccgtcatgaccatccaaccggggctaaatacggaggaataccctccccaggaaattaacttaggattatatataggcgcgaaggaatatccgtactgagctgtcaccatcagcgacccacctctcatccgcaatatataaccccaaataatgatatctcgtaatctagacaccacgtctaaactaccagatactactctaatatcatcgtcatgacatagagtaattgcataagcaaacactatacctgcaccaaagcatctcatagataagctagccgtatattcagtataaccagaacataatataaagtaggtactcatgtactcggaaagtatttcaataccataaatgtatttagaagtgtattcgaacaaaattacaaagcttacaaaagaggaaaggaaagctactaaagccatacccgaactcttccgaagacttccggactcctgattcctattctaattctattccactagctagatactactaaactaaacttgtgaggaatgagagagctcttgcttgaggtgtgtgagtgaagtgagaaggtgaggggtttatatagcctcccaatgactgttgtgacggttggaatggttggaaataccctccaaccgtcattgggagctaatccacaccgtccagaagaaaccctgcttccagcggcgatgaggggggtccggccgaaccaccaggtttggctgaacctggggctggcccaaccagcccatggtttggctggtggcctcctctgtcgttcttctctgcagacttgtgaattgtggcccagtttgtcgtgtcaattctgagttcttggcccattcatacacaagtctggttctcgacatcgtccgattgatttatcgtgggtgttgatgtcgattctccttcactttgtgatcattctctgcaaaaggttagtagacctaatactagtggaatattattactctaacatatttatgcattgcaagcatcactagttctctcctgttttactgatattgacggtcgaaactgatcgatatcgaccgtcaacaaaaccccccaagcttgaacctttgctcgtcccgagtgaaggacgaaaggaaacaaatacttggttgttgatcaggagttgctactatgctgcatatctcaaagatacaggtgcaaggtatatgtactctctctcagattaaataatctttggcacggtggcttacccttacccctgattcccacgagacactgcttctcattgccttgggctgttgaaagacagaacaacagttagagcactagtcacccaatctttattcaactcttattccggaagttttcaaatgattttgcaaagaaaaccaagttcctcaaatgattcactcagtctctccaagtgtatcattttgaattcctcaccaaatgatgccttttgatatgtggagcttggtagggatcaatcatggcatacttgcattcacatttattactaagtcaaaaacttagactaaagcagataactaaacatactcaagattaagatcgtgcataatgtgtgtgtggtatatagtggaaatggtatatgaggaaaaatgaaagaaaaatgcttctcctttgtgcttactttcttctcccaaaatccttcttttattgattaggagaggacatgattacatttttttttcaatcatgctcatgcttgatgaagcataactttttttttcataaccatgcctttccgtcctttcttcttttttttttcaaaatgattttttttctttttaggagaagaaagcacatgaaagcatggagagtttattttggtggaaatatggatatggaatggaatattgcttagctcccagtgtaggagtttagaatgtgcatatatgtgggtgtatgatcttgatcatagagtatgagaagtatctacacaagtcacaagagtttgacaaagttcaatggaatggcaagtaaccaaaatgtatatggtttaatcatgatagcacatttttggctctggtaggaatttatatcaaatgaggaactttcaatttatcattttgaaaaacaaaacatccggaattcaagtcaaactagtaccaagatcatagctactcatatttactatctcatatctcgcaacaacctagacttagatcagcaagtgcagcccatttacctcaggttcccggataattgttggctacttttattcaatcttcgagagagtatttaccaagaacccatatatcagagatataaaacagagcaactattcatcatttcaacagagagaactagcttgtcttaccaagcatgactcaaacctatcctatcttttttggtattttctattttgcaaatttttatgttgttttcaagttttataggatgcaattggaaggcaattatgcaattggaaagggaaatatgcaatgtgatacaagttacctcagtggggggagcgaagtctccccccaagtttggctttcgctcatggtccttggtaaggattaaacccctgaaagcgaaagtacgcctgaaggtcatcatgctgttgctgcatcatgttgttgatgttggcgaactgagcatcagcagattgttgtcattcttgcgtttgagctatgtgttccgcgaggtcatactggatctcccccgtctgcgcatcaagggtgtccattctcctagtgatttcacccaagtcccaacgggaggaacttgagcgccattcacttggagatggaggcacaccacttgatctggaaggttgattgtcccccagtggatgtcatgaggcgcatgccaccggtcctcactggcgcttgcccaggttgagactccgatactatggcgtggagcttgggtccatccaggtgcatccccagatagtgcccaacctgcctcatatatctgcacgggtgtcgaggatgatgaacttccttgtttgttccttgtcatgttgtgcgtctccctgtatgttccacctgcacaagattcttctatggtctgcaggggaatggttagttcatggcagttgtacaaatgataccctgcatttggcaacgggatttcatttgtacaactggggaaaaagtatatcaaagatccatctgcttcatgtttcaaatatgcccttgtactagataagcctcatcaatacgcggacgagcggctgagataaaagcaatctggtcgctaatgacccctagccctttcgctatccgagtaatcagagaagtgcactcaataggagcagagaactttatactttctaaccattgccttatcatacatttcacaggagaaattttgatctttctaaccatggcaaacatgataattaattcatctcccctaatgagtctcagatcacttctaggaaacaaagtcatagcaatctatttgtgcatgagcctaagtgtaggattatggatatcattcgttctaggtttcttgcaaattggagcaccagaaatatcttcccaaaacctatttttcttgaacccagaaattcctttctggagatcaattttacaggaatcgtgaaaaccaagaagtgtactcaagcctttccatgtgagcgtgaactccttatggaaaaaacgaaaagaaataccatcttctatttctttcaaagtgcacagaaattgcaaagtaagcaaacgagaaccaggctcatctaccacagcaaatctctgccaaccaacagctttccaaatagaacaaaattcaacatccatacctatcattttcagcaactccggtgagtattctcgcgtgtgagcatactcctagtcgctcagcatgtagtaggcttgtctctcccgatcactgacaaggtcgaggtcagcgtcgctcaggagttgtcacggagtgtcggcgtcttccatcgagacatcggttgatgaacgaatactagactcgtcatgacaacttgatggagagctcgaccccttgaacagacgagacagtcgccttctcatactgcacaatggaccaagaacaggctaactaggcgggggttagaaatgacaagagtttcacccgccgattagtttcaccaaaacaacttatatgtatgcaactaaagatttgaatttgaggaaaactatcaaagcttaaatgaacttgagagcaaactttagagacggaatgaaaaatgtgttgaaatggggtggaattccctttctcggctggctggcttttataggatacccacaacggtcaagaatgacatgtggggcccactagccgttgcctcaaaagaggaggcagccgaccgttggcctggccggttcggtcgaaccaaggtgttcggccgaactcctggtgagcccaactggccccactttcggctgttggattccaacggtcagtgtggtcgtggcacagtaaatttttgttgaaaattttattttggcttgctctgaaaaattcatttgaagaatttcctcaaaattcaaaaaattcctaaatgcaaatttgaaattcaaatatgtgttgatgcaaaaattcaaattgttgaaagcaaatatgcggataaataccaatttacatgttggcgaaggtcacgtcatttaaagtccgacgtgcaagaccgtacctccttccgtttcagttcgcggattttccacccgtctccggaggtgatggagcgggcatctttggcttttccttccacaccttctttgatttcgatgcggtagacagcttcctctaagccggctgctctaacttcttggccagtacaggtgattttaccggcgtcttccaataacggttcttgggcattgttgtttccttctccagaaagttctgcatgaactttaccaggctatccgttttgggtggctccatttcgaccacttgaatattctgcgggttcggcccgtacttgattctgaccatggagcattgttccgtcctcggttggaactcaaacttttcctccttcccattgatatggaaacggatgctccccattcccacgtcaatgttggctcctgcggtgctaaggaacggacgctctaggatgagcggcgtatctttccccgtgtccatatctagcaccacaatatcaaccgggatgaagaaatcccgtatcttgactggcacctcctccgctatccccgtcgggtaacggactgacgagtcagccagttggaggcgcattggtgttggtgccaacaccgtgaagttgagcttgtcgaagacgtcttttggcatgacgctgacgctggctccaaggtcgcacaaggcctggtgaattgttgtgccccgattgaccaggtgatcgtgggacaccccggatctttcttcttctccgggagcttgtggagtatcaggttgctgcaatgttccgtcagcttgaccacctccattgttgggagcggtttcttgtttttgagtatgtccttaagataacaggagtatgttggtacttgcatagcgtccaacaacggcacgttcatgtgaattttctggatcacttcaacaaagcgagcgaactgctcgtccactgacggtttcctactccgctgagggaatggcaacaaccgtgtgtcgcagtaccccccgtggcacggtcttctctggctaagtctccttgtcagccgaatcagtagatggcgtttccttgggcatcccattagttcctgtagggttaggatacggcggatcacgagtggaattacctcccctcgtcgtgatcgccttaaaattttcaatggaggagtcgggttgccccggaatcctcccagattcatttgcagggactaaagatgccaacggagctaactgggtttctatcattttattaaagctcagctggttttgaaatgcggaagcgaagccatctagcttgacatgacatttatgttctctaagatcttatcattggcagcaagcttttttgcttagcgcatcagtggttttagcttgcgcaaaaacaagatccttcaaggagggttggttagagaaattaccgttattattacctcattgataatatgggcgtggttggttccacccctgacctccttgtggacgatacccgttgttgttgttgcccatgtacattgcctcctcacgggtttccgggcggtcgttcccagaatgacccgtgccgccgcagacttcacacgtgatgtgtgagtccaaggccttgacggtgccttgtggccgtttctcatggtcgtccaagcgtttcatgaggaggtccagcttggcagcaagtaactccgtctccttgacggtgtgcatgcctcgctgacgggtctggagtcattcctcgcttcaacccatattggagaccatcttctctatgagttcaatggctccttgaactgttatagagaagaaggctcctccagctgccgcgtctaggtgatcgcgggacatcggggtgagcccgttgtaaaagttctgcaggatcagccagtcgtccatcccatgatgaggacaggaggccacgtactcctacagtcgttcccatgcttccggaatggactcgtcccttgtctgctggaaactggaaattcgtccacgaagggcattggttttgcccatcaggaagaacttcgagaggaatgccgtagagcatttaacccaggtgttgatagcagcacggttggcatagaaccactgcttcgctctcccgaggagagagaacgttaacagcagcagcctgacggcgtcgggactgatgcccttgatggtgtacgtactgcatatcttcaggaattgctgcagatgagcgttggcatcctcattaggcttgccacagaacgggctagcctgcgccatcatgatgaggctagacttcaaatcgaaatccacatctcctatgttaacttgcggcccgacggccacattatcaacagagggagcagcgaactcgcgaaaagtcttgctgactataatcttgaaggttggtggcgctggtacggctggtttctctgtcggtaaagttttctgcggagcagcgacccgcggcctgacgctccggaagaaagcttctagattttctttgaagttttccggcaggttgaaaccagtcatgcactaccttgttttcacaataaaaactgaaaataaccaaggttagcctgcaaaggaaaatgattatacagaggtaaatataatgcgttagtttaagtaatctctatcataaatcttcccaggcaacggcgccagaaatgcttgttggtatttcttaacgacattagtagaaatataattcccagcaatggcgcagaaatacttctggtatattatggttacagagttcatccgcaagcgcacggatataccattgtagcatttcactcgagagtattccaagggtatcgtatttattttatcccgtgggaagatcttgtagagagaactcaactaataatttatatattacttgtgataatcatattctaagcaggagttaagataatccaaggatagagtgacacacaagcattaactattcatcctcataataaataatctaagctaggtggaaagaaaaaagaaagagaatctattcctatacttctaatatacatagtatacatacattctagttaactggtatactagctaataccctctatccgataccctcctggtacatcgagaagccacccttaactgccgagttccttacgataacccatcatgaccatccaaccggggctaaatacggaggaataccctccccaggaaattaacttaggattatatataggcgccgagaaatacccgtaccgagctgtcaccatcaacggcccacctctcatccgcaatatataaccccaaataatgatatcccataatctagacaccacgtctaaactaccagatactactctaatatcatcgtcatgacatagactaattgcataagcaaacactatacccgcaccaaagcatctcccaaataagctagccgtatattcagtataaccagaacataatgtaaagtaggtactcatatactcggaaagtatttcaataccataaatgtatttagaagcgtattcgaataaaattacaaagcttacaaaagaggaaaggaaagctactaaagccatacccgaactcttccgaagacttccggactcctgattcctattctaattctattccaccagctagatactactaaactaaacttgagaggaatgagagagctcttacttgaggtgtgtgagtgaagtgagaaggtgaggggtttatatagcctcccaatgactgttgtgacggttagaatggtcggaaataccctccaaccgtcattgggagctaatccacaccgtccagaagaaaccctgcttccagcagcgatgaggggggttcggccgaacctggtggttcggctgaacctggggctggcccaaccagcccatggtttggctggtggcctcctctgtcgttcttctctgcagacttgtgaattttggcccagtttgtcgtgtcaattctgagttcttggcccattcatacacaagtctggttctcgacatcgtccgattgatttatcgtgggtgttgatgtcgattctccttcactttatgattattctctgcaaaaggttagtagacctaatactagtggaatattattactctaacatatttatgcattgcaagcatcattagttctctcctgttttagtgatattgatggtcgaaactgatcgatatcgaccgtcaacagggcgcgcgcgaagcgatgcaggtcgagcacgcctagtcctcccagttctttcgggcagcagacccgatcccaattcactttacatttacctccggacaagttgtcgccaccggcccgaaggaatttcctcctgattttgtcgagcgcttccaaagttcctttaggaagtctaattgaggtgaggtggtagatgggttgtgaggttaggactgtcttaacaagggtggatctgccagcttggtttaggagcttcccttgccagtgaggaagccttgcccccgccttgtccacaaagggctggaagtggactttacgtagcttggagagcgccaatggaaggcctaaatatgtcattgggaaggcagctttctttgccagaagatgtagaaggatgtcgtcaaggtcaatgtcgttgcaacgtatgggggcaacttgacttttgtggaagtttatttttaggcccgtggcctcaccaaaggactcaagaatgtgtgccagcgctgagacgtcttgttgtgtcggggagaggaagatggcagcgtcgtccgcgtacaacgaggttctcattctcggcggtcgtccattgaggcgtaacgaggttctcattcttggcggtcgtccattgaggcgtgtgaggtgcccatcctcagtcgctctctccaggatgtgtagcgggtcgattgctaatatgaacaagaacggcgttctgtaataattggctatttgagtaaagaccgggctgtttcattacactattaaaaaaaaagaaacagtagatcgaaagtggaagttcctagctagtaagtcttcttagtttttttttaaaaaaactgaaacctatcgaaacggagttcttttccaaaatttcatcatcaaactgaaagatgttctacaatttcacatgcagatatcaaacggaaattttttccataatttcgatgttctatataatttcacacgcaaataccaaaacagagactttatagctcgagtgctgactgctgagccttcatgatgaaaagttaatttccagaacttagattgctgagccatatcgaaccagaaacttaatttccagaacttcatgatgaaaagtttaaaactgttcttttccaagctataatcaagattttcgtaaatataggttatcttttctaagttcacatgtcacacgcgtttgacagtgtcgtgttattcttcaccaaaatctaccatacaaaatctctgtacatgtaaaagtaaaacatagtatgatgtgcagagcataaataatatcacatcactctttttcaacttttttttaaaaaaaatccagatcaattaattcatctaagatagaagtcaaacacatacggagtataatctaggaccatattgcatatacttaactaacaatttgtacatgttacatctactaatctccattccatgtttgacttccaatcgaacagctaagcttattatgccatattatttcatttagccccttggaattcctccattttacaaatacatccctcaccaatctcatttctatacatatcatcatcgtttcctccaaactcagaagccca

SEQ ID NO: 69243 - DNA, 8882 bp, Oryza sativa
tcctcctcccatctcttcctctacctcctctcctctgtatccgccccatcccctcccctaccctattcttaggcggcggcttccggatgaaacacgccctcacacggatgccgggaggcggcggagccggcctcgcacaccggtggtgaggcaatgcgcgaggcacgaggcggggccgcggacgaggtggcaggcgctacctgtggcaagcaacggcgggcggcaccgcgccggatcttctctccttttttttataatttgtgattgagagatgtttaatttcttttttaaaattgtgattcattgcatagatctgagatgtataatcgatctgtgatgcatttgatttgggtgtaattttttttaagatttgtgatgtatttgatttgtgtgtaagtaacttaggatttgtatttgtgatgttaatgatttgggatgttaatttaatttggggatttgggtatatgtatgacactcgatttgagggtttggtgtttgatctggtatatacatcttactcgatatgggagaaaataaaaagaaaatggaccaactgggactgcccctatcctctctttactcccggttattttacccgagactaatgatagcgatctttagtcctggattcgtagtcctggttggaaaaccgggactacagagggttataaactgggagtaaagacggattctccaccagtgtcataaacactttttgctgaatattgtctagaggttgagaggggtcaaatatgagaatcctccacaaccggctgaagaatcacatgtgcaataatgtcccataattcaaggtactcagcaaagacacccaccgtgagaacatacaaaatggtcctttgttggctcttgttttgggtaccatggcaaacaattagggtgcaagatcagcaatgtgctgtctatgaagccatttatcagtccaaaacaaggtgctaccatcatcacccaccttagagaaaaccgcgatagtgaaaaaaaaataacgagcacaccggttgacctgaatagggaaagctttttttttttgcatccattaattccaccgcatccaaagctccaaggttttgaagttctgagaaccagcccggcaaaaactttagtccaagccacaagacaatgaccgcttttcgcgtccttccatcctctccaaaggaaacttcatcatatctcatcgattgccttaatggcccatgatggaatgtccatagccatacaaagataaaccacacaaagatgtgagcacaaattgaaccaaaattctccgattggcccgtgctagaagatccacttttcatcctagatgttgatccactaatttgtcaataataggctgaactttgttgacaaccgaatttggtaaattgtgaaccaggttagacattgggatcaaggcggattcgagaaagagatcgattcaaagaacagagtgtgcttcggctgagatggatcggacagaggacagccgatacagcgaatggacgtgatgcagccgattccgatgacgatggtatcaaaggtgtttctagagtcgtttgaagtgcttcataaggattgctacaatggagataaagctctcggatatgcagttgtatctattaattaggatatttcatgtaattttcttagagatatgtttgggcaaaagtctgccgcaaagacttatagtatcttagagtttgttagaggtaagtattgtgtccggcaaggacatattttgtaatctcgggtataaatagaacccgaacccatgtaatcaaacaacaatcgttcaatacaatctcggcgcatcgccaccttttttactttcatttatttcgacgaatgtgctttcgggttgagctgcatcgattccgatcttcaactagaggtaaaacttgttatggcggcttgtgttctcggggttaatgcttccatctttatgacactttaaccctgtttatgtaattcgtcgagttatcatatacacgacacaatctatgttagttgcactttataacttgtcatcggctagttcttattgttagaaagcaatcggtagagttatgttttgttattaatctagattgtatcttgtatctactatctcttgcaggttttcatcatctcgcctagatctcatacttgtatttatgcttaatgctgtatcggttaggttcgatctattaagtaatatctataattatggatatctagcttgttttatgatcattgagagaggtagcatcggggtttcagccgatcttacctgatttagcattatgtcttatatgcttaattgatatgctaaatctgccatttatattaagatcttgttacaataaagtatattatgcttatgtttgatatattctatctattttaatatcttaatatagagtggtatcggagtattagccggtacatgctagatctatctgatcagctatgctataagtgtttataatatttatgttaatgtatatttcaatctaagtgatttatactgtctcggcatggcgactgatctatcccaatcacttggtttaaatatacatcgacataaggattatatagcgttaatatctacagccgatcgaatagatttagtcttatcttgtttatttataactgccgatcgatttacatatgacatcggctcaagaataaatgatatgtcatcagcgactggccgatcggctatcgtttatggatttaaccgtggtttcttttgtctttccttcttgttgattgcaggatcaaatcaactggcacactcacgaatctaaaagcaagattttcgacctgcactgaagttaagcagatcttccaggccaatgtgtatttttcgtatcaacaaatttgtgcatttatcaatttcctcaaagagaggggcacaccgaggtatttacaggggagatcaagcagctcatgtgagagaaggtcctgagtaaccgtgatgtccatctcactgcactaaatagggaacacactgctcttctgtacattagttttgagccatggtgctttgccaaagagattgagtatgtccagcgttgtgccaatgtcacttgtggagggtcaaaggaaagagccacattatccgcatagagagatatccaatgttgcaaggctcacaaagatagaggctgcagcaaacccccgtcctcgtcctttgacaccatatagtttaggacacccatgacaagaataacaagcatcatggatcaaggatcaccttggtgcaacacatgccggtgtgaaaatacctcaccggggtaccattcaagagaacttgaatcgacaaagatgccaagagcctgctgagaatatcacaacaaataggcctaaaacccaacttgtgcaagaactcaaaatggaaacacatcttaccaagtttattaccatgaaacccgagaatgagagagcaatgatcagaatcgactgggatacactttgcaatatactattggggaagggttgctcctagttatatacatgatgctacgttaaaagtcagtacaactcccaacacgatgcaaaacaccatgcacgagagcctcaagcctaaatctgttctttttctctaaatatccgcattagatagagggggcaccccttgttgtgtaagtgtgttgcatggactatggtcatgtggatcattaattgcataaacatatcactactattacaaggtcacgtgaaaagctagcaccagcaggcatgctgttctcacgtgtgcttggtggcgccctagaggaggttgtgcagtggagttgcaggctacatcaagcagggcatggagatcaaaacaagtaaacagacttgatcaggagaattgatggatccatgcggtagaagagatggcaggagccatcttggttgcgtacggcatggacagatcaaatttacaaagagttttggacttggtgattggtgcaaggctgtgattcgacggagcggttcatggccacaagacaacaagcatggtgtagatatgtggtggtgatcaaggtgatgcagtgataggggtgaaagcagtcggaaacgatcaggaaaaaccctaaaccattaccacaaccatattatttttctgaaacagaatcgataacggtaagatggtaacggaaacaatatcggaaatatcagtaaatcgaaaacggaattattcaatcgaaaacatgtcggtatcgttcggaagtcgataattactgtcggaaacatcgaacaataacatcgcacatttagctagcaatctagaatgattataaatatttgacgataattataaatatatttgtattcgacgataattattccccaatttcataaagataaagcaacacaggcacatagcaagttctcttatacataacaagtccactagaaccataaccacatagccacagtaacactgttggaccggatggaactcatcatggtcatcattttcttcaacaactgtatcatcaccagctacaacatttgctgagccggccggcaagctcccgaacggcgtgctagaggcattactgccgtgaggtggtgggggcggccccaataggaggcgacgtcgtgaggaagcttcgccggctagcgccatcatcgctagggggcgggagggtggggaacggatgggagctgccactgtgttggcgccgtcgcgccgctgcgttggagctgccacactgctgcgccgctgcgttggtgcctccgcgccgccgcgccgatgcgtatgagtacgacggcgctggttggacttgggacaggtcgactgggggattgggcagccaggagcagccaagcagctctaggttagggatttagggtttttgttgggctgagaaaatgggccaaagaaaaataacttgggccagccggccagtgatgtttgtaaaaatggtaattaccgggataataccgtaaccacacaaaacagtcggtaaattaccaaaccttttccgatatcatttccgtattttttttaccgtttccgtttccgacatttaccgtttccgaagcatccgataggtcaaattcggtagcggtagcccggtcagccggtaattactgctaccgttttcaaccctagcagtgagtatacggctcgagacaaggtgtgtgaggtgcgcgtgtatgatggttttgcactataccggtagggtagttagaccgatggattggttaaactgcagagcttggacggttataccgagtacaatggacggtggtttgttgctgaaacttatgaacagatccataagaaggccaagaaggctctatggtttggatagttttcaagtgagaagggcgagtagactgacggcggcaggtaggtatagcaatttcccccacggggccgggtcccctgcgtggacgggggtaggttagattttcaacccgcaggtccattgggtcggggccccggtcatcccacgggtttgccttcgggggcccggtaaaggtgtccattagttattttccatacaatttatgtagaaagcccattaacattggcccaattattactgctatagtataaaaggaaaggtcaaaactctaaatcaactcctcccagtcgccgccaggcaccaacctctcactcaagcgcgagaggcgagagggtagcgacagcgcaacacgcctgccccgcccgagccgcacgccgtcggcctttcccgccgtccccacactgtgcgtcgtcggcctctcccgctgccctcacgctatcgccctatgtcgccgcccctgggcctcgtgtcatcatcctctgtcgctgtctgtacgccgcgcgctgtcgccctctaccaccgcccctgtgttgtcgtcttcttgtcgatcggtcaccaacgctcctctccgttgcgcgggccccggctaggtggcgggttccctgcggggttgggggcgggtcctgtgttgcacctgcatccttcttcagggccggggacgagtgaggaaatcggggctcggggtcggggccgttcttgtccaacccggacctgctccgctccgttgccaaacctagcggcaggtcggtcaggtcacatatggaattatctggcggagacatgatatatctgagactcgacaatgagttgagatatatggagttagaccaaaactgaagaaaagtcccgggcaacatcgggttgaatacattggtggtgtcaacgagactgtttggtagtacaagatatatccaggatctgcgtggtttacatgatggggatatgtggaatatgtgtcgctgaaaaggaagagcaatcactatggtggtaatttcttcaattgattcaaagcaacaatgaattttctcaaattatcaacgactcaaactactacagatgcaggaaagcatggatggatttgttagctcggtccataagattacaaggaagaaagggttattcatcagtctggtgagtttaatttatctattcggtaatgacatgggttatctagccatggattaaataaaatcaaatttacgatagaagatgaaggtgaacatggtcttcgaggagtctatgatgtgacatctaagaaggaattcaattttacttgtcaagacgattgtgatgatgggatagaagatggagcattgttgtagatggagtccagagaaataagttataggaatagcagagtttcttgaagggagtaggtctggtgcaggctcatcgggcagctcatcatgaagttgcggagggaagacaaccgaagtctggagggcaggtggatcggcacgatgactctaactacttctgggtgtcgtatattcgtcaaggtggagtttgttagaataggtatcgaataattgatgttagttaggcttcatcctaattggttcacaatttcatttagcttttgttgtgaaaaaagttttttcttgcacatctctgtggttaatttattgctcgaaatatgcattcatcttaggaaagaaagatacataacttcaagcaattagttagcgacaaattctccaaagcacaatgccatagggctcacaaattgtttgctggctatgtgaaatgggataattgtatgctgattgctacgtgacatactctccctgtttttctttttcagtttggttaattcaaaaataaactaacctacgtaatgtaaaataatatgaagggagtatataacaaacttgataataatttactagtgaaattgtatcagagataactagttataccttcgtcccaaaatatatcaattttttttagaaacacagtacaaacacaggcgctcacaacatgcgcacactcactcctatgaacacactatgagcacctccggaagactgagccggcatatcttgagattgacgaagtcaccaccctatgagcacctccgaaagactgagccggcatatcttgagaaccccctatgagcacctccggaagactgagccagcatatattgagcatatcttgagattgacgaagtcaccaccctatgaacacctccggaagactgagtcggcatatcttgagcaccccctatgagcacctccggaagactgagccggcatatattgagcatatcttgagattgacgaagtagactgagccagcatatattgagcatatcttgagattgacgaagtcaccaccctatgaacacctccggaagactgagtcggcatatcttgagcaccccctatgagcacctccgaaagactgagccggcatatattgagcatatcttgagattgacgaagtcaccaccctatgaacacctctggaagactgagccggcatatcttgagattgacgaagtcaccaccctatgaacacctccggaagagccggcatatcttgagcatatctagagattgacgaagtcaccaccctatgagcacctccggaagactgggccggcatatcttgagattgacgaagtcaccaccctatgaacacctccggaagactgagccggcatatcttgagcatatctagagattgacgaagtcaccaccctatgagcacctccggaagactgggccggcatatcttgagattgacgaagtcaccacagcgcctcgctgtcgacgggtacgtcgcctaccactgaaagaataattagccgtaaatgcgatcacccgtgtcaaatctaggatttgaacccgggtgggctggttccaccacaaggaacctaaccagttgagctatgctcacttcgccaaaatatatcaatttttgactatatatgtgaaacaatttagatgcatagctaaaaattattatattttaggatggaggtagtacaacaatactaaaattttcttaaattttcttgttgggttgacacctgtgcccaaatgaacaatttcaggccaaattccggcgagcgagattggtgaaacttcctacattcgtgggaaccagaaagaggttcaaagtcgacccaaattttatccaaaccatccaaatattcatagattttttattcagaagttttatactacaagtgcacagagactttatcactgatatatgagcctaacaaatcgtgatcacacggtgagttcgaaggtagaggatatcaatcccagtgtacagctgtaggggcaggaggacaacaactggacaagccattcggccgttgggggggatccccctgttgggcccgtgaaggcccagatccaacggccacgagcagccgacaaggggaaccccctcgcttaatccgggccctccacgtgtcacccgccccagtggaaacgctccttcttccccaaagaggaaagaaaaacacacacacacaccgcgaggaggtgaaaaagaacgaacaaaggcgagtagtgtgaaaccgtccccgaattcgagctcccgcttcctcccccactttttatccccacccccgga

SEQ ID NO: 69244 - DNA, 14977 bp, Oryza sativa
aaaatctgtcttgagtttcctgaggtatggtgtttaacatctcaaagtgcaccgtttcagtttctgcatcatgttcatcttatctgaatttcttatcatgttacttaaataacttttcaggtgccacagcagaatggggatgaatgtggtatatatgttctttactttatctactgttttcttcagaacaaagcactgggagaagatttcagccagctggtgtgtcagacatttccacccttaccctgttttccttttgcaccttacaaaagctatgctaatatgttttctctatgaattagtttgatgatccagaagaatgggagaacttccgcaagggtgttcattcattccgagagtatgttctttttctgtgtatatcctgtatgctattattaaattgtggtcttattgttttttcctttttgcttctacaggaacagagaaaatgaaattgcagaataggtgagcatggtggatggcaatatttcaccagctatatgtagttatcaggtatgtaatggctgttatgaaatcattgcctcttctattttgcttttgcctcttgtctttcttatcaagtttttctcttgtatatgtaacagaatacaacagcaaattacctgttcatcttcctggtggcacaacctgaagaagtttgaagactgtcaagaatttgtttgtcatacagttcatgccgtcaagaggaagatggctatttctcagatacaaagcagcatcagtgtcaacctagcgctgtcgagatctttcgttgatccaggctattgataagctgaaagccccttttttggatagggttccatcaacattcagcacctgttagccgtatagagtcacagatgattcattccttaaaaaaaaaagaatatttaaacgatttgatactatacttatgcattgtctagaaatgctgggtgggatttccaccacctttcagaatatttagctgggggttatatgatgtacatcaatatgtttgtatcagatcttaaagatggtgtattcccccttccagataatatattacagtttcgtatttgatgcattgaaatgctgtcagcgtcagtaatctgaaagttcaaagtagcaatatgttgtgatccatcttgacagtaaagcagaactcaaccaaggaggatcgtgtctgatgttgctgccttctcagagtaagcagaacttcagatgtgacacctttgttgctaacatgccacaccccttccgatttttatatctttgattttgtttttcttttccttttgtgctaaaacgatatggaaattgcttgttttgggtgatgtttattctttttgaaaacaaaattgcatgaaacgctcatcatgatacttgggagggaaaggcactcaagatactgagcgaattagggtgtgtttgaggagatggggattagggagatggggaagatacgcaaaacgaggtgagccattagcacatgattaattgagtattaattattttaaactttaaaaatggattaatatgattttttaaagcaactttcttataaaatttttttgcaaaaaacacaccgtttagtagttcgggaagcgtgcgcgcggaaaatgaaacaatctttctccctttctcctgcgcttgaacgcagccttagtggtgatagtaggcaaaaccattaaccctgcaaatactattatgctccctccagttccataatccgatgtgtcgacgtttgatgtcgagattccggtatttgtatagtatggggatcgttggtactaggatatatacgagactgaggtaaaagagacggagacagagatttttatacaggttcgggcccctgaattgtcaggtaataaccctacatcctgttggccgaagccggtcattgctcttattcattataatcacaccagtacaatatttggggtagcctatctaactgttgtcgacatggcggtctgaacgtctaactcgtagtcgacaacagggtagtcttctcctcgagttcgtgcccggcgagatcagaaacaacgctagatccctacggccggcctatgtaggtaccggatagggccgatccaggcatatctctgaagtcgatatccggcggcttgtcttggcgtatgtcggcttgtatgttgtagcttctgtggttccgtgtatgttgattgtggtaggtgtccattgaggtggtcgtctcccctctcctcttaggggggccttgtatttatacccataggtatccccttatccaagtagaactagggaaaccaatatggatacaatccgagtagtccttgtcatttccatatagaactctggttgtctttccttatccggaactcctcatatatccgcaggttgtttccgtataggacatggtatgtggtgggtcctgccgagatttagtcaactactattaggtatgtggtattcataaccctgacacgatgttttggattttttttaatctcttaaactatggctttctattataatatatagaataaataaaaaatatttacttatattataatatttttaaagactattatatatatatatatatatatatatatatcttgttgtattgtttttgaactaaatattttgttcttgttcaagcggaaaaaagcgggaattttttttagtccgtttgggaaaataaagtctatgttaggaaagatttttcattttttagtgaaatatctaggaagtggaagaagcactttagtggcttctgtggatgctttacttctgggatcgaagcgcgcttagctggcatgccaaaccatttagggtgtgtttagttcatgttaaaattaaaagtttaattaaaattgaaaaggtgtgacggaaaagttgaaagtttgtgtgtgtagaaaatttttaatgtgataaaaaaagttagaagtttgaagaaaaagttgataactaaaccaggccttaggttggaactttatgcatatgacattacattagtctcttaatatcggttatgtcagggttatgggtgcttccaaaagaaaaaaaaaatgcatgattaattacttggtgaactactactccatcgcaggaagacaacatgatttggtcggcaaatccactctaaccacacagagtgcagcgagacacgttgttaccgtcgaaatgtagagatccgtatcctattttcctacgcgtttatgaaaagatttgccacatgccacgacacgcgacacgcgcgcttgttacacaggctttctcaactgctacacgcgttacggaccttccgttatactccttcggtttccgtttccgtttccgtttcatatcataaattgttttaatttttcttaaattcaattaaatcttaagaaaaatatagcaaccaaaacaggacaatggcatgtttaagagagttgattttgagaagaagccgtttactctcttcgtcatatttgaattatttttatgattaatatttttattatattagatgataaaatataaatagtactttgtgtgggacttttttttagaaaaaatataaattttttaaataaaataaatggtcaaacgttaaacacgaatatctacgactgagacacatcctattccaataaatctagacaagagactatccaaattcagattatatttcgtttagatttttatactttatgacagaggtggaactattttttaactcccatctggttggtgagtccgcagcttctaagagtcagcagcttctagtagaggagtattttctaatccggacgaaaagctgatcgttttgggagcaaccatacgagaagacaccgcgaaattggttactacgagcgggagacgagcaataaaattgcgttgggggggtgggcaggggcacaaatcaagcactgcagtggcagtgcagctagcctaaagtttgccgattccccatggagtgaacgcaactagaccttgggagtgagggggaggcggccatggcggtggcggaagtcgggggaatgcttgcatctgccgtcctcaaggtggcgacccagaagctgggcgccgccatagcgggccgggtcatgctccagtggaacttcgacaaggatctggaggggatgaaggccacgctggagtctgtggacgcggtgctcagggacgccgagaggcggtcgatccgcgacgcggcggtgcggctgtggctgaggaggctcaaggacgccgcctacgacatctccgacatgctcgacgacctggagaacatcacttccaaatcggatgcggggaaggtgcgcaatctccactgcagcgattctcgcctctttttgttattccttattattattattattattattattattattacggttttgcctattattactccctatgacacctacgtttgaccattcgttttatttaaaaatttttaaataaaacgaatggtcaaacgttggactaaaagtcaacggcgtcatacattaaaatacggagatagtattatttattgccgttgcgtgccgtcagttttgggctgttcagattaataccattttcaaccataccattgccaaaaaaaaaatgttcgcgtttattttgttgccaaatttagtaaatacataagaaatcctgctaaaatttgataagttttattttggctacaatctgaacaggccctttggttatggatttactagtggatgtttccgattttccccatctgaaatacagtaaattttattgacgagtattcctctattactaactcaaatcagtaaattctctgcagttgggatgtgtgatgatccccaatctgactattgctcacaagattaccctagctaataagatgaagacgataagtgatgaactgaaggagatcactaatcaacatcttagcttcagattcacggaagatagcagctataaggagcacagagttactgataaacgggaaacatcgtccaaggtggaagaagcactagttgttgggaggactgcagagaagcggataattatatcttctctgtccaagagaatgactgaagagaccgtaatccttcctatatatggcattggaggcataggcaagacaaccttggcgaaactggttttcaacgcttccaatttcagagactactctaaggtctggatatatgtgtctcagacatttgacttgaacaaaattagcaactctataatttcacaagtatcggaaagtgagagccagttgactgaaagggagatgataaataggcgtcttgatgagctactttccggtaggaagattctaattgttttagatgacctatgggagagggatcaatttcagttagatgatttgaagactatgttaaaggttggcaggggcagcagggtgattgccatcgtaaccacccgagataaggacattgcagagaagatttgcaccactgaaccgtacaaactagaacccctgacagatgacatgtgctggaaaataataaaagaaaagagtgtctttgaagcaagagatgacaaagaacaattggagaatataggaagggaaatagcatctaagtgtggaggtgtggctttagcagccaaatcacttggatatactctgcaacccatgaagtttgatgaatgggtatcagtgagaaacaacgatatctggaaggcatctactttcgaatgtacatctttgccatatcataatgtgcttgcatccttgtgattgagctgcagcaatatgcctccaaacctgaggttatgctttgcatattgtgcaatctttccaaaaggtcacatcatagtaaaagaccaaataattcaccaatggaatgctcttggtttcatagagcaatctgacatattctctactaggcagcttggtgaggcatatgttagacagcttttggggttgtgcttccttcaacaaacaaaggctccttcagtgagtttctacttaccacatgcatctatagctgaacagctttatcatttctttattagcctatagtacacacataaatacatatctgagatttttttatatattttgaacctttctttaatataattttaaaataaatcctgctaaacttatctccagatttgcatcttttggccacacaatgccatcctcattggtgtggcaggacaacactgttgcacctgttaaagcctgtggcatcacaaaacatatgatgtcacaccatgagcaatggcactatagtaactcgctaaaccattgctcaagaagtggcaacatttggttgctaggtgtccaaaaccttttcttttttaatgaaatttagctattggtagttttcaaatttaaataagtaaatgttctaaaaataaaaagaatttggcaagatacaaaagttacatccatttgcagttacagcaagggaatttgtgcagatggtcctttttagagttggccctactataagctgtggaaaagcacgtaaactaaatttaattgctgtggaccttcagcttcaatattatttatttctttagtgaaatcttagatgctaatatgctatcatgctagcccttctcattgaggcatatctgacacatacccctattatgagctacatgccattgggtggattaaactatttcatagaagtatcaatatactaaagtctttaatggagtactagtgtggtgtaatatatgcaacaggtattgctacaatacgtcctcccctcagctcattctactgccatcttcatgggttcatggacactaccactgtgatgctagtggcacctcccacttccgttggctttactatgcccacctcctaggtacccagacaatcttctgagttggctacccaatctactgttaatagcttgcaattttcttgctcactaattataccaaattcatgggagaaggcctctggcaagtacctaagctaaccggttgcctagcctagcctgccttggaacattcaggctgcctattaaaggcctcaccacaactcgtgtctctggccaccctcaatgcctgaacgtcattggtttcctgtatgtgaggaagaagacaagctcttctctctccatttctttctctgtgattcctagatcccacttcaaagttctatgtggagcttcttgtgccagaactttcttgaacttttaatctgtaatcattgcaatatcattggtcttgttgttgctatggtggtaaacttccatgggggtttgtttgctccttgttggtaggttttaatagagtaccgagttttatatgttccaatgatcttggcctagtaaacgaaaatcagctttaaggagtaaaccacaccagtattccagaaaagaagtccacaaggcctcatacaatgatttggtgcccactgcccaatccataccacttaagcctgcaagatgggtaactgcatgaataccatttacccccttttattttttgaaacttaagatggtaggagatctaccggatatattagaagaagagaattgaccctttttataaggaaaacagggcccgaaaaccgtacagttgcacagtttgctaaagggaaactggcaaaaccttacacagaagacacaaaaaaaacatgtgacaaaacgactagacccacagaagtgatcgagagaagagcaaggcctccaaggaggtgaacaacgacagaagccgctgccgacgcccgcccaaaactggactgggttttcacccgaagtggagagagttcacaaggcaacacctccaaggaggaaacgacacccacaggcgtcgatgtcactgatcctggaagaccaggcagggctttcgcctaagactccctcaagaagtgcaggacctctaagaagctagagcaagagtgttgagtgttatcgttgcccagctcatcggctgaacccgatgcagcagctctgactccactttaacacaaaaaacttacaccgaagggggtaaggacatcgctctgcactcggcacaactacaggtttacacagccacatggcacgtgaagcaccagcgaggcccaagcgccctgactgcagacagactggaccaccaacacggacgaacaaaaaactccaccaccaaaagactccacggccggcctgggagcagacgaccaagagaagggaggaggcctggccggcctgaaggggaactgagagctgtcggcagggggagcaaagacatcggtgttatccatgtttctagcgaggatctccgggcttcgcgggacaatccaaacaactgcggcaaccacctccaacttcaccacaccaccagtgcagagagaggagcactggggcgaacagcagagcaactgaaaggaagaaaatatggggagaggggggatgacggtcaccggtcacccctactgcttatgccgagacgacagagagaggaagaaagagtagggaaggaaagagaaaatggtggttgccggcgactggagcggccggagcctccgacgcgaccccccggcaggactcaaatcccgccgaccgacggagacagctggcgccgatgaaggcaggccgacgcgccgccccggacgccgacccgctgcagcggtggagccccgctagcgccggccaccccgcgggccgccaccaccaaaccagcctaaccgcccccgcttcatgcctctcgacgctgccatcgtagatccggcggcggcggggccggatctgccgccgcccagcctgggagaccccgccgccgccgacgaacgccgcccccccccccccaacccgcgcgcgggcacagaggagagacgtcgccgcgagaaggccccgccgccgccatcctagctcgccagccggctttgccggcggcgagctccggcggcggcgaggtgaggagggggagaggaaggcggcggtggcgctagggtttcgccccccgtgtcgcctgcgcgggggcgacgcggggggaaggcttctctgatcgaatccaagcgtatatagaccaacaactggtttacccccttttagaatatcacttgtcagtggtgtaggatataagctttgtcctactaagtactaaccatggaccttaataccttatcacttcgttgataatcaaagagttgtggaaacggctgaactcgttgataatcctcttggcatgggagatttagaagcactgcagtgaccgtgtgtttaatggtgctagccctaatgtcatggtggtttcacaggcaatagtgaatgagggtagcttatggtgtttagccggagcccatgctctacataagtttcttgtgaggtcgcttgccccaggtgattagttggtcttttcttggggctttggtcgtgcgtcctttgtatgcgacggggagggtccttttggtccctcctatttaagtttgtttttttcctttcttaatgaaatgaacgcagttgtcctgtgttttttagggaaaaaaacttatcatcaaggtccgaacattttcttagaagttgcaaaggatggcgagaatttcacaaacgtgtttctaccatcaatataacattaaaaatccatactcattatgtactaaatctttacctattataaaaattcaagatgtttttgtgtggaattttcgtctgtcaccctgagtctcggacggttgcgtttcactccctccgcgttgcgtcagaatcggtgtcacggaggcaatagattaattttcggtaatttctcaagagcgtgcggatggcctggttagaatcgaacgacgaggcacggaattatccagattggttctggcaggttcccgcacaaactatggtaagtaaacctaaatcagtcccatgcatcttaatattaactgtccacttaatatatgtagagtaacgatactaagatgccatttgttccatgaatccattgtgacatggattgtccttccaacgccatatctctactgttataaaaaataaagatttttttgccggtattttcttacgtcatctgtatttgagtgggtttataaattcgcttttggaaatacagattcgtgtataaatttgaatttaagtttatttacttttggaaatacaaaacaagttgtataagagatttctttaaaaaaacttacatgctaatttgagatgaaagtcagactcctaattgcagctcatgattttctaaaaaaaaatatccaagcgaattcccatagtgaatttcatcctagctaaaccatataacaataataagattaaaatagcattcacccgttgcaacgcacaagcattttttctaatctctactattataaaaattgaagatgtttttgctggtactttggtacgttatccgtatttgagtcggtttttaagttcgttcgcttttgtaaataaagatatgtgtttgagtcagcttttaagcttgtttacttttggagatacaaaggagtcgtataagaaatctcttttaaaaaaactccacattgctaacttgagatgaaagttaaactcctacttggagctcaagattttctaaaaaaatatatattctagtgaattctcacactgaattttaccctagataaacaatataacaataataaaattaaaatagtattcacccgttgcaacgcacgggtattttttctagtgaatcaaaatgctgaattagttgagtatataaatctaaggaaaaaaggataggagaggaaaaactgctcattacaaatacccgtggcaacctctcataggtaatggaagttgtgtaactccttgcctgtgtgtcaactaggaattcacacaggcattacaatgccaaaattgataatgcaaaagaaaagaaaaaaaaagcaaaagaacatgaccagcaaagccttcatgttgaagccaatatctaggtcaactcctggaacagtatgaccaacgaaagtatagcaatgttttcttaattttgtggcatataaggtgatatatttatatgttcttttgttgcagactactagggtccataacgaagattctacgttcttaaccatgcacgacctggtgcatgattttgcaagatcaatcttatttgatgcagttctggattctggaaaaaaaatcaatattggggtaagcagttgtcgctatggaatgctcagagattgcagcaaaccactagagttggttacaccttcacctgcaaagataagagcactgcattttctgggttgtggcaaaattgagcttcatggtgttgcattctcatccgcttcatgcttgcgagttttagatttaagtggctgttccatcctgaggttacctgcttctatcggtcaattaaagcaattgaggtaccttaatgctccgggtatgaaaaatcgaatgattcccaagtgtatcaccaagctctcaaaattaaatttcctcagcctttgtaggtctcgtgctatctcagcactaccagagtcaattggtgaaattgaaggtctcatgcatcttgatttatcaggttgttcacgattaaaagagctcccaaagtcatttgggaagctcagaaggttggtgcacctaaatttgtcgaattgctctcgtgttaaagatgtatcagaatacatttgtggccttaccaaccttgaatatttgaacctatcagtgtgccgtaaaattggatttctaccgagaacattgggcagcctcacagaacttaagtatttgaacctatcaggttgttttgggataaaagaattaccgaaatcatttcagcagctaaaaaatttggtgcatctggatctgtcatgctgtaattgtgttaaagatttgtcagaagctttagatggccttgcaaaactgcagtacttgaacttatcatattgtcaccattatggaaaccagtttcgtctgagagggctgccagaagtcattggcaatctcaccagtctccggcatttgcatttatcggggttcctagacaatatatttggcaaccaatctggagtcatggacaagctcctggaaatagggtatttaaatttatcaacattccagggtaatatttttcagcaactaccaccaggtcaaagtcacagtttcattgagtgcatcggtgccctttcaaatctggagcatctaaatttgtctaataatgtcagcctttatagtgtacctgaaagtctgggtaaccttaggaagctacacacattagacctcacaggttgcattggactattgtggctaccagaaagtataagtaaaattcaaagcttgaaatatgtacttatgaaggatttgttgagacttaagtccacactatcttgtttcaacaatggcccaatcttgttgccaaactttgtggtccaagctgttgacaagaaatccagcaatcttggtcagcttcttgatgcaaaccctgctgagttggacataagtagtcttgaaaatgtgaagtccacaaaagaagcaaagggaataaaattgtcaggaaagagaaatattgtcaaactgaaatttgattggaccataggaaccaagcgatacgtggaggacatggaagtgttgagagaactagtgccgccaagcactgtgaagtactttgaactgcgaggttatcacagtacaagctttcctacctggttaatgggcattgcacactgtctccctaatcttgtcaaaattaagatagtggatttgtcgaaatgcagcatactaccacttggtcagttaccaaaccttaaacaactggttctcggtagaatgaagagcataacaaagatcgatgcggacttctgtggtggtgcgagagcatttcctcagctgaagacatttgacatatacagcatggaaaggttgcaagagtggaatacaacatactcttgtggtgaggatggtgtgactgagttcatgttccccaaccttcagtggttaagcataagtgactgccccaatttggttgtgaaaccactcccgcctagagttacgtggtggaaaatagagggcggtgaaagtgtcatatcatcatggggagggagtgtgcacactggtacatcttcatcctcttgttcagtaactaatctggtcgtcaaattctgtacgttgccgttgagtcagtggagtctgcttcaccaccttcctgccctccgtcacttaaccatccactggtgcgctgatctgactagctcaccagagatcattcaagacctccactcactcaaatcactatccctagatggaaacgaacaggcagagcttccagattggctgggtgacctcccttctcttcaagaactaaagataaccatgtatccagcgctgactgagctgcaagagaaaattaggcagctcatgtcactacagtcattgacattgtcttcttgtcagatgctgacatcattaggtgaatggtttgggagtctcacctctctccaagaattgcacatctcacactgccaaaggctgaacagtttcccagagggcatgcagtatctcacctccctcttgtcactgcatctgagttactgtgagagcatttcagcactgcctgaatggttaggaaacctcacatccctcaagacactccagatatgggaatgcagaggcatcaagtctttgccggagagcatcgaacaactcactatgcttgaacatctagaaatttctggctgtcctgaactaaagcaatggtgtgaattagaggatagcaaaacgaagcttgctcacataaaaaataaagtatgcactctatcagttactgttatattcatctttgtactgactattattattttattcatcttagcatagaatatttgtgtttagcatttcttagaggatactttatgtggatatgtctagattttaatatgcatagtgatgttattcttcttttggacacaaacatgcaagtagatatatcaagaggacaaatacatataaaatattcctaataaataatattccatctagtaaaaaaatgttgttttggacatataacatattaacattcaatacttttagtaccagtatcttcaatattttaattggtatgtctaagtcgcatttatatatttctctcatgtagtagttctctataatattataatttggtcaccaaagctgttcatcaattgccttttttctaaaatttatcagtcgattaaagtttcattgcatataacctaaatttgcaatctgaatactgcaacttatacatttgttgcaacttttagtttatgttgtattttatttcctggattaacctagatgcatttgtatgcttttgtatacatttataccattttataatggaatcattgacagcaaattaaagtatgatttttaatcttagttagaacattctttgtttctcagcaagatatatgaaatattgatatatgagtatatgactttttagatgttaatctagtgattaaaaagctattaacagataaggaaaaaccagttgtttggtaaaaagattgcatttatctatatgtatatatagatactagtatcatagaaacttatggtcaaactagtattttgaacatttgtgaccagaaaaatgacttcgttttttttgcagtgtttttggtagtgctgggaggctagaaggtgtcttcactaatctcaagcttgcgttacaaatccaggagcatctcggcgctatatgtgctgccatgtcactgccggcatctcaaaaataaaatacagatgttttttgttttttgatgggggtacttccaagctccatgtcaatgctagtcatttctgccataggagtttcctaggtacaaggttgtcatgtctctcattttcctacagctcattgcattggaaaactcgattaattagccctaatgaccaatgactaatgcaagtgcttaatatatatacatagcatacgatctgtttttatatccaaatctctcgttcttctcgagggagcatatgtaattttatttttatttttttggtttggaaatatacttggctggacctggaccatatgagattctgacaccatatgctacaaacactaatccaaagagcatctctcattggactaattaatcagg

SEQ ID NO: 69245 - DNA, 18479 bp, Oryza sativa
ccgcttggatgcattcccttgactcctccctgttttcctgagaccaagtttcaagttcgaaatccaaattcaatttccaaatctcgtttcctccccggcgccgaatcccgccgcccccactttgaccgtgccggcccgcgctccgcgttcaaattcgaccgcttgatccaccgacctcgccgcccaacgcatcctcgccgttgccgttttcgggtcgcccacgaaaccatcgccccaccgccagccgagcgccagctcgtctgtgatctcccccttgcctataaatcctacccaccgagccccaaatcctccctcaacctcggtcgccgtcgcgcggccaaccccggagcaccgccgcctccttcgtcgccacggccaagaacgccgcgccgtcaccaaaccgtcccaccccgcgtcccttccttccctggtgcgcccgcttcggcgtcacgttcgtccccgtgcgccgccaacggccttcctccccttcccatcctcaaatcgccgccgacgccattcctcgccgattggtgagctcctcgtccccttccccttaaaggacgccgaaccagctcgctgtcgccctcccggaactcctcgcgccccctctctgtttccccggccgtgcccctctcggtgcaatgaccgccccgccgtgctctgttcccgccgccgccgcgctcggctgagcgccgccgttggcctccttttcgggactccccgcgccaccacccgccttgagctcccttgacccaccccaaacagtcgctctgcccgattcgccgccgccacgcatgaccgcgcgccgccgtgggcttcgcggccaacgccaacgggctttcttccattcccatcctcaaatgcccgccgacaccattccttaccgaatgggagccccccgtcccctttcccttaccgaacgccgaaccaactcgctgtccccctgccggacactcgcgggccccctttttggtttcccgggcatgccactcttgatgctatgaaccaccccgccatcccctcgccgtatcctctcgtctccaccctcctggagccccctcgactctccccgaaccgccgccctagccgccggccttctttcttgttcccacgtcgtgccgcccgattcaccaccgcgggacacgggcgcgctctgccgtcggttccccccttctcttcgaacccgctcgccaccaccttcctcgggcccctcttgacctcccccttgctgccccgtggccaccggcctcccctccagctctcgcgccgcgccggccttttcgttgccgcgccgcgccgccgcacgagcaacaccggcgaccatcagcctccgcgcccaacgcgtgtgcgtcgcaacaccacaccgattcgatcgaaccatagcccgcgcccccttttccctcccatcgcgtatccacgtcggcaatccggcgagcttcgccaccgtcgccggccgccgtcgcgccccttctctccggtccgatccgtggaaccgattccccgcttcctcctctcgcttccagtgcctgccgcccactccgattcgccgccgttcgctggagcgcaccgagcgccgttggccatccgatgagccgcccggcctcctctcccttccctgtccgacgtggcgtccacctggacgccacctcagccgctgaccccaccagaccaagtcaacccctgcctagtcagccacccccccccccttctctctccccgctcgtgggcctggcccatcgaccagctccccctcctcggcccattgaaacaaaggaagtccatttttactccctccgccaaacacaatgaccaaaagtctatatctgctccctcccaattcacctctctctcaccatatgttggccccacatgtcaatgagtgataaaaggatattcttgagaatattcatttccataaatgcaataaatcatatctcctgctccataaaacatttcctatattccaaattccataaaatccttcctcttaatctggggattccaataattcaacccattggtcctgcatgtcagtgactgtcaataatattcttgagaatattatttctataaattctataagccatttctcgtactccaaaaaatccaatagatcatttccttgtccagaaatccaattaagcttccaaaatccatatctcctcaaccgctcgaccgattgactccgttctacttccagtagttccgtaaaattgatatcaatttaatggcactattaattagtctaaataggatctttctttcagtcttttggttaggtttttgattgtttgcgtatagttgcggttaccggattttcgtcaagcggatttcttgaagattcgtgaagatcaagaccctgagcaaggcaagccacctttgaacatattgagcctatatttgaacttaattaatttgcttgaaaaatattatgcattgataggattgcacttaatctatttgccccgtctgcaaggcagaccggtgggcctacccaacttgttgcatctgatccttccattgttaattgttatatcatgttcccttgtaactatctagttgcgcctcgatattcgtgcactctgtgcgagtatcgacggtctccttcaaacttaaaatctgtgtaacttcttgggtaaaacttggtttacaaaagctttggaaaacccgacgcctgggtcggtgccttgtgaaagaaaatgagttttaaaaataaaatttgcgacacaaggccattcctgggcggaatacttgtgcggtcgcatctaaggaccgattcctttggaattacatccgagcatacaatagtgcgaccacacgggtggaatgggacgcccctggctgagtaaatagctaatcaagggagccttgatgccaagagacatgtggattcaacggggtggtgtcggggagaacccccgggcttcctggcacagtatggtctgggacctaacctgttgttggtctgggactcctctcattggcatatggtaaccctgtgtcggctttcgaaataccttgtcgtgaaagccccaaagtcaccagacgtggctgttctgcacgggctgggtgaccaaggctagtaacgtcgtgtgggtatagtgtaccccctctacagaggttattaaactgttcgaacagccgtgcccacggtcatgggcgaatgtgaggtgattccttagcgtagtttttgttttaccctgttttatgaaaaggtgttaaggtttgggaaacctaatgcttgggaagcaattagctgtccgggggacagtgggaccggaagtccctggaagtgattggtcgtttggggaccactattattgggaagtttggaaaaatggtttggtttgggaaaaccagctttgaggccaactctgggagttgtgaaaatcttgataaataaatttgttacttctcaccccgactgagctgagacttgtctcgctctggttgtggaaagcacacacttagattgttgaaaaccttgaaaacaaaactgattgaaaaataacaacctattctttgaaacttgcattaaccacctaagttcccctggcttgctgagtacgtaagtactcacccttgctctctatataaatatagttctgccagctctgaagatgaagttgaagtgaagtgaagattagggtttcgtcctagaccccagccgtcgcctgtggtgttgggggttagtccgttgtttccgttgctgctgccgctgttggtgttgcctcgtccgtgtcgtcggttgtaatctcgggctgtcctgagttgcaacctaagttaaggtaaataagtcctctatttattctaaggattgcaatgattcatatttgtcaccgtgggtaccagcgctatgtcctgggactagtactgagatcgcggtttcgtaggaagcggttcgcgccgtttttcctacgacacgctcctatcaggtgccgttgtacggcgatgccggattggggtgtgacacatagcaactcctatgccccgcagccgttgccgccgcccccgctcccacccccggggttcgtcctcgctgttgctgatgccctccctacctcccatcagcattgccatccctaccgccaaccgccggatgcaccatcgctgcccacccaaccaccggatccattgccgccaagctctccaccgtcctccccaccaccggatccgccgctccctgctcctgtatgccgccggatccctctggtgctggccactcccgctcgtccgcccacttgccaccatcgttgtcgtcgtagccatcgccactatcatcgtggccgcggtggaggaagggggaggggggaggggatggccgcttgaggagggggcgagaagatatgaggagaagataagggagtggagtggagtgtggagaagttaggaaatgagatattttaagaggagagaataaagagagggaggggacgggtaaacggcttggtgccaggcgggcctattaagaagcctgcctacgaaaattgttttttcgcatgtggtctttgaaccacgctctcggggcagcgatttttgcaggcgggagcagtttaatttgccagcaacctcaaggggtctcatccgaaaaaatcgtttctatagtagcggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcggcggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacacatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagtgcaacacacaggcattgtgcttgtttaaagaaaaaaggaattagcaacatctatattagataagtttcattaaatttaacattgaatatattttgatgcaatatttgttttatattgaaatgttaccatattttgctataaatttggtcaaaattttaaaagtttgactaaaaaaagtcaaacgacttctaatataaaacggagggagtatgatttttcacatgcaggtctatttttaagatgtggtgcttttaacataaccgcctacgaaaatcgcaacaaaatataaaataatgggccgggtgatgggagtggcaaaactctcgcttaattatcctctcccccgtcccctcttaccctccatctccagtacagcgtggtagcgtgggaagcgggcttcggatccagtggagctcgatgaggagtacctctgtgatggcctccatcgcttctctccccctcccttgtgttgggattgctcactcacagctacaagtgttaatcacaaacacttttgtctctctggtgggaaatcacttcctctctctctctctctctaccgtatttttgccacaaaggcttctcaggtagacacacacaagcagcacaagatgcaagtttctgttgattcaaccacccacggcctcatcatttttctcattatatatagactcaaattacatgcaaaggataacaaccagccaattctcttgaccgggactcacgccatgcactaacaaactaaccctctatgcaaggctgcatgtacacctacatgcaagctaacaaccagaacgtgcatctatccactattgcgtgcatgctgcgtttccacgccaacgaatgacacagccatctcggccacttcgcgatgtcatggcgcacgacgttctcctgcagcatctcacgtacccgccgtctcgcacggcttctcggccgcgtacgcatctcgcatacaaccataagcttcttcgggtaccatatcctgctacctatacatttattttctacatgcgaccaaagtaaacatgctaatgctaatgacaagattatttgtaacaccttgctcctggcagctacaacgatgggcatcaagcaacatcacagtggtggtgccggatccagcaaagctcgatttggaggacctcctgcgatggcctacatatcgcctctcctccttcctcacttcagatgattgtgatggcaggctctggacggtggcagcgacgcaatactagaaaaagcatttttcccaatataggggtcttttttttcgcaggcagacatgagtctgggaatcaaatgactgcctacaagaatataaatcagggtgaagttcgctgtctgtctgcgaaagtctattttcacaggcggattacttaagcggcgcctatgaaaatcattttcacaattttcacaggcggaccacctaagccgcgcctacgaaaatagattttcgcaggcgcactttatgtggtccgcctacaaaaatcgtacataccaagaaaacttcaatccttatctactactccaacccttccctatcactcatttctatcttctcaactctctccctccaccaccggcttctcagctccgccatcccctcccctcccatcccatctctccctccctccaccggcggcggcggcgcgcggacgcggcggcggctccccggcttcccctcctagatccagccggagggaggccggggaagggcagcggcggcggcgacgacgtggttccccggcctcccctcccagatccggccggagggaggccgggagagggcagcagcggcgtgcgcgacgcggcggcgacccggtgcggcggccgcagctccccggcctcccctcccagatccggccggagggaggtcggggggagggcgacggcggcggcggcggcgaggcgattttttttgtttttttattggattttcgcaggcgggccatttgcccgcttgcgaaaatagatgattttcaccatcgtccgtctgcaggcggtcctccccttcgcctgcaaaaattgcttttggccgcttgcaaaaatgctttttctagtagcgacgggctttgatcgtgtttgatctgatgaaggtggactttaggtgcactggatctggcggagcttgacgtggaacgcctctagtagagataatacggtgagatctggtggacttaagatgcaatagagcaatgtcttccggcagcgacgatgtgtcaggcgtcgaggaggtttgtggtcggatctagagtttctagaatactttttttatttttgtcccacaattgattttgtcatgaatgttaagaaaatagaagcacaacggagacacaaattttacataaaaaacccttgagggaaaaactacgggcaccgaccggcaattatcagtataaaggagttggatacaaatgcagaggatacattgggttgtctaccatttgttagaaaatagatgcacaacaaagacacgaattttacgtagaaaactcttgcaggaaaagaccacggacgccgaccggcaataatcactatatagtagttggatacaaacatagggttgtcacaccctccctgtgcggcttacaacagatatatatagctaggagtcctcatgggcaaagagtcgaagtcttaatgggaaactaatcctattaagaaactaatccgaatatattgtgtgcctaaaattcggatcacatatttaacaattgtgtcgtccaccgggattttcacagacacatctagatccctatggttgctctagctgcctgtgaaaagtcatattagcaatttaattagaaaaagcttcgtgtgtttatttattacgagaatgcttaattacgggcgaccggcgctggggagccggatcgggcgctccccccgcgcgcccctacccggcccacccacccacttctctctccccttttttttcataaaagatgtttcacctagtgtacttacaatgtttcactattatagatctaatgttgcagtgaattaaaatactcttttgcaaaaaaaaaacccacatattttggaacctttattaagggaatttggtttattttttgttccaccaaaaatattttacctattgtacttataatgtttcactatgtatagatctaatgttgcagtgaacgaaacattctattgcaacaaaaaaacccacatattttagaaaccccatattaagggaatttggtttattttttgttccgccaaaaaatgtttcacctaatgtactcacaatgtttcactatgtatagatctaatgttacagtaaactgaaacattctttcgctatttgctgaaacattatttttatataaggtgaaacaacacccgatttaaatgagtgaaacattttcgatctacttagtgaaacaattccgatatacctggtggaacatcgtgtaacatttaaagataattcaataataagctaaatttttttcgtcggaatatatctatgtgtggtcttgttttgaatatttaattgcaacgaatttaatggtgcaatcggatcatgatttggataagtaatttaagagaaaaatcagtttaaagtagttttgcacataaatcagacgctgacgtcatgctgatgtcagcgcccgattttaacctcctcccatcgggcgcccgagcgggagtcacgtcctatttattacggtgtgtatatatagtatagactagactaccatttgtttgttttgctttcaactagtggctaatatctaaggccctgtttagttcacaccaaacttctcccaactcccaactttccatcacttcacattctccccactcccaactttccatcacatcacatcacatccaaaactttcttacatacataaattctcaattttttttccaaactaccaactttccccaaacttctccccaatttcaaaaactaaacatgacgaaatataagccataccggaccaatccttatatacaactgggaggccaactggtcatttgctttcagctagtggctaatagctaagtacgacgaaatataagccataccggaccaatccttacatacaactggaggccaactggccaagtggttaatatcaattattccatcctggtcctttcttgaatggtcattcttgaaaaaaaatatctttactctaattataatattacactattatgcttgtttgcgagccagagaggccttttgtggcttaatttgtcgtcctccaaagtcccttatctcctgagttatgggtctatatatttctgtctgaacagtcctaaattttcttttagaaaaattcttcctccgccatattctagtaactacatcagttattcatcaaactttcatcactatgtctatgcataagtatttagaaacatgctatattacaagagttgctacattattaatataaccatttaacctctctgtttttattacaacctaatcatttatatatcggaaatgctataggacggtattccatttgaacgggatgatatctctgagatatcatgtcgtgatatctaatcggtatcaagatacctaaccggtaccatactattcaaaccagatatcgttgtagcaacccctttataaaatcagcacttatcaaagttttgtaccatatggccagcgatgaaaagtaaacagaaatggcgactcttatgacatggaatttttaaggggattggatcataaaaagaagggaaaattagaaccatgccattataattttacaaaatttgagatatatcatcctgacccacatgtcattgactcatacgggtcctaaatgtcattgagatatcgatagcatatctcaaactttacaaaattataatggcatgcttctaaattaccaaaaaaaaatggtgcatctacggtgcaaacaggctcgatttatggtagccttgtcctggatagctgacacatatggaaaccacacatttgatacagctccaagtgaacgggatgaggacccacgtggcttgactcgacttttttaacccgcttttcaacatatgtgttttcaagggaaaaagaaaagcatgtgtgcatgtttcttttgaagaacaatcaatccctcccctggctagtggataggaaattcgtctaaactatagctatttgcctatttatttagacatttttttccaagcaaagctagagttttgcatttaatgaaattacccgataattaataccccttttttaaaaaaataaactctctccatcttataaaaaaaacaacttctatggatgggaatatggataaaagcttgttcatatccatcctcataagttgatttaattttagatagagtacgtggctgtcaccgattcctaaagtggataaatccgagcacatgtttaaacatatgtttgaatattctgataggcatataagcctaccacctgtactgccgtagtacacgacaaggacattgcctcttgtgattgaggtgagttagtatgacaaaaatataatatttatgatatttattaataaatagctagctcgtgcagctcatggatataactctcctaatgatgtcagccttaggaaataccgatagaagggaaatggcaaatgtaaaataaatatggttagagcatctctagcagtgtcgctaaacacaaccctcaaaactattcaagggtgaacataaaaaaaatacggaagaaatttctgcgcttcccaattttttctcagctcgtgttgttctctcggtctcgagccgtcttcctctgcccggcgctcctccctcaggatgggaatggttaggttctggattgaacctaaaccatttcatgtgacaacgctaatccatggtttaataggggcaacccttaatgattctattaaatgaataggttatccaatagagcaaaaggttaaccgattgaacctagcacacaaccacacatatacaaggcaatacatcacaggattacatatctgcaaagcataacagggttacatatatgcaaagcagtacatcacaaggctaattacacagccaattcaccgtaaaagagcagagctgcagtaagttcacaataaaaaataattggaaatgcgtactccagtactccaccattaaccacaagaacatgatagcgtatcatttattacaatgtgcctaagtcaaaagaagatgcacagctaacatcatttcatacaaaagtatcatattgcattgatctggcattcaccaataggacattctctccaaaaacagcccccaccatcttcaacacacctttcatgtcctagcttccctaaagaaatgtaatataggtattattattcacagttatatcatgtcctagcttccctaaagaaatgtaatataggtattattattcacagttatatcatgtcctagcttccctaaagaaatgtaatataggtattattattcacagctatatatctctaataatagctactccctcagtttcatattgtaagaccttccagtattgctcatatttatatagatgttagtctacattaatataaatgttaataaatctagaagaagtacatatatttgaactgaacattttttttctcctcgagaggatgtcccccgcaatgaggtgctagttatcattttaaaaaacggtaagatgctaattgctttccatgaaccaacatatccaaactcctcataagtaccaacatcagttaggcatcacaaaagcggcactaataacatattgttagtgccagtacgttctacaactggcatatttagtccctcgtatatgttggttcttgtttagacccggcatgaggctcaccagggacgagttagcatgttcccatccggccaggctgtgttcgctagagcaagttcccatccgaaataatgcgcacagaaaatggaacggtctattaatggattagcgcgtgattaattaagtattagctgaatatttttcaaaaatggatcgatatgattttttaagcaactttcgtatagaaacatttttgaaaaaaacacaccgtttagcagtttgaaaagcatgcgcgcggaaaacgaggggatgaattgggaaacttgggttaaaaacaacaatcagcatatatgagtccattatttgtgctgattgtatgtaacaaccggcacatatgaggctcaccttacattccaattcttatattacgccaacatttgctgactatatataagtaaagtaagagagttaattagtaattaattctcatgctaaatattttatattgcaattaaccgttatacatatatagggccatataggccataaataaataaatagtattccctccattttatattataagttatttcagtttttgttattcaaattgttttagatttgaccaagttacggaaaaaaaaactagcaacatttataacatcaaatttatttcatttaatttagtattgaacatattttgataatatgtttgttttgttttaaaaatgttagtgtatttttatattaatttggtcaaacataagaaagtttaactatgaaaaaagtcaaatgacttataatatgaaatggagggagtagttagttaatcttgcataatctcctctcgatgcattactaacttctcgaacacttgaaaattgaaatgatgcataaaacacgtatactcaaataactactccaatagctaggcatgcgcagttgatcgatcgatgcagccgtccatgctagtgctagctgcaggtagacgtggatctcgacgccgccgccggtggcgaggctgtagtcgtagctcactagtacaaaaaaacatcaaaggtgccggttcccagctggctatagaaaactggcacctattaatcggtaccaatacaagcaaccggcccctataaaaaatataaacggcacctataactttgcacgatccaaaaaaaaaaagagccggctcgaatcgagctgaattcacaagccttcactgcgccatgcccccacgtcttgtttgaaatccccaaatcccccacatcacagatcacagatcatccataaatcatccacaaatcatagatcgaaacatattcaataagaaaatcatccacaaatcacaaaaacatcttaaaagaatctacaaaatcattcaaaaaaatttgcgcgcggccgcctgccaccgccgcctgccacctcccctcccaccggatccgacagaggggagtgcgcggccaccgccgccgccgccgcctccgccggaccgccgccagccgttgttgccgcctccaccgggccaccgccgaggtcggccgcctcccctccggctggattcggcggaggggagggcgcggccgccacaagccgctgccgcctccaccgggccaccaccgaggtccgccgcctcccctccagccggatctggcggaggggagggcatgtccgtcgccagccgctgccgccacaaccgggtgaccgccactgctgcctccgccgagccgccgtcgccaccgccaccgccgctcccacttccgccgggccaccgtcgagctgccgtcgagacgagagagagcgatagagggaggcgaaagagagagaacgatagagggagagcaagagagagacagagagagcgagaacgatagataaggacgggcggaccgagagatgggtggaccgagatatggataaggccggctcggtggctcggctcggctaaggataggtgccggttttttaagaaaaccgtctcggctcattataggtgccagttttttaataaaaccgacacctattaacctataataggtgtcggttttatttaaaaaactgacaccaatagtataggtgtcggtttctctttaaaaccgacacctataatggtttaaaggtgtcggttttatgtgtttttagcctgcgggagagggtaaaacactatacgtaccggttttaattgttccagcacctataatgccgatctctatgagcttttttgtagtagtggttcttcgtgaccatgtacccacgcgcgaaccggaaccgccccgtgccaccgatcaccaccgactcgcgctcaccggcgtccatgtcgatgcgccccttcgccgtcaccgagctgccgcggtgctcgccggcctccagcaccacgtgcaggctcacgtccgtcaccatgccgccctctgacacccgcaccgcgaacccctacgccgtgcccatgcgcgcactgttggcggatggcccctccgtcagcgcgctgtttagcaccacgatgtcgccgaactgccgccgcggcggcgaggacgacgacggcggcgatgtggcatcattgttgttgccgtcgccgtcgtcgagcaaggaacggccggagacgacgcgcatggtggtgggagccgggccggtgtacgtgtcgtgcatgtagaagtggaggtgggtagtggtggtggtggtggtggaggcgccgatgtggtggcggaggaagacggcgaccgcgaggatgagggaggagctgaggaggagggagcatagggaagccatggcctggtcgagcctgctgtgggctatgacagctgcttgctttgtttgtgttgttgcagctggcatgtatttatggatgtgacgagactgtgagcgctagtatgttataaaagttagttgatattgcggaacgactaaccttctcgatcgcttcgatcatttatcacccaaaacatatcagataatgatacaggaatatacgatatttgttaacgaagtttagctaaagtcctatatcttcggggctttgattatgggcgctcctttccaaccaatatagctcctagctactaagtacgatttccgacaaactcacctttcactccgtttattcgccacagttatataacttttttatcaaacatgtaggacaattgcgtatcattgcattacagaagaaccggtgattatatgtgcatccttgataaaaaaaaaacaaaacacggccacgaccttacctaaccatcttctagtgcaacaacgatgaggtaagaaatgccttaagcctttggccatgcccaacaaagcaactcctcactagtatacgataaagctccagcaaggttaattaggataagcatcttcaaatacacatcgattatgatgcttccaaattaaccaaggtcctagaatgatcagagagttaaggcctttttttcgaacttaaccatcaaccaaaccatccatcgtagctcaccaatccctcaaaagaggcttcattacatgaattgtgtaaatggttgatcgatcgtctccctagtctgatcacaatgagtgcattggacaaggtgtgtgacttcaacttgcaagaaagtcagctgtccagaacctattgtgttttgtatacaaccaaccacatgaaaaaacttcatttgcagggcctagcgcatgtattccaaaatacgttcccattgcagcctaaaaaaattagatccaaagaaaaggccctcacactactggaaaaatcatctttggtcggtcgaccaaattccacaatagtcccggatgtaataaaaaccgggactaaagaacatctttagttccggttcaaaaggttagagctactttttgatttttagtcccggttggtaacaccaaccgaaccgggactaaagatcatttttagtcccggttcaaaaaaacggcaggtggtgtcagacccctcctttatctttaatccttggtgttaccaaccgggactaaagatctatttatagtcccggttggtaacaccaaccgggataaaagaacaatatgatccggttggtgttaccaaccgggagaaaagagcgacatgcacggagaggcatggtgtcaaaccccctcttttatatttagtcccgtgtcaccaaccgggactaaagataaatttctagtcctggttggtattaccaaccgggaaaaaagatcgacaggatcagttaataagttcaaacctttatctcatcctctcctcactcagatccatctcttcctcttccttctcccatctcttcctctacctcctctatatccgccccatcccctcccctcccctccccacttctcaggcggcggccggacgggaggcgcctcctcctcccatctcttcctctacctcctctcctctgtatccgccccatcccctcccctccccacttcttaggcggcggcttccggatgagagacgccctcacacggctgccgggaggcggcggagccggcctcgcacaccggtggtgaggcaatgcgcgaggcacgaggcggggccgcggacgaggtggcaggcgctacctgtggcaagcagcggcgggcggcaccgcgccggatctcctctccttttttttataatttgtgattgagagatgtttaatttcttttttaaaattgtgattcattgcatagatctgagatgtataatcgatctgtgatgcatttgatttgtgtgtaattttttttaagatttgtgatgtatttgatttgtgtgtaagtaacttaggatttgtatttgtgatgttaatgatttgggatgttaatttaatttggggatttgggtatatgtatgacactcgatttgagggtttggtgtttgatctggtatatacatcttactcgatttgggagaaaataaaaagaaaatggaccaactgggactgcccctatcctctctttagtcccggt

SEQ ID NO: 69246 - DNA, 7952 bp, Oryza sativa
taaagcttgtgttgggggggggggggggagggtctgtgttaacatcaatggtgagagaagcaatttctttagcacttatagagggcttagacagggtgaccccctctcccctcttctctttaatctggttagtgatgccctacagcctcttttgatagagccaaacaatcagggatcctctcaggtttagttccccatctttgtccaggaggtctgactcatttgcagtatgcagatgatactgtgatttttataccctttgataattcccagatcaccattacaaaatttatcatgtactgttttgaggagatggccggcatgaagattaattaccacaagagtgaggtttttactgtggggcttgaggagaatgaaaccatcagagttgcaaagatgcttaattgtcccattgggaagtttcctatgaagtacctgggattaccaattagccctgataagattcttaaacaagacctgatgttcttaccccacaaaatggaaaagaggttgggaaattgggcaggccctttatcttatgctggaagagttgttcacattaactcttgcctatcctctattccttcatatgccatgggcttttaccaactccccgagggtgttcactagaattttgactctttgaaaggtagatattattgggctggcaataaacaggggaggaaatatcatatggtgaagtgggctgacttagcactccccaaagattttggaggtttaggcttcactgaaacaagactgtttaacactgccctccttgccaaatggttaacaaaaattgaatctgaagacaagagcctttgtgttgagcttttaaggaagaaataccttctacaaggaggagtttttcaatgctctactgaaggggtctctcaattctggacaggtgttcttaacactagaaagtggatgaagtttggttctgtgtggcaactgggaaatgggactcatttttacttttggctggacctttgggttggttcctaccctttaaatattgctttctttgagattttcaaaatctgtaatcagcaaaaggttacaattgcagaggtgaatacaaagggcttggggatatttacttttagaagatcttttggtcctcaggaggttgatcaatggaggcagttatgtgatttatttgataacttggagctttctaactccccagatattatgagatgggcgttgacacctaacaaacagtacactacacaatctctctatagggctctatcgttcagaggaattagagatgagaaaatgcatgccatctggagatgccctgcccctatgaagataaaacattttctctggctagcacttagagatagaatccagtcgtgtgaacaattgaaaacaaaaggttgggaaggttctgaactttgtgtgctatgtaactcactagaaaccacaagacatattctctttagctgccccatggccaccttcatttggtgtgtctgtagagatgcttttgggtggcactctgtgcctaacagctttgaggagttcttttctctgattaaacacacttctctgaagagttttagtacttatctggccttactcgctgctatttcctgggtcctctggactaccagaaatgatatgatttttagatcgcggactgtttactcaccactaatgctcccctttcgaattgtttcttacatgttacagtggaggggtttaagtcacgcgaatgaagctgccctgatggaggccctgaccgagaaactgaaatctgctgttacaaatgttggcgcgaccagagcaggaattggctagtctgtttcagtccttgatgtagttcttcagaggctgcgagcttttgttctttttctttaacctgtcgttggtttaagatgttctagagttctggttcttttgtttcgaggcgttgccctcctgcgctataaaacgctggctggtttccccagcataccttctggctttcaatataagccgggctcttgagccttttctctaaaaaaatacagacatcttcagtttgcacttgttcctgtttgggttatgtaatctgaagaaaggaagatggatagttgatcatatgttcagttcttggtgatataaattgcctgtcagttaactacatcagtaactttggctatcaattctagctagaatgacatcagctgcatgctgatcgggatggagcacaacgacaatgctggtcagagactgagagtaacgaagcaactatgtgtctcaatgctatgcaagaaacatagtaactgcagtctcctgcagaaaaagtaaaacatgagcttggtgccagcgggagctgggccggcggcaaactgtggcggtgggggcgctcggcggcggcggagtgatgtgcggggcgtcgagggcaggcggcggcgcttggtggcggtggggcatcgactgggccggcggggtggtggccctcatgctcgcggcgccggagtggatgtcgatggcgctcagatcgatcgatccagactccaaaggatatctcaccctttgatctgacaagtgggcctaggggcaaaacagtccaaaatgcctggaaagaaatacaaattgatttaagaaatgagaaatacatcaaaaactgagaaagtggtaccaaatagactaattagtagtcctaatgatatattatagagggcatacggattgggttgtaaaagagttgaggcacgcgaattggatggtaaatactctaaattatcttttttatgaggtcaggatgcctaacttataccttttttttaatgagaatagctagagcacgagataacttttaatgaatctaacaaattaaatacccctaagctctttttaaccataccctcgagcatatgcgggattcctctcattaaaccacccgatactttatatgatgacaccatgctgacatcaacacgaaatctagatatcacatcaggtacgaggtatcaagtccgatacctactgataccaaagtaccaagtctgataccaggtctgataacgatacccgacctagtacctgttgaagttataagaacataatgatttaatttatttcataaataaatcataacattgcagatgtaaactagcatgaacgcatcattagatctacacatgtaaactagacagtaaagcataaataaatcgaatatgcgcaacatgctgaacacgtaacaagggtaccggaagaccggttacttagcaagaattactcccaggtgcgggtgttgacgacggtgcgcagcacacgagcgaagaggaagacaagccgttgtggtcgaacagggagcaatcacgcgaagcgctttcaaaaaccatattgctgccttcttctggtgcaggacgtcgaaggcgaaggttccgaagacctgctctcccgattgccgtgcacgccgacgagcgggatggagtagactacgagtgacgacgcagtacagaggaggaggcaaaccctagattaatttcgtgtgtgttgcgtggaggcggcagctcagcttatatagagatatcaggacgcttgatcaggatgcctacatgatctctgctccgtgtaaccaaaccggataagtcgcgcgaaacttatctggactccacgatgtttcacgcactggatttttcggagtgtttccaaaacaaacaagtccgaatttcccacggcaaaacaaaactatccggactctacgctttttcacgcacctgattttttggagtgtttccaaaacaaacaaatccgaatttcccgtgcaaaacaaaactgcaaaaagaggttacatctgtgcaaaaggaggttgcatctgcgcaagggtgaagaaccactttttggcggaccattcgacgcataacgtcatgcacacgcgctgccacgccatgtcaggcgagcaagcacgcgcctgtgttcaccctcttctcttcacatcacatgtttcaaatgactagaagagcatcctcccttataaggaggtcttcctctcgtagaataagtaatgtggtactaaactcctatgcttgtcatcccatgaggtgggcttttgtgattttctaaagaattaattttcgaatgggctgagacccatctattaattcccttgttagagtactatgagtacccttacaaccctagcttgccttgtcagcatctgtctccaaaggaagacaactgatcctagcccctaagttcgggtttttttttcatataatttattttcggagtttctctttagcttttcagattcaatgaataaatatggttaaaactttcaccaaattgtagggattcatttcactactagcacctcttatgacagttcaacttgattggtcacataagctgcaaacatgagttttgcttgcggaattacagattggtatctagtttgctatactttagtcagaataatatttcttaaatattgtggattgcagattgagaggtacacctattcaagttattgtggatgacatgaagctattttatagatactggtgttctttttttgtttaattattagacgggaattcctttttcattagttatgaaagccaaaaaaaagaaatactatcatttggtccctgcctattgatgatcaacagtctaggcaacggaacgtgccaaaaaaaaagccaaaaagtcaattcacaacatttctgtttttgaaacagtcataaaacaattaaaaaatagaaaaaaattggtagcatatattacaaatttcacaataacaaacagatttatttaatttatcaacgatgtaagtaccattcataactaaaatttttaactcgctgtatttgtgtgtcagtgttgagattcgatcattcgactattggtatgaagcagattcagtctatttggctcaaagtctgaacctagctactttagtgcaattttagcggcatggcgcagtattggccttatattcttagaaccgtgtactcagataataatatgaaaccacgtataataataatatatactatgggtctgtttgatagagctctaatttctaaatttagctttaagagttaggtctagaataaagttttagagagttttaaaccaatctaaacccagctctagctacctctatagtttattttgtgagaatgctatacccaacttcgctcctattttaagtggagctaaaattatttggctgagctccagctccaggtaaagctgaaattgtagcaaacatgccctataatgcaaatggatccatcattcatgatatcgagagatgcctgaaacacgttcgcttggctgtcacgcctgcaaattaacgcaaagcaattaacgaaagccgcagaaaagcaaatctggaggcatggaaatgagctgcaaagttcatgtgggcctttgcatacagataattcgatcaaagtacgtgtgaatggttgaattcttgtttctaaagatctctcaaagcaacatattctttatataactgaacgtgacatggaacgaaatctttttcgccgggggaaacgggacgaaatcgttatgtgcacaccgaacactggtggagaaaccctttgtagtcccggttcgtaacccccctttagtcccggtttccaaaccgggagtaccaatccgggactaaagatcgctatctttagtctcgggtgaaataaccgggagtaaagatcgatctttagtcccggttggtaacaccaaccgggactaaagatggctcagccacgtggccgggatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttcaacaaccgggactaaagatatctttagtcccggttgttgagaacaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaacattttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacggttaggctcatcaggccctttgcccttttttcctttgctaaacatgtccttcacgaaaaagacttgcgttacatcattggcaaggacaaaaggttcgtccgagtatccaaccttgttaaggtcaacagttgtcatcccactgtcatcaatcattgcgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataa

SEQ ID NO: 69247 - DNA, 63122 bp, Oryza sativa
aaccgggacaaaaaaaaatcaaccgagctggcgccactgcccccacccggctgcctcggtctctccccctttctttcccctcccctctcattaattaaacagcctcatccatcctttgtccatccttatcctcctccatcccttctcctctcccattcctctcccttctcttctcttcctcctcctcctcctcctaccacgtgaggccgggtggcgcacggcggtagggagggcgcggagcggcgggcggccgggcaggcggccgaggcggtggaccgtgaggtaggcaaggcgggcagccggcaaggccggcggcgggcagccgagcaggcggccagcgaggcggcggcgctccccgggcgggcggcggagcccgaggcggcagcgggcgggcaccggccgttgaggcagcgggcagcgggcggcgacgctccccaggcggcggcggagcccaaggcggccgggcgggaggccagcgaggcggcggacggccggcacccgatctctgcgatgtggttttttcctgatctgtgcgatgtgtgcggccgatctgtgcgatgtggatttctttttctgatctgtgcagccgatctgtgcgatgtgatttctttttctgatctgtgtgatgtgtaatgtgtgaatgaatttgtggagatgattttgtgattttgtgaatgatttatgatgtatttggagatagaaaatgcagcttgatgtatttggggattttgtgaatgatctgtggtgttcgaatgatttgtggataatatgaatgatttgtggggctcgaaatcatggaagcagcaaggaaaaaaattaaaaaaaagaacattagccccggttgttaactctaaccgggactagatctcccggttagtaactccaaccgggagtaaagatccttctttagtcccagttattttaaccgggactaaaaatgggtatttttagtcccggattcgtagttccggttgcataaccgggactatagggggttgtgaaccgggactaaaaagggtttgtccaccagtgctagctagctaggttatgtgctactgcaccttatgtgccttttttttttttgacaaagcgagaatgcaacattcccaatattccaatattccgagcaaaaaggccgccgcaatatcaaacagtactatctctgtagagtatgtatccactacttccgtacaatccgtctcgataagattaatttgtggttaacgaggaagaattggattgagacgatacagtcagaggcaaaaattatctcctttaatttccctttgcattccttaccatttaaccatagttggtgtcatggggtgtgtgattttcttttttatattacatggtagctagatgcacataccactacacacgcaacaccatactcacacaccttgtgaatgtgtcccctaacatatactttaagagacggaaaccagcgacatatcactgatctcactaaagtcttattgaaagtccatatgcatgtgtgtaatattcttagacattaagattttaaactctgatagatagattcgtacacctacgactctaccaccatactattggtgattcccatggttgtatgattttgggcctttgaggtgtggagaaaaacataaggtagctcctaaatcaaacttaaagttaaaaggaccaaatactgccccagttgacacgtaattagcactaacctggagattaactgaagacccttctcgagaagccggagagaggacatcaaccagaggatggatggagctcaatcactggagattataaacgggatttacgacgatggcgccatggatagacgaggcagctgtaaagaaggcaggattgcttgcgatgatgatgaagacagtgttgacaaaaccgagcaagttgtaattgtgcagacatgccgtgcatgcgttaatcgcgtatacagtacagtttgtttgtccaaagcttggcagagctcctcaagtacaatttctaaggattaatataagagcacggttacacgtactaaactattagacttctactccctccgtttgtaatacatgacaccgttgatcttttgagatacatttgaccatccgtcttattaaaaaaaattatgtaatcatttattttgcttgacttgatttattatcaaatgttctttaagcatgatataattatttttatatttacataaaaattttgaataagataaataatcaaacgttggtcaacaagtcaacagcgcatacattagaaaacaggaggagtattaacattattgatctcaatcaattgatttaactagataggagctatagaaaatttatatgtacttctacagcatggcacatcagtgtttgttagtataggagtttactaaaaaaacaattagatttccgtgtgatatatggctctaaaatatgtcaacatacagctaggtagtcccttttccttaatataaaaaagttgctttaaagtaaacctatttgttgtttggaggaattaaattaaactaataaaaatcatatgagtaaattttctactatttaaaatagaggctactacttgataataacaaatgttatgcaagtaaaggacttcacagcattttcaagaataataacggcttgtgaggattatgcatgccagcctaattttttgctgctactaacaagaacggcgctagaataacggttacggtttgcacaagtttttcaatgctaactcaagtaggaaatgggtgattcatcatcggaaccgtcgaaattcagcaaatgtcgtggacggccagcttctaacattgacgaaaccagtggcggccagctgcatatatgcccactgaattgggcattttgatgcgtcatttacacataagttggaaatttgaagcatatatttccatcagttgacttcctccaggattaatttaactgcatctttaaaatatggtttctgaaaatctcttgcattagaacatcatacatctgcagacaattcactgtttgctggtttgcaggtgatatgatttgagcaagttgcggcgccattgttgactgatcacgttttagcttgtaaaacaaattatgagatggcgtgcgccatagtgtgaggatactgtacaacattatactcatgtagaacagaaactatgtaaaatgacacatgtaatgacttcgtgaatcctaagatatactgatatagtttttaaaggtactcataagaatgagatgtgcatgcatgtttgtatttatagaagtatgtacatctttacctgagcgccagtctttaatttatttccaaaaaaactacgtaaaacataccgagcttatatatgtgcatcaacgtcaatagtcacttacttcctccgttccaaaataaacgaatttaggataagatgtgatattttctaatacaatgaatatggtagaaacatatccagatttattatactagaaaacgtacatcacatcatagtttatgttagtttttttacttcctccatttcacaatgtatgacattctaatattttctacatttatattgatgttaatgaatctagatagatacattgtgaaacggagggagtataatacaggggaagtacttacaacgggagggaacaagaacagtgcaccaaattaggtgaacaaaggtacaaaacgcagtatgagtaaatgctacagtgttgattgcatcagccggtccaaattagattgacaagttcgaaaggaaaaaggatgaaaaatacgagtacgtcaaacatagtggtaagggtgtgtatgatgatagtacatagatatcgatccactacatcaaattacatatttttttccccatggccggcctccgaatttcaggtgttgattgccaaaagtctcctctccacattgctcaattggtcttctcaattaggcagtccaaactgttctgtgactagagtttgaatatcctcatgtgttgcttagaccgatagaagcgaccactcgtctggacctctcgtctcccaacccctcgtcttcgatggccttgccgccgcccgagcaggccaccagcgtgccaagcggctgtgaggaatgcggcagtggggcttcctcagcagggatctggctccgtatcgaaggggcgtcgggggcggtgcaggaagcggcaagaaggtgggcggcggaggcgttgcggtggcggccggaggtggtcgggcctacgtatggccgtgcgagctggtgtcagcggtggaggtggttggcaggtgtcaacgacagcatctcttcgggcggcggaggacgacggcagcctaagcatcgccggcgtatccttagcagggaaacggcaggtttgggtagaggtggactcgttcgcagcggcgtgggagtccgggtggaagacttctccggcggcgacggctaaggccctaggggcagcgctggtccgagacagcggcggcctgagtgccggtgcaaggttcacagtgaggaggaggcggatcccggtggcagcggccgccctaggggcggcagatgcctgtttatcgggtggaagaggttttcctcgatggaggttgcaaaggtctccggtagagccaacggccctaggggcggcgatgagctgggaatccaggaggggaggaggttcacgaagatggcggtggccctaggggcagtagaggcgtaggaatctagcgaagcggaggtgtatcataagtggatcttgttggctcgcgtttggttggctagttttagctggacggcgacggatgaaggtgggctaaactagtgacgtgtggcgtcaactcacctgaagcggaggaagatggcatcagcggagattcgcaacgacgacgcactaggtgtggcggcgactagacgactcacactcgctgaattttttggttctatgttcttctctttcttgagaggatatgtgagtctaaatgctcttgtatttttttggctgtgtatattatttgtggatatagaggccggattaatgaaaatccattatttaaaaaaatgtgttgctaggaccaggcttttcgtgacgaatttcagtaatcatcaggtaatacaatccttatgcccagtgagtgtttaaacacaactcttgctctggcagtcccaaatctgactcaacaagatgaattgttttataacaatatttctgtcacaatgatcaactgctaggacaatattcttctttttagtgaaatgatgccttaccttggccttttgtcccgagaaccagttatcatatatagctaattgccacaagtgaagttttttttttctttttgaaacaccatcctcctgctggatatgggccagttcggctgccattcctgcggcagcagcgcttgtgttgtgcggttgcaaaacaaataccagccgaacatgccctatattaagaagaatgggcctagtctacgagggagaccaaacccaaaaaccatacaaccaaacaataaattaagaaaaccatcaaaacctacacaaagggcaaaagagaaacaacctgtggcgataggactactaaggcacgactgaagacatcgagcaactccgacttcctaagacaagccagaacataccaacaaacccaccaaggagcgggaattactaggcgaagcctccgacaaggaaacaatatcaagaatgttgtcaatgtccgtccatagcaatatactaggttttcatctaaagaagaagatgaaaattgaagccaatgcaaattgccacgagctagtaaagtataaaatgatgacacgaagaacggacatcagaacccctgtattttccattaacaaaaagtatatctgtgcgttaatatggaccataattctaaaattatgtttaccaaaataacaggtggtattattatatataggaaacctccttaactgtacatgtgcatccatcaagctaacaagacaaaatttagttactgctggtgcatcatgcactgtttggacttcttccgtttgatcattaattactgtaacacattactgtgaaatcatgtcagaaaaaacaagagaaaaaaccaacaattaaaaacaagataattacgcttatgtcaaacaacaccaaacatttgctaatcagaagcatatattcatgaaaagtaaacttaattaacgatgcaagttgaaagcatctaccatgactaaaaaagtgagcaatatacagattgcatgcaagtaggactgagcagtaagctctggtttcccaaagaccccaaattatcaggattccataacttgtattcttcccatttcaaaagcactgcggtatgcaagacttcctaatttgaaaacattctcatctgccttcgttagctcagatgtctgcagagacttcccttccaggagcttgtccctcataattgtcaaggcttcaacaaacaaataatacatgccagtgatgacttgtgcacaagaaacatctatactactttaaaaattttaaaagtaggtaatggtgatggcagtaaatctgccaccccgcaaaccccattgcaatttttttgtagattaccccttaaacttttttataataaaaacaatcaaatctataatggtgttggcaatgattctgccaccccaccaatcccattgtaaatttttgtacgttgcctcttaaactttttgataatataaacaatcaaatctatcaccccaccaaccccattctaaatttttgtatattaccccttacacttttcataagtaaaaaaaattcaaatataaatagattgccacatataaaaatcaaataaggtgaatgttcactataaaaataggtaatatatttcaagatatatatttttatttgttttagacaatattatatttaatattttttatctgttacagactgcggacatttagctagtaaaagattaaatcaagaactaaatgttttggtcttctttcacacttcaaccttcggtctgatcctccgacttcctcttctcctccctcttcagcctcttcttctccctcttcagcctcctcttctccgccctcttcaacctcttcttccgcgccttcttcagcttcttcatgttcgaattccacttcacgttactgtccttaagatcgcgttcattcttgcccatcgaatcgggttattcacaattcagatctccaacagtactgaccctaccgatagtatagaaaaaccaaatgtcactcatctgatgcaacattattaatattcggaacaagaaaaacaaaatatcatttcattattcagaccataccctataggcttctctgatttgtcactagcagtaatgccattttcagcagcatgaccagctgtattgcaagaaaattctttctcaagcttggttaaaacttctgctgcatatgcccggatatactcacacatatcatacttcaggcacatgtcagggtcatcttcactcaacaagtaagatagtttcctagcctcctttgcgatccccttcagaacatagttttgaaattagcagcacaaggtttgtcagcaaaaaaaagaataagtaccaaaaaataatacactgagtggcagcttgttcaggtaggggaagtcacatacaaccaaagcagcagcggcaatggcagcatccgattcattcactttacagagcataagatttaaggcagactgccggagacctcattgctgaagctgatcgtctcggtgggatccaactcatgttccaatgaaatgcatatcaactcagcctccatcgtgatacacttgaaaccaccatttgcaataattgatgccagaaaaaaaaggttagtaaacatcataaaatgataattactgtttattagcacttgaattaggtagttaggcatgcatgcgtaccaccaagcctgcagctgcagcagaagattcgccctctgactgaatcatatggcttgcacactccttgatcttggagctcaggatgatctcttcaaccgtgagtgcactatgacagctcctaagcaacttgttctcaatcttgatacactagaaacgtttggttgttttgcaatggtgcaatgaagtttattaattaggaactgaatcaatgaaacaagtaaggtcgccacagtaagtatgcgtttgcagaggcaggaagacattaccaggttggctgcatcatggaggacaccacatccagcaggaggaatgccttgtccctggacagacctgagctgggagcagagagtggcaacttggccagcattgtggctggaatactcctcgaggtatttcttgaattgtggccactcaacagaactagaatggtacggaaacaacctttcccatccccatcctctctcgaaaagatcttgagtagagattaaaaaaattactcagtaatactgtactctccaaattactctgtccatcctaaaatatactccatctgtcccacttgttaaggcgcgatcaaacgtcgtacagtcttcaaaaataatatttgactttaaaattataataacaatgtttgtagcaacaaaatcataatcatatgaaaataaatttaaataacaatcgaatgatattatttttatcaaatgaaattaaatttatattaaaatatttattggtcaaatatttacatagttgaattttaaaatatgtgtatgtcttagtgagtgggacggagggagtaggacacaactatttttttatttttttaatgtttcataatacaatgtatgcatgtatataattaactaacgcctcccctctcccctaaattcattttttttatcatttactctcaacatctctaatcccgttaagtgcatacaatgtacttgatatgattcaaacgagaaagataatagtaattattttttgtttcttatgttagtgatggttgtaacttatatcttgggaggaaaagagtaaagtacacggtactctccaaattatagacccaaaaatacatcatatctctgtcaagaagaaaaaaattccaaaaaaataaaataaaaatctcttctctagatggattgaatcaggatccagcaaaaaggcaaaacattgaaccaagcatacatataacatatatccccaaccgtagagaggaaattcgtactacctggatagtcgatcaagaacaccggcggtgcgtcgagcagatcggcggtagtctcctcatcctccttgtcggcgacccactccaacgccatggcttcgcacaggtattccacatcacgggggatgtaggtggcagtgatgggcacctctgatgacttggtctctccattgctactcgcatctaccaccatggatctcctcttccattatagagtttcgtggatggattgtggggggcgaaacgcggggaggttttttttctttttgaaatctttgatgcggggagagtgggagacgcaagagaaattggacattaggccactaccaatagtgggtttcatcacaatgctattccgcggaatggcgttgttaaaatgccactcacaacagatgccaaacatttgtttttgccatttaagccaattctctccatgtccacctaattttccacccgggctgactaaaatacccctccggctgtcacaagcgagttgttcgtgccgccggcgcccgcaccgcccaagctcaccgccgatgacgtcccgcccccatggctgaagcccgctgcccacacatcggagaaagagaaggaaaccctaagccggccactgcgtcgcgtgccacaatctcctccgtcgtcgcgcccgccggccaccgcgccgctcctctcccgctaaccaccgtgcgccgctcgccaccatctcctctgccgtcatctccaccacatgccgcaggctgcacgccaccatggcccaagaaggctagctccaggaggagctcgtggtaggacaggacctgcgttgccgtcttgggctcagtcggcacggtgactgtggtggggatggagatcaacgagccggtgaccaaggcggcgggaggtgagccgaagccctcacgctcatcctcgctagctctccggattgtgtgtggtttgagctcaaagattgtgttcttgaatttgtagagcaagaggaggagccgagctccgccgagcctgaggttggcgccacccctgccgtcgtggtcttctcctcatcccacatgttcgccggagaagagaaagaaactgtaggagagaggggtattttggtcagttgaagtgcaaggaatggtgaatatggcaaagcaacggcttggtatcggttgaaagtggtattttaacgacgccattccacggaatggcattgcggtgaaacccactcttgaaagtggcataatgtctaatttctcgagacgcggagcaaaagcagaggacgctctctctgggccgggcagcccactggcatggtgagacacacaagacccagtaagcgccatgtctctctctccctgctttgagaggagatgtcagatgaaaagagaagatcgagaaatacaaaatagtgcatgaataattgaatattaactattttaaattttaaaaatagattaatataacatttttaaaaacaactttcctatagaaatgtttttttaaaaaaatacatgcggagaacaaaacaaatctcctctcaatcttagctgccgaacgcagtagtcagctatacaagtactattttcttttgaccggcgcaatcaaaagcaccgttttcctttgttcgagagctgaagaaaatagaagattgagagagatgaaaatcgagctgagttattagtatatgattagtttagttgtatattaattaatctaaacttgaaaatgtattaatacgattttttaaaacaatttttctattaatatgattagtttgaaaaatacgcgtgcgaagaacaaagtatttctcctctgtatccactgcaaaacaatacagccttagtatgacaaattatccgtcatcccccatccgatggaaaaacatctctatctccaccatctctactactttaatttaaatgtgtaatcctttacccgaaattgctaattggctcatacgcgctagataaataactaacgcgcgtttcagttttggcatatcattagcaaggccaaaggcccaagcacacttttaactttatgttttttcgtctgacggcgccagcatatgcacgtgctagtatagataggaattaacacaaaggggcagttgggcaagtgaggcaaatcaatgtacaacgtgattaccgctataattcttcattattagttttaatttttaattaggtgacgtgattaatatgagcactcatacctgaaaattttcaacctgtttttaaaactttcaacttaaatataaaaatttcaactcaaaattttgaaactttcaacataaattttgaaactttcaacccaaatttttgaaaactttcaactgaaaattcaaaattttcaactgaatttttaaaactttcaaatccatattttaaaactttcaagtcaaaattaaaatctttcaacgcaaattttgaactcgaatttgaaaatttcaactcaattatttataactttcaatttatattttcaaaaactttcaactgaaaattaaaaattttcatccaaaatttcaaaactttcaaatccaaattttaaaactttcaaatcaaaattgaaaactgtcaactccagaattcaaaaaaaaatcaattccaattctagaactttcaagtctaaaattcaaatcttttagttcttaatttcaaaagtttcaactccgaatctaaaatttaaatcttcatgttagatagtactccctccatctatttttgatagtcatatttctaaatctgaaaaatttatttttgatagccatatttcaatccaacaccctatcattttaatgactttctcggattcaatgcatgactctccattcttccacacataattggttacatgggcattgagaaatgtaaatattaatggatcgcttgtttacgaggaatgactagtagcatgtttaaatggatgataagtagaattacttatgtttggtctgtgtgccaagatgaaatattactatcaaaagtagatggagggagtatttattagcgttaatcatgtcattaacgctaatcacattattagcattagtagagaggggcagcttacgcgggttgatcggaggatttttatttttgtcgctaacaagaacgggaaaatcgccaaaagggtaacgacaaatcaccgattcctctgctccacgcgctcgcgacttgatcttccggcacgtgcgcattaggagcccccatcctttaccatcattgtagttctcccacacaaagaaacgtctcgaaaaaaaccatctcatccaaaaaaaaaacaacaatatttccacgcaataatcaaccagaaaaggatagaaaaaattaaaccttataattcatatctctcttctggcccttatgccactgtcgcatccatcctctccttctcatactgcaggcgcaaccaatgcacgaatagaacacatgcattgtattttgaattgatattttatttggtatatatccagaattaattttcaattggtgccggatttgagttttccaattggtagtgttgttgcaagaactcaacaagtgtatcaatttcccttccctctattctctgccctctatgggtgatatttacacatttatatacatggatatacaagaggaaaatgcctcggtgtccctatgccttacgatatgcctatgcgactggccggtgggccagccttggtcctagtggtaacttggtggaggacaggagagctgccccggtatgggggcaccactgttctcgaggggccttgctattacctaggtaaaggcatcctccgggtaatagcgtgctccgcctggcagccatcaacagtgtcagagttagttggggcgcgtagtgcgcatttattcgtgcccgctagcgcttgattcttgacttggcatgcgagggcatatcgaggcatgattcactccggccggcacactgagctcttcagacccctcggaggcccgtagcccttaggttccctccggagctccccttccgggctccgggttcccctctgggcttcggagctcggtcatttggagtggcaccggagcccgtggcgctgtgacctcccggagctcctccggagccgatcagccaccatccggagcctgcttaggtctcattcctctcgcccccaatgagatccgattctcctggatctccggaggcctccggagcgagggggccatccgcgaaccgacatggccctgattcatggtcatctcccggggaggaaggttctccggagcgctgcagcccttcggaggctagcgtctcctgatccggagatacttccccaacaggtagcaagatttaatttgataaaattttcaattactatcaagaatttgaagttgtgcgtgtcggtttcaaattggtatatcatatacacacagcagaccccacaaatgcaaaagatagggggagctctcacatttcttacaaatatgtacatattagtttcacctcacatgttagtatgcacacatttaagggagctcaaactcaccctttggaaagtaagttattatcaatctattcataagccttaatcgtttcatcatcaatcaatgatgcaaaaaggtgaagatttaaaatgcatctaggccctccagtggattttggctaattgataaaaacattccatcaagattctacttatgccgataatctagattcttccatagatatatctcctttaaccgagagaatggtgtatttgaataccaacaaacaactatgtagcgtgtgcctagctttaccaacacgatacccataaattatacggaattaggataacaagaatgaacacaagcccaaatttgctctatcatggctggtactccctcctttccaaaatataaaacataatcacccttaacctaaaaactaagaaacaattattatcatctctttgtttgaatcaccccaattaataccatacatacacccaatagaattaaagatcttatgagtataggatttaaaaaaataataatttaggtcagaggagatgctaattaattgcatacatacatgtatgacttatattataaaccaactttaaaaaatagttgtaccctatattttgaaatggagtaagtaattaaggtcgtgttggcccgttggccttgcaggcccacaccaaattgaagttacacacgactaacctcaatgattcgtcaatacgagataccaaaggcattaaagatgtggcgtggcccactctgatattctcaattcaaattaatacatgtcttgacgattctaagatatagtagatccaataatacataaaaggaccataagaccaatacacagaaaggaccatagagaaccaatatgtagaagggcattggcccgatctgaaggaaatttacggttaactttaaaagtgagcggcttgtggggtccaattgcaagatttcaatatccggccagttttaccaccaaattaattccgtataagaattagaatttacataatcatgaattggctaaggatctgattatataagttttggaactataaactctattttactttttctggacagaaatattttcagaatacactgggactgttaattcataacaaaaacactggactgcaaaagggatgagaaaaaaaaacaaactttgtatgcttaatgtaggtaatatccactacatcagattacaaatttttttttcccatgttacctccgaatttcagatcttggttatctaagtgtcaaaacattgttcaaccggtgttctgaatgagctaattaagcgcactaccattatctgtctccactccagtttgcctacttgacaccaacagtttgaatatccttatctgttgctgggagcaggctttccatgacgaatttcagtaatcactaatccagcatcatgtccaatcgcaactctgcaacagtaaggtcgtttcaaaaagaactctgaattaataaagaatgcagagcacatccgtaatgcatacaacgtaccgatagagttcacatgccacatagaagaagatgaaaaacatgccagttacaaatgttaaaaggagttcataaggaaaggtgtgatgacagtttttacacaaatagacaattgcagaaaagacagatcatctacttcataactcaaaaaatgagctgttctgatataaagtaagatctttgaggaatggataaattttaatttcaacaaatttaccgaaattcatgttctcagtcaagtttattttaattttacacttgcagaagttgcagggaagcagtaacattgtcaacaacataacatcaagataaatagtagaatccttttaatcactcaccgttttgaaccctttaagcaaactatagcagtaactttgccgagctcaaagtccagtacaccttccagcctagaagattatggaaaacagtgtcatttctgaaactttttggacatgaaaacatggcaagatcacatctcaaccttatgaagttgtgttaatatgtaccgcaaattaggaacttacttgaaggtagtggcattccacagacgaactgtctcatcatttgaacctgtgagtaggattggcagatctggatgggaacaaacacaggtgatacaatccgtatgtccttcaagtgtttgaacacaagtccttctctgacagtcccagatctgatcagcaacatgaaatgcattagaatgttacttccgcaaaaaacgatcaagagataccacaatattgttcttcagtgaacctgtcttaccttggccgttttgtcccatgaaccagttatcatgtacagctgattgcctcgagtaaagaaatcaaaacaatccactatagatacatgcccagacagtgtgaattcatgacgcgaagaacgtatattccaaacctgtattttttttccattgacaaaagcatacatatatttgtgttaatgacctaaattctcaagctgtatttaccaaattgacaggagggtacctgagcatccatcaagcttgcaacagcaaatttatgtgtatcttttgggttaaatttgatttgatatgctacgccatgggggtcaaatgtcctgatacactcccagtccttgttccagtcccacagcttgatctggtcttgtgagcctactgacagtaggtaaggctcagttggatggacatccaaagttgtgatggtccaactccaagcatgagctttgaatctcttcacttgctttactggggactcatatgtgtaaactcttatgaaaccatcgtgatgtccaaccacgaaccattgctttcgcgcgatgaacttggctgcagtaactgtagtgttggagtgagtaaatcagttagcattgctgtggcacatgtacaagtctatgcatggttagtagtgagtcagaagcatgcctattggtccatatgagccttgaatcaggttccttgtttcctgtggacaaatatatgggcaaatattagtccttgaacatccaaaagcatatttcaacatgctaaaattgtaggcatggagataactttcaatgaatttcactcacataggcaaactttacaacttataacttttttgttgtcattggcagttttctaaatttatagcgggtagtatatatgcttttagacaacagaatatgtttcttttttttttacatcactggcttctatatcagaaatatacgcaaatacctgtcccaccaaacaaacatgtaactagccgattactggacaaaagtttacgtctaaatatttgaattaaaaaaaaagttacacaattttttgcacgcctgctaggacctcacactccatgtgtagccaccttactttctcacatatgaagcagtacctcatgacaacgagataaatgttgttcatttgacttcacctctccaaaacttgtagtgagtatttgatagtactgtacaactttgagagcatgtctccatcaacagtatttgaaaaaaatgaagaaaaatgttttttaaatagaactaagagctcgtgaagaatatttgattccctagatgaattcaaataaaaataaacatttaactagaaagtttaagatatcatcgagagctataattttcgtacaagttttcttttcatctgacgtaatattaaaagctgtaattttttattgaaatgtggccattccttaagagaatcgccgatgaaaattgaactttatgggtggcttcttaagagaatcgcttatgaaaatgttgtattttgttccaggttatttccaaagaaaaccgcatgtgaaattttttcccttattatttgaaaatgacttgattttgaaaattaatagaaaatatattttaagtccaactaaagtgacccaaagctctctgtgatacttaatatttcctttaatatgatcagatcaaaagtattctaatatggttccttacttattaaaagttacctctatgtgagttgacatattatatatcttaagtgaatgactatatccaaggaaatattgaccacatcttattaaaggaaatactgtaggggtctcagataatttttggttcacctcaatcagatttaaaatgattttaatgtgaattttgaaagtttggccactttaaaagaataagaaaaaaaaaggatatgacggttcgtaacgaatgtttgagacattaaaagatctcaaatgaaaaaacatcaaactacaaaattgtattttccgtaaagagatataattataatataaagtttgttctcatccacttcataagaaaaaaaagtgattttttaaataggacccttgccatttttataggcggttaacaaatagatctgagaccttatgatgaatggttgagcccctaacaatatcaatatcaaattaaggcaactaaaaagttgtacatattgtcaacagctaaacttttcatatgaaaagattgttctgatccgacttcatacggaaagattgcgattttgtttacggaaaaagagtcatttcctttttataggcagttaataaatatatccaggaccttgtaatgaatgtttgagctactaaacaatctcaaatgaaaaaaaattcaactacaatgtagatctcattgggagctataattttcatataaagtttattctcatctaacttaatattaaaaaaatgactttttttattaaaatagagttgtttacatttttacagttagtttcttaagagatcagtccatgaaaataaatttttacaggaggtttcttaagaaagctgcaaattgaaataaattgatgtactacctcataaaatcacctaattttcatagacggttttcttaaggaataatatgtggaaatgtgttttaacaggcaattttaaactataaggccaggcttcttgccattattccacctataaaataaagaaagggtgcccacgaaaatattttttaaaagtagtgattgaaatgggttttttcttatatgatccttaaggaggttctgtgagataccataccattttatttttacatgtgcctttggtattttccttgtatagcggtagcacaaattaacagtaaagtagcatatgcagcttaccaagagtaataacttacaagcgtattatagttcaagatgtcaactgagccaaacatattgctcgtcaagatcctgtgtacataagaagaaatttacttatagtaaaagctatagtaacagacattttacagctgcttcaaaaaagatagaaatgtagtagtgttcaaagaaattaaaagataaacagatatctggccctgattttgtggaccctaactttattatagaataagcgcataaccaagtaaaagaacttacataaggaaaaagataatgagaaaacatgaccattgttttagtcatttctcctctacttccctttttcaaaataaaaaaaataaaaaaacataaccattcttttttagaattaaacataaccattgttaaatcaaaatttacgtatcagcgtatgttcccacaaatttttatttttgttttaggtctaaaataatatgggatcatgctaattgccaagtgtagttaacatgaaagtagtgaactaatacacgaacaatttgtccttttcttttggatataaacacaaatcttcgtttcatttgttattatggaaaaaaaactagaacatatgcagtttatctcctcttagaaccaaaaaagaaagactattcacataccatggttccgatggatgcacatctattggaaaatcaggatgttccattgggatgatctgatcaaatgacacatcgactgaagttaacgaaataataaaatgaatgggttttcaaatgttataaaagtatgcaacatgcatggttttggtgatacaaaaacaactaaaacttatttcacctgatcttcctctcggtcctcctctttctctttggaacaagaactgttatggtgatcggcttcatgattttctttggtctcatttaagttcaaatggcttggcaatttgctctcaagagtgacagactcgttgttgtgtgagggtagcttctccaaggcatggtctatcggcagctaaatgaggtccaaattaatgaagttaatagaaattctatcattggtgaataaatatgactttcaaatatatatgcatgttttcctctctgagaaaaaaaatgtaaataattattttgtagtatatagttataaaattgtacactcagcatcgcaggcatgaaaaatgagcaatagttaacaaggttggacctcgataacgcatattaaattattaaatagagcttacttcacatgatttagagcaggttagatggtacaaaactggaattggtcattccgtcattacacttttgattccctaaaaggattactctcatcaaaatgcagttccaagatgtaggggaaatagtgaaacagaggttgttgattcatggaaatcactaatgaaacaaggaatatattgtgaaaatgaatgtaaactcatcccttgatacattatagtttttcttatcaaatagatgacaaatacgataatgccacatcggcataagcaaaatgattcctctgcattatattcctccaggaagaacattgcgctgtagccttttataaacaaaacacacgatagtaataattaattacctcaccaatgatagcttctttctcgttaatttgattgatgatttccactatattaggcctattttccctatcagtctccatgcatttcagcgctatctcggtgcatgtcttcacttgctggcaatatgcttccagtagggaaccattccttcctgtctctaacctagttttccaattccctagtacctgtgcaatcagaataaaagatgaagtactattcaaacgaaataaaatatttcctcagttctaaaatgtttgatgttggttagttcatttttaactaacaaacgccataaaaaaataaacagattgagaagtttagttagaaataaatagggagtagtttagttagaaataaacgttggttctgaactcctgattacttgatcggtaaattcttgagaaggaatttcggtgcttctgaagtgtcctgtaggtccaggtccagcaattatctctagcattacaacgcccaagctgaatatgtctaacttgtttgatatttctttcctctctatgtattctcgtggcaggtatgggctgcacggggacaaataatatgatggatttcatataaatcacatttcttattattagaaaaggatacattcaaatgagttatatattcagcttacattgtcccaacaagagtttttgtagtcatggttttgtctttagtgatgaacctggacaaaccaaaatctgcaattttcggcaccatgttgttgtctagcaaaatattggcaggctttaggtccaaatggtaaataggtggcttcatttccacatgaagatgttttaaaccctcacatgtccctttaataattttgtaccgtataggccaatcaagaccatcaactttatctgcaaaggtaaacaaaagatatatcaatagaatgcaaatacacatgactaattttcttccgagctgaatatgtactccaaccagtttcataatacttgccgagttgtcattttggacaaggatgtggtctaaaataaaatttctaagtcaaacttattaagtttgaccaagaaatatagcaatatttccaacacaaaacatactatcaaaatatattcaatgttagatttaataaaactaatttgatgttgtaaatgttgttatatttttctgtaaacttgatcaacctcagaaaagttcgacttatgaaaaagtcaaagtggcttataatatagaacggatggattataataaatatataattttattaaagtatctttcaagattaagctatacatatattttccatgcttcttaagtaaatattttaaaatttattcatagtcaaagttcaaaacattttaacctcggccttatccaaaacgatagatattatgaaattaggggagtagtgggactttgagcaatatcataccagaaagatagttttcaaggctcccccgaggcatatactcgaagcagagtgctctatgtattgttgcaaccaaaactggtcttcctttgacttgtccatgtgtatgttttatttcatagcagtatccaactaactgtacaatgtttggatggttgaccatcataaggttcccaaactcattttgtaatttcttgtcgtcaaaatcttgcgtatcatgaagaatctttactgcaattttatctccatttttatgctttccctattaaagatctagggtcagtactcaaaacatgataagtttgtgataacatttcacaagccgaaaatgaaagcatcaggctctgtttgttttgtcatcacacttttactagaactaagtttcatgcaacaataaaatgtggtgcagggttgattgctcacctcagtgttatatgtgcatgtattgcaggcttattattatttagaaattagaacccactacaatggtttcaccaattattcacagtaaattggtgtttacataccaaacttgcctttaacttaccttgtaaactgttccatatccaccttcaccaagctttcgctcctcagagaatccatctgtaatttcttctaacaattggtatgctacattagttggattcatagctgaatttgtaacttgtccgttttaccaatatctcctctctgtgtgatgagaataaagagtaataagtttctgagaataaagagtaataatttgggtaattttactatgcttgataaggtactgggagatgttatattttctagtgtcaaacttgatacctccagctaccatatatctcaaaataataaaattttgatacttacaaatactttcttaaataccgtaaaattttcctaataatttactcgttttatgagaagagaaagactggagttaacagtagcactctaaatcttgaactgaaatttctcaaagcctggtttatggcattgactaaatgtgaatgaagggattaaagaaagttcaaaatgagccccgagatatgcatcatttggagaaaaatcaagtgaatttcgactagttttcttactcccaacaactcacttcggaactcatagccacggcaatgtgtaagaatttgagtgagtactagtggagaaaatcctagccttgtattaaaagggaaaaaaaaggaaagaaaaagaaagaccagcaggccaagcttgcttatccatcaacagagacacaccatcagtaaccaacattccatcagaccaatgtgaatcatgaatcaaatgtaaaagcccaagctaattaaggagcaattgaacaaacagtactgcctgcacaggaattggaagcagtaattaattaattaattagcactaacctggagagagataactgaagatcgacctagctttcgagaggctggagaggagaaagtagagacgggatcaggctcaactcaatctatcgcaggagatgagatgaggagatgattataaactgcagtttacgccggcgccgtagacgacgagccagctgtaacgccggattgcttgactgattgattgtaccttctgatgatcagttcatggaccacgatcgagcaagttgaaattaaggacatctagggcacgcgtatacagtacagttatcttgtccaaacctgcatgcttattctagcttgctattccctcaagtcccattttaagtatagttgtgggtttctatgtccaatgtttaatcatttgtcttatttaaatttttttttaaaaaaaataagttaagcataaagtattattcatgttttatcatctaataataatatagatactaatcataaaaaaatttaaataagatgaacggttaaacgttggacaataaacccacaattgtatttaaaatgagacggatggagtacggattagtagtggtcattggccaagaaaatccgtagtgccaaaggatgagatggctaggtggggataattctgttctctatggaatcctagatttgtcaccaggtgtacctttttgttttaggaataaaaaccactcctgacaagtttgccgaaaacagaccgacgtctgatggaagcagtaaaaaccgatgacttttgatcaaaataattacccacagcccaacattgcatggctcgtgagttgtgatatatacagggcccagggacagggacagagctagaacgaaatggtgaaggatggcacttactttactctactttagactaattttagactgatatgaacacttgagtttggattgaggtggtgcatatatgatgaaaatagacgaattatagctaaaaatattttcttgatcagatttctaggcaccccctcttctacctagcttcacccctgaaaatatggcaagcctaatttactctgctgaaaaaggacggtactactatcagggacgggagatcatgattttagaaatacctcatggtttaagccttaaattgaaaaaatatatcttatttaatttttcatcgataagatattagtgtaatgtttgaataccactatcaaaaattatgtgcccgctctgatactactaagaaataggaaaatgcatatcacattcacatatggttgcatcggtgctgctactagtagctagtggaagttgaccgtcgacgttgagcaaagcgtgtgggctgcaggacttggattggacggtccaagaagacgaccggcctaacataacagcgactgcagcagcagccaacaagcagctgctctctgcagcagtgtgtacatacattcaaaataaaacaactgctgtaggattttgggctgcagccgatcggctgggctggacagctgcagcccaaaatgccgcaggcagctgaaccgatcagcccttgtattaattggatgggttgggcctattacttactccctccatcttaaaagacagtcatgagttttttgtctaattttgatggttcgttttatttaaaaaaaatagtatttttgttgttattagatgataaaacataaatagtattttatttgtgacttatgttttttaaattttttcaaaaaaagttaaataaaacgaataattaaaattgaatacggaaacttatagctacgcttaaaatgagacgaagggagtagttggaagtatctgttgacttcctatttacctcacgggataacttctttcactgattgaagggcttgtaatggcttactacaagagacacaaaggtaacctcaagaagaccgtcactagctgcaactaatagtatggctacttgtcgaataaaaaaactaaagaaactggaatgtccgaataccattcgtaacccaaatcaaagaactcgaccccaggttcattttcccttgccttttccttaaatactagtatgattttgaggaagaaattttgttgtaatctgtgatcacttttgtatttgagtatcatacagatgtctatcagaatctctgctaccacaaaaaaaaactttagtggtggtggtgagtcgtgaacaatccaacggttgaatattttcctaggatccttgtcatcaccgcaccagtcaacgcccctcccagagccatgggcggtggaaatcctagctcccaaagttggcgtcattgtcgcaggcgccaccgctgtcaccgcagctccccgcaccggatctatcatcgtcaaggtcatccacatcgctgaggtcccagtgcctaatccgccgccgttgagctccccatcgaattcagcgggtcccttaaggaggcgcttgcgaaaatcagattcttacatatggcttcttatgaggcccacttgcgaaaataactttatttttatgtatggtctcataagatgaccacattttagcaagcgtgacttgacccaccccgggtaactgattgttgcatgtggacgaccattacagctcgcctagaacctgtagtgggcctcgtccgcaaaaatcaattctgttgatagatatagaaacaatgctctactgaagtacaacttttacatacacatatgagctaactaacaggagggccaatgggtgcgttgttgataaatacattatttttccgttgcaagagcacccagaaatacaccatatctctgtaaaaaagaagttctaaaacaaataaaataaaaccgtagagaggaacccgatgatatataaaatcaaggaaacttgtcctacttgatactagatgaagaacaccgacagtgcgtcgagcagatcgtcggtgatctcctcatcctcctccttgtccacgacccagtccaacgccatggctttgtgcaagtcttccagatcacgggggatgtaggtggcagtgagcacctcctctgacttggtctctctatcgctactcgcatctgcgccaccgatctcctcttccattctagggtttcgtggatggggtcgaagcacggcggggggttagggaaagcaagttttcgaaatcttgacacgaggaaagtgggtgggagacgtagaagaaaagcaagggactctctctctctgggccggaccggtatggcccactagagtagcgagacacaaggcccaataagcgccaagttttttctttctctctcttcctctcttgatcgactatggaaatcaaagcgccgtttgttccatttttacatgcgcaatcacaacaatgtttattttgctttagggtaagtacaaatgatatggacttttagttaatactcatgtagaggatatcattctacaataattgagacaacaaaaccttttataaccattaatgcaccaatataatcttttattactcttctttccttttcacaaccccaaatgtttcctttaatatatgctaagagtcgattgtaagccatgattatacatagcaatgatatttctcttcgttttcttctctcttctatgttaccaaatttatttgcgtggcaatggagagagaccgtcaataaacatcattgtacataccattaagatgatggaaattatccttcatcaccaatctgatggaaaatatatctctctatatctctacttaaaaatggagtcatcatccttcagtcatatccttccaccgtgtgcatgcacgcgtgtgtatatacatagccattagatctaatgttttattcacaaccacacttatatggacctggcccgttacaacgcaggggcatgttgatagtatactaagtggagtcgtcttttccccaacatcgtactttcgcaaataaaagacttgctaaaaaccatctcatcttaaaaaaaacaatagtgttttctctactccttttaaaacagagttgttttcctccttcccaaccatcttagtttcccaaataaaaaaccgtctcaaaaaaccacctcatccaaaaaatacaacttcaaaaatggagttgtcttcttccttccccacaatcctactctcctgaattaaaaaaaccatctcaaagaaaccaccttataaagaaaatgacaatgttttctatactactaaaaagtggagtcgttttcatccttcccaatcatcgtagttccccaaataaaaaaaaccacctcatccaaaaaagaaaccatatttgcacgcgaaaatcaaccaaaaaactagattaaaaaaacaaaaccctataattccaatctttttttcatcccttctcccaccgcacgcgtagcacatccatcctctccttctcgtattgtgtgcacaaccaatgcatgaatagaccacgtgccatgtcttttgattttatattttcatttggtatcaataatttggttttctgaattggtatcggatttgagttttttaactggtatcaagatttaatttgatattttttttcattagcataaataatataaagttgtgtgtgttggtttccaattggtatatcatgttacacacaacacacctcatgaatgcaaagagataggaggagctctggcatttctcataaatacgtgcatatgagtttcacttcacatgtccataataacatttaggaggtgctcaaactaaccttttcggattcaaagtcaaatattatcaatttgtttgtaaactttaatcgtgttgtcatcaacaaacaccgtaaaatagatggaaattgcaagtgcatctaggccccatattggattatggctaattgatgacaacattccatcaagattctacttatgctggtaatctgaattcacccatagacatatccctttaactgagagaacaacatatttgaataccagatgactccgtggtgtctgcccaactttatccgcacaatacccacaatttatatggagtagggataacaagaatgaacacaagcccaaacctttcgctgtcatggctggcaagaaattaaagtcgtgttggtccttggcttttatgggcccatgctgaattgaagttgtaccgactaatctcgaggaccactcgtcaatacgagataccaagggcattaaagatgggtctttggctccattggtggtgtggcccactctaatactctcaactgaaattaatgcatgcttcgacgcaatccacaagatacagtaggtccaatacacataaaggaccatagagaacaaatatgccttggtacaatctgaaggaaatttacagttaactgcaagagcgagcgggttgtgtggtccaattgcgagatttcaatatccggttagttttaccacaaaattccgcataagaattagaatttacgtgatcatgtattggctagatctgattatataagttttgaaactataaactctgttttatttttgctcgacagaaatattttcagaatatgctgggactgttaattcattcaaaaaagaaaaaaaagcactgggatgcaaaaggaatgagaaaaaacaaagtttgttttcttaatacaggtaatatccactacgtcagattacaaaactttggttatccaagtcttctctccacgttgctcatttagtcttctgaatgagttaattaagcgcagtaccattatctgtctccaatccagtctgcctagcttgacaccaaccctccaacagtttgaatatccttatctgttgctgggaccaggcttttcatggcgaatttcagtaatcactaatccagcatcatgtccaatcacaactctgcaacagtaagatcatttcaaaaagaactctgaattaaataaagaatgcagagcacatccttaatgcatagtgcatcatacatctttgtagtcacagaagaagaaaaaaacatgccagctacaaatgttaaaaagagttcatatggtaaggtgtgatgacagtttttacacaaatagacaattgcagcaaaggcagatcttctactttaaaactcaagaactgagttaacaaatttgaggaaaagataaattttaatttcaacaaatttatcaaaattgatgttttcagtcaagattattttgatttacacaattgcacttgcagaagttttatcagggaagcagtaatattcccaacaatctaacatcaagatgaataccgttttaattactcaccgttttgagcccttcaaacaaattatagcagtaacttgtccgagctcaaagtccagtacaccctcaagcctagaagattatgaaaaacaatgtcatctctgaaactttcggacagaaaaaacatggcaagatcacatctaaatcctagaagttatgtgttgggcgcagttagatgtacttacttgaaggttatggagttccacagacgaactgtctcatcatttgaacctgtaagtagtattggaagatctggatgggaacaaacacaggtaatgcaatccgtatgtccttcaagtgtttgaacacaagtccttctctggcaatcccagatctgacataacaagatgaattgcattgcaataatatttccaaaaaaatgatctcaactcctatgaaaatattcttctttagtgaagatgccttaccttggctgttttgtcccaggaaccagttatcatgtacagttgattgcctcgagtaaagtaatccaagcaactcactatatatccgtgcccagacaatgtgaattcatgacgggaagaacggatattccaaacctgtatttttttttcattaacaaaagtatacatatgttcgtgttaataacctacactctaaaattgtgcttaccaaattgactggagctaaacgaaaataagaaataaaaattcattgtacctgtgcatccttcaagctcgcaacagcaaatttatgtgtatcttttgggttaaattttatttgatatgctaggccatggaggtcaaatgtcttaatgcactcccagcccttgttccagtcccacagcttgatctggtcttgtgagcctattgacagtaggtaaggctcagttggatggacatccaaagttgtgatgttccatacatgagctttgaatctcttcacttgctttactggggactcatatgtgtaaactcttatgaaaccatcttgatgtccaaccacaaaccattgctttcgcgcgatgaacttggccgcgataactgtagagatggagtttgtaaataagttagcattgttgtgatttgtgacactatgttaaagactatgcatgatcagtagcaagtcatgaagcatgcctagtggtccatatgagccttgaatcaggttcactgtttcctgtggacaaatatatggggaaaaaatcttagttcttgaacatacaaaagcatatttcaacttgctaaaattttaagcatgagataacttatgatgaattctatttacagtgtgtatagtatatactcccccggtttcatattagttgtttcacttttttcttagtcaaacttctttaagtttgatcaaatttatagcaaaatatagtaatattttcaatacaaaacaaacattgtatcaaaatattttcaatgttaaatttaataaaactaatttggtgttgtggatgttgctatttttttctataaacatgatcaaaccttaaaaactttgattaagaaaaaagtcaaatgacttatagtatgaaacggaggaagtatatttttaaataacaaaagatgtttcttttttacatccatggcttctttatcagaaatataaccaaatattagtccctcgagaaaacatatatctaaatatttgaattaaaaaacaagttattgagaaacctaggacctcacactccatacatagccactttactatcccatgtactatgaatcaccttgttttgcttacaatatttctattagtatggttattcagttatgtcaagttacctctatgtgagttgacatattatgaaactagatattagtgaataactatattaaaggaaatattgacctcataacattaaaggaaatattgtaggaatcccaaataactttggttgacctcagtcagaattaaaatgatttttctaagaatttgtaaatatcaagcattttcaaagaataagtaaacaaataataaaaaaaggatatggaggcttgttacaaatgtttgagcccttaaaagacctcaaatgaaaataaaaacattaaagtacaaagctatctcaccgagagtcataattttcatataagtttgttctaatccaacttcatatgaaaaggttgtgattttttttttttggaatatgattgtttccactttttacaggtgattaaataaatagatttgagacattgtaacaagtgtttgagcccctaaacgatatggaatgaaaaaacattcaactatatcgttgatagataaacttttcataaaaagaatgttgttttcatccgacttcatataaaaagttatgatttttttttcattgggatagggttgtttccatttttatatgcggttaatagataaatatgagaccttgtattgtaatgaatctttgagtccctatatgatctcaaatgaaaaaaaaatcaactacaatgtagatttcgtctagagctataattttcatataaagtttgtctgacttaatatgaaatagcgaggatggcacccacaaaagtagttttttagtagtgaatgaaatgaggtcctttttcctgatccttaaggatattctgtgagataccacaccagccattttgttttaacatgtactacttggtattttcctagtatagcggtagcacaaattaacactaaagtagcatatgcagcttaccgagactaaacttatacctgcgtattacagttcaagatgtcaactgagccaaacatattgctcgtcaagatcctgtgtacataagaagaactttacttatagcagatgttttacagctgcttcaagaaggaaatatagtagtgttcaaagatagtaaaagagaaacaggtctaacctgattttgtgtaccctaactactattgtagcataagcgcataaccgagtaaaagaactttcataaggaaaataatgagaaacataaccattgtttaagtcatttgtcctctacttcactttttcaaataaaaaaaaacataacaattgttaaatgaaaatttacacatcagtatatttccccataatttttatttttgtttttagctctaaaataatatggggtcatgccagttgtcaagtgtatttaccatcaaagtagtgaactaatacacaaacattttttccttttcttttggatatacacacaaatcttggtttcgtttgttattatggagaaagactagaacatatgcagtttatctcctctcagaccccaaaaaagaaagactattcacataccatggctctgatggatgcacatctcttggaaaatcaggatgttccattgggatgatctgatcaaatgaaacaacaactgaagttaacgaaataataaaatgaatggtttttcaaatatgataaaagtatgcaaccggcatggtttcagtgtaaaaaaacagctaaaattaatttcacctgatcttcctcctggtcctcctctttctctttggaacatgattcgttatggtgatcttggttttctctggtctcatttaagttcaaatggcttgccaatttgctctcaaggttgatagactcgttgttgtatgagggtagcttctccaaggcatggtctatcggcagctaaataaggtcaaaattaatgaagttaatataaagagtaaatttcataaaaccctacctattatggtccaagtttcacaaaaccagatgaactttggcacatggcacataacctcaggtgttatggtcttaacgtttcacaaaaccacattactaaccattttgactttgatctaccacacttttgagttctacaatcgcatctcaaaattatgagcattttatccatcatataaatgttacaaccgcctttactattttgatgtagcaatatgtcaaaatggtaaacggtatggttttgtgaaactttaggaccataattcctgtggttatatgccacgtgtcaaattttatgtggttttgtgaaatttagaccatattagatagagtttgatgaaatttactctaatagaaatgctacagtcggtgaataaatatgagttcaacatatatatgcatgttttcctttcagaaaaaaaatgcaaatacatgtttgcgatacctagctatgaaattgtacactcagcatgatatgaagcaggtttgatggtagaaaactggaactggtcattacacgtttggtcccctagattgattactgtgataaaaatgcaattccaagacgcaggggaaatagtgaaacagaggatgttgatttgtggcaatccctaataaacaaggaatatactatgaaaatgagtgtaaactcatcccttgatacatcataattttttttgagtaaatcattatattatcaaatagatgatgaatacgatactgccgcatcgacgcaagtaaaattattccactgtattcgtttatgaaggacattgcactgttacctatttataaacaaaacacatgctagtaatgattaattacctcaccaattatatcttctttctcattaatttgattgatgatttccaatatattaggcctattttccctatcaatttccaggcatttcagtgctatctcagtgcatgtctttacttgctggcaatatgcttccagtaagggaccattccttcttgtctgtaacctgtttttccatttcccttgtacctgtgagattagaatatatataaagatgaagaactattcaaacgaaatagaatactcccttcgttttgaaatgtttggcattggatagttcatttttaactaaccagcgtcacaaaaaaaacagagagttgtttagttagaaataaacgttggttctgaactcctgattacttgattggtaaattctagggaaggcattttcgtgcttctgaagcgtcctgtaggtcctgcaattatatctagcattacagcgcccaagctgaatatgtctaacttgtttgatatttctttcctctctatgtattctcgtggcatgtatgggctgcaaagggacaaataatacaatgaatttcatataaatcacatttcttattgttagaaaaagattcattcaaatgagttatatattcagcttacagagtcccaacaagattttttgtgatcattgttttctcttcagtgatgaacctagacaaaccaaaatctgcaatttttggcaccatgttgttgtctagcaaaatattggcaggctttaggtccaaatggtaaataggtgggttcatttccacatggagatgttttaaaccctcgcatgtccctttaataattttgtaccgtatgggccagtcaagaccatcatcttcatctgcaaaggtaaagatatatcaacagaatgcaaatgcatatgactaattttcttccaagctgaagatgtactccctccagttccatagtacatgtcgttttggataataacgtagtcttagaaacacttttttttttctaaaccaaagtttttaagtttgatcaagtttatagaaaaaatatagcaatatctataacataaaacatactataaaatatatattcaatgttagatttaatgaaactaatttgatattgtaaatgttgttatattattctataaactttatcaaactcagaaaattttgacttagtcaaagtgacttataatatggaacggagaaagtacaataaatatatgatttcattacagtgtctttcaacattaatttatacatttagtttccatgcttctaaaataaacattttaaaattcattcatagtcaaagttcaaataatttaaacttagccttatccaaaacaacaaatattatggaattgggggagtactaggactgagagcaatgtcttaccagaaagatagttttcaaggctcccccgaggcatatactcaaagcaaagtgctctatctatggttgcaatcaaagctagtcttcctttagccagtccagttgtatattttatttcatagcagtatccaactaaccgtataatgtttgtatggttggccatcataaggttcccaaactcattattgaatttattatcgtcaaacccttccgtgtgaagaatcttcaccgcaattttatctccatttttatgctctccctgttaagtatctagggtcagtactcaaaacatcataaaagtggtgcagggttctgtttgctttgtcgttagacttttactagaagtaagttttatttgcaacaataaaaagtggtgcatggttgattgctcacctcagtgttatttgtgcaaaacatgcagtgcaggcttattcttatttagaaattagaacccactacattggtttcgcccattattacaataagttggtttacataccaaagttgactttaacttaccttataaactgttccatatccacctttaccaagctttcgctcctcagagaatccatctgtaatttcttttaacaattggtatggtacattagttggattcataggtgaatttgtaacttgtccgtgttaccaatctctcttctgtatgatgagaataaatagtaataagttttttagaataaagactaataattagacaagtttagcatccttgagaaggtatcaggaggtgccacattttatagtataaaacttgatacctacacctatgaggtatctcaaaataacaaaactttggtacttacagatagtttgtcaagtgctataaaatttccctaataatttactcgttctataagaaagactggagttaatagtagcactttaaatcttaactgaaatttctcaaatcctggattagggtatagactaaatgtgaatgaaattaatacagagagaaagttcaaaacaagccctcagatgtgcatcatttggagaaaaattgaatgagtttttacctagttttgttaccccaacaactttcatctgaactcatagccaaggccgtgtgtgaaaattcgagtgagtatactagtggagaaaatcttaggctttgtattaaaaggcaaaatgaaagggaaaaaaaacagtctctacagtgctctctatgggccaacggaagggttgtatgtgaatgtgccaatggagcaatgatggacgtatcatacgaggcttgcaaatgtgagatcgattcggttgtgatggactctgttttagaaaggagaaaaataactaatgaacgatgatatgggaagtactatcataccctcacaaattgacggtgtagatcgtttctactactatagtagagagcaccgtatataaagactcaaaaagaaaaagaaaagaccaatagatcaagcttgtctatccatcaattgagaataccatcagtaaccatgataattaatggccaagttcatcgatcgtgaagcatacgacttaacttaattaggctcctaaatctagataaaaaaacccaagctaggagcaattgaacaaattgcatgcctttcactggaagcagtaactaatcaattgatgattaattagcactaacctggtccacctggagatatatttgacgatcgcctagcttctcgagaggctagagaggaggagagatcaggctcaatctatcgcaggagacgagaggaggatgagatgattatataaaccgcactcaggccggcgccgtagacgacgaggaggagccagctgtaacgcagatttgctgcaggattgcttgactgagggtgggttcaattcgcgaaaagaaaaatttttaggtgtcatatcgaacatcggatgtttgatcagatgttgaaaggggttttagacaaaaataaaaaaactaattttataaatcactgaaaaccgctagacgaatcttttgagcctaattaagccatcattagtacatatgggttatggtagcatttatggctaatcatgaactaattaggctcagcccagaagattctcctcgcgatttccatctaaaatgtgcaattagtttttgtttttagctatattaaatacttcatacatatgttcaaagattcgatacgatgtttttagaaaaaaaaatttggaaaactaaaccaggcatgactgactgaaagtaccttgtgatcaagttgacacatttatggcacgcgtatacagtgcagttagcttgtctaaatatgcatgacagtctatctaagagtctcatcttttcacttatacttattagccaaaatttaaattttaaaccttaaatttgaagttgattttggagggttttcattgaagtttattttttaacctttatttttatatcactaagaacatgtatataaaagttttattcgtaaattatttttcatttgtaaatataccgttttgcttactaagggcctgcttgctacggaatagtagtactgatcaagaaaatccgaagtgccgaaggggatacagtaggcatgtgtgaccagatggctaggtgcatttatatatgttaaccatgttcattacggttgaaatcctagatttatcctgatatatatccaccaattttaagaaaaaacatatactccccagttctctttaatttatttattatcacttttaaccataaatttttaaccatcaatgtttcaactttggttattaataacttttagacgataaatttattattattgaaagtttatggttgtatctatacaccttttttttttccaatgtacgtccctatgttatagaaagcaagtcgatatagcatacgggtaaaacagctcatatccttgaactaaggtactagttgttgaaactgaaaagtatacgtatgcacatttgaaatattaaacataaattaataataaaataaattacagattacacctgtaaactgtaagtattaaacctaattaatccgttattaacaaatgtttaatgtagcatcatattgttaaatcatggcgtaattaggctcaaaatattcgtctcgcaatttacgtacaaactgtgcaattggtttttttcccacatttaataccccatgcatgcatccaaacatttaatgtgatgtttttggccaaatttttttagatctagataagcctatatattgtttaggattatacacgccgcatgcactcttgaccctctaaggatccattatttggtgccaccgacaattctagcatgtgtatagaaaatcacaattctccactggacggtccaagaagacggctgacctaacatatagcatggcgagcaagcatgcacactgtattaattggatgggtctaacttagttggaagcatcacagttgacttccagcttgtaaatatgattctcagaaaaaaaaatacttgtaatatttgatcacttttgtatttgagcatcgtacatatgtactatcttcattctatttttgtcatcacctagacaaagagcgcagggaccaaggacaactaaaaattcatcattccgtaattaattctcatcggttaaagtaacacgttgcttcgtatttcatgggttgcatcaaattttaaatatattaggtagttgtactaatacgaattaaattagggcaattttttttctaccccactttaatgtccaatattgattttactcttactttttagggttttcgtttttgcccatacttttttgaaccgaacaatatttttacccctgttttgttttgaatagagaagttcacggtattaactacatggcaaaaagatatttataccctctcctatctctattcatgaattgtgtttttctctattttatgcatggctttgaaaatttatttttgtgaatatgtttaaaattaaatgacctatattgactaacataacaatttggacagattctaaatttgatggaattttgacaaaatttcagcagcattttgatagaaattgaacaaactttgaaaaaatttcaagaacattttacacaatctcggccacctcctccaagccccctgccagtcgccgcctagacccctcaacgccgtcgcctacccctctcctcgccgccgcctagcgcacgcctcctgctcgccggcgggaggggctgcacctggtcgcggcttgctcgccgacggaaggggttgccactggtcggcacccgcttgccgactcccgctcaccgccgcctatccctctcctcgccacctagcccgcgcagagcgcgctctgctcgccgatgggaggagctgcgcctggccgccacctgctcgccgctgccgcctagccgatgcccacgtgctgtcgcctacccctctccccgccgcctagcccgcatacagcgctccctgctccccggcgggagaagctgcacctggctgccacctgctcgccgccaccaccaagccgatgcccgcgcgctgcggcctaccctctccccgctgcctagcctgcgtagagcgctccctgctcaccggtgggaggagctgcgcctggccaccgcccgctcgccgccgcctgtgcggctgtgacatcctgacccaattaggatgaggcccttgtgagcttgtgcgcatgtttagtaccacattgctagtttagcaagtgtggaaccgacttataaggccttgtctctccaaccatgccactctcgggttaactattttacacgaagcgaggacgaaaatgtaagtggagtggtatgtgtaagtggacccgtccgtcgaatgggctggctacatggttctggagggagggctgttacagccacctggatagtcttagatagacactcttagaccctttttctcgtaatgaaaaggtatacaaattcaaaaaacctttatttcctttatttatctatttctttactatcataaacccggttctttactaccataaaccccgtcccactcacttcagtctaaaccaggggtaaacgtctcttttggtaaaaaaaatagtggtaaaaataaaaaccctaaaaaataggggtaaaatcaatattggacatcaaagtatcagaaacaaaattgtcccaattattggacattcaataatgctcatttactctttacacagataaataaatagacatttgttagacgacaattgctttgggaagacctcaaaaccttatgtcataatcaaactgggataggagtactcggtaggtcagaatatacaataatgccgtagtaattggtccttcactacttctgttcagtcaactgtaaactgctctcggctggtttgcgtacgaagttcagttttgctttccggaagtcaaacggtagggacaagcgagaaaatcaacgcgtaaattgggggcaagggctatcgatatgcaatcgtgagaacctgaccggaaatggctggacaattgtttgaatttataagagtttatcaatatggaacagcgtgagccgacctagctcagtggtagagcgcgtggcttttaaccacgtggtcgtgggttcgatccccacggtcggcgactatgtttatttgaacttaaatatcttttttattcaaatttaaaatttaaatttccgagagcttcccaatatgatgatcttgtttcacatgacgaaccaatctcgcaaggatttgcgcgacgcctcgcctgatcacagatcagttggattatggatccttgcacgaacgaatcgtgtagcgcaatgagtaaagcatgactgcatgagcataggaaaaatagtcttaaaaaaagaataggaaaataaaagaaaaaatatgtattcgaaacctcattagcagaaataacaaaaaggaaaacgtacagtagtattactaccgatgaactgcattttgtttttaatccaaaagatcgtttttgtttttttagaacaaaagatcgttcttgttgtcgacatgtttttccaatggtatatcagtcaaattcttactgttctatacgctttaatatttgtgtgctttcatgggccagctagacatagcacacgggcctgcaggtgtcaagataagggaagatcagctgaaaggcctaaattactggatcagcgagagttctgggctgcatatacagttgggtacttgggttgccaaacttctacgatgttttagtatatctatcatcaattggtacgttacagtgagtatttacaatgttctttttattaacacagtaaaaacacagatgcccgcgcacactcacttttatgaatacacacacgcatattttatctatatgagcacctttcaaagactatgtcttgagattaatgaattcgccacaagcgactcgttgtcgatgaatatgtatgaatatgtacctcccactgaaaaaaattaactttgagtacttcctatgtttaataacatgaaagtttacattttacagtggatattttgataatattcattgttttttttaaattacatcatagcatatgaaatttaattcatttgtttcatgagcaaatagatgatgagcctcattgtttggcttatgcttatacatataaaccaaaatttaaattttaaaacctaatttgtagttttttattgtagtttattttatattatttgcttttaaatcattaaggatatgtatataaaagtttcattcataaattatttgttggttgctgataagcagtttcaataagcataaacataaatgaaaagatagggctaagcatatacgagattgatgactttttaaatccgttcgcgtattcatgttttttagaaatatttatgaaaatagataaacaatacaaggcgcacttaaacatactttagatgatagatatagtggtacctcttttcacttcacctaatccggtttaaaaataattatcattttgaacaagactgatatcaaaatttaaaactttaactataaatatttctaaaatatttgtgtagcaaacatggagagcatatacattaatcttaaaaagtactccaataaaatcatgcatatgttgatatttctatatattgtaaaaaaaatagtggtcgaagttatttttagacaatttcaagatgacaattatttttgacccggagggagtaattgaataaatgatgccggtcaataaaaatgagaaaatggtcaattgtgtcatataggaatatctaaaaaccagagggagtatttcctacttggctgtacgcctgtgccctgccgtattcttttgttatattgctcttctgccaaagtgccaagttgtttaatatcgtgttcttttgttaaaactgctcttctgccaagtcttttgtgtttaaagttcacaacatctcactagaggattttgtttcagatgatgaatcaattcgttttagatccttgaagatttgtgtgacacctggtcacatattaattaaatggatcgcgtggcgcaatgagcaaatgagcaagataaaagaaaatgactacatgtcatcaatgtaatcacaatcttcaattcgaaagattctgaagatgagcatggcgacctgtgtactgtgagctaactctgcactgatgttctgatgctaaagtcgtgtattgttaccatgaatctggttctaggaaaagcatagatcattcttgattgctggcatgctcctcgtgaacaaattaaaatgaagattatagaagctggtcgatctagagaccttgaaagctgaaacattccaggaccaatatctagagcaacatcctgcatcatgtaacacgatcctctaatataaagtcaaacactcaaaggagcatggttactgatatgtgagcccgatgttgatgggtcccacatgatagtgatcacttgggcatagtatgtcagaggattctcttcccatgcatcatatatgcatcatgctgtggggcaaggagagcaagagggcagggattgaaatttcggtaatttcaaacctccccccgccataacaatatcaaattttcgggttttctcaattttttgtgaatttagtcaaattcagttaaattgtgtcaaaatttcagaaaatttcgctccaaaaattaccaaaatttcggacatttcgattctactgaaagggctgaaattttagccaaaatcgaaattgaaaaccctgcaagcgggtagctcttttagctgaaacggttggtatctattctgactgccatagtggtaacactcataggattaactaggtaataccccgcgctttgctgcggaattcataaataagtatatattaaatattgttgaaatgatgaaagttgaaatgttgagaaaataatatgaggaagatgatttgacacatacttattaatctctataatataatattgtagatgatgtgccatgtttgcatggaatttaaaataggttagaatagtaattgctagtgagtgaagatgtggcatgcttacatgggatttaaaatgggctagaatagtaattgctagtgggtgatgatatggtatgcttacatgttgagctttaccttctaataattgttagtgggtaccaactatatagaaatatatagaaagatagatcagcatatggctcaaatatagtgcttctgaacattgcataagggaaattgtgaaaatcttctccaaggataactttttaagagttcctttcagccaactggaagggatggggtgaattcattcaaactagtcaatcatggttatgacgggaacatatcctatgcatataaatttcccgtgcacactccatacacactaattagcaaatgccacgaaacattctaaaaaaaaattggacatatactcctaatatttatgcatggttcccttcttggagtacagcatacctttgctggtttgtctctccataacgagttcaacacagcaaccaaaggaagctgtgcatagtgagtgtcactctccaaggtcacaaatgggttaatttgttgctgtgattgctatcaagcaaatctgtttgtttagtgtcgaaggaaacgaaaccgtcattagttttggagcaccgtgtatgagaatttgcctttaatttgcaccactcatgcggaagataaatggagcaccaaatgacccaaaccttgcgcacacgctggctctggcctatataaaggcattacacaacccatgaacaatttaccagtacgttcaccaccatggttagctcagctgcctgcttcttcttcttcttcttcttctcccggctcatcaccatctacttctgcttctctcccatcgcccacgcacggcatccggtgaacccgagcaccggatgccggcgatggctgcgtgtgcaaggagagggacgcgctgctggatttcatgcgtggcatcaacgacgccgacaacaccctcgcctcgtggcaatgggagaaagattgctgccggtggattggcgtcacctgcagcagcaaccgaatccgaatggccggcaatgtcatccggcttgaactctctgaggcttctttgggtggccaagttttgcaaggccggatgagtccttccttggcttctctcgagcatcttgagtacctcgacctcagtgctctcgtccttccgggcatcaacagcagtagcccaaagttcttgggttctatgacgaacctgagatatcttgatctctctgggtgttttctctctggtagtgtgtctccttggctcggcaacctttccaaattggagtaccttgatctctctttctcaaccttgtcaggtagggttccacctgagctcggtaacctgacaaggttgaaacatctggaccttggtaacatgcaacatatgtactcggcagatatctcatggattactcatctgcgatccttggagtatcttgacatgagcttggtgaatctgctgaacacaattccatctttggaggttctcaaccttgtgaaattcacacttcctagtacaccccaagcactcgcgcaactaaacctcacgaaactcgtgcagctcgatctctcgtcgaacagattgggccatccaatccaatcatgttggttttggaacctgacgagtatcgaatccctcgagctctctgaaacatttcttcatggtccgtttcctaccgcgctaggaagtttcacggcactccagtggcttgggtttagtgataacggtaatgcagcaacgttgctagcggacatgagaagtctctgttctatgaaaagcttgggtctaggtggtagtctatctcatgggaacatagaggatttggtagacaggttgccacatggtattactagagataaaccagcacaagaagggaattttacaagtttgtcttatcttgatctttctgacaaccatcttgctgggattataccatcagatattgcatataccatccctagcttatgtcaccttgacctttctaggaataatctgactggacctatacccataatagagaactctagcttaagtgagctcatcctccgttccaaccaactaacgggtcaaataccgaaattagatagaaaaattgaagtcatggatatctccataaacttgttgtcagggcctttgcccatagatattgggtctccaaaccttctagcactaattctgtcctctaattatcttatcggtcgaattccagaatcagtttgtgaatcacagtccatgattatcgtggatttgtccaacaattttcttgagggagcctttcccaagtgttttcagatgcaaaggttgattttcctcctcttaagtcacaatagcttctctgctaaactcccatcatttctccgcaactcaaatttgttaagctatgtggatctatcatggaacaaattcagtggaacattgccacaatggattggacatatggtgaacttgcattttctacaccttagccacaacatgttttacggtcatattccaatcaaaatcacaaatcttaaaaatctccactacttcagtttagcagcaaacaatatatctggtgcaataccacggtgtttgtcaaagttaacaatgatgataggaaaacaatcgacaataatagagatcgattggtttcatgcgtattttgacgttgtggatgggtctcttggaagaattttctctgttgtgatgaagcaccaagaacaacaatatggtgatagcattctcgatgtggtgggcatcgacttgtcactcaatagtttaactggtggaataccggatgagatcacttctcttaaaagattgctcagtttaaatttatcatggaatcaattgagcggagaaatcgtagagaagattggggcgatgaattcattggaatcacttgacctctcgcggaacaaattttctggtgaaattcctccaagtttggccaatctggcatatctaagctacttggacttgtcatacaataatcttacaggaagaattccacgaggaagccaactcgataccctctatgccgagaaccctcacatatatgatggaaacaacggtctctatggtcctcccctccaaaggaattgcttgggcagtgaactaccaaagaatagcagccaaatcatgagcaaaaatgtttctgatgagctaatgttctactttggacttgggtccgggtttacagttggtctctgggttgttttctgtgttgtattgttcaagaaaacttggagaattgccttgtttcgcctctttgataggatacacgacaaagtatatgtgtttgtcgccataacctgggccagtattggtagagaggctaccacagattaataggtactactacgaagcaacaaacagtgattttgctaccagggaaccacactaaaattgggttgggtggaacgaataaacaaagatagtatcatgcaatgaatgttattctttgtatttatatgaacacattaaaattttgtaataatttatagggattggatcttgtgtaatactatatggtttgggatcactaatacatttgtcgacagatgtaattatagtacaattgtgatgtaattacactgtaacattctatttcggtgacgaatcctctcacatgtgtgtgcggtgtgaatttttcccttcctcactttgtacaaatcttgaaacaaatctaacggtttaaaattatgtgaaagttacatacaagtgatattgtagttacatacaagttacagtgtactaacacttcaattgtattgtaattacatctatcaaatttttaggagaaaatttgtcgacaaatatatagcaaaattgtatggttttgatgcatgcactattcccaccagcaattccatatatcacaaacttcgggagtgagagttgataattgtggaatttggggattttactgtgtacaattgacttacggtaagaaccacatataatgtttacaagagatatgaaaagacacatataccctttaacatccccgctcaaatgcaatgtgtatgcaataacattgcatttgaaaggtatagcttaacctacactaaaaccaaagtcaatgcttgaagatgttgtcaaagcgtgcaaatcttggatgatgatgaagaagaaaagatagcatcccctccgcaatgaagtggacctcggagccttcacaaactgttcttcggccctcggaatcttgaagccttcacaacccgttctgcggctcttcaccgattcggagatgttggtgatgatgttgaagggcctttacaaattgttcttcggcccttgattggtgacgatggcctgctccgatatggagctagtgagatactagtatactgacattacttcgacgaattgaaaggatgtgatggactttagtggactcgataaagaacataggaaattgatttgtagatgatactatgctagcaaaaggcattgcaatagacaaatagcagatggcaacaaaaggggaaatagtgaccgtcaaattacttaaagatggaaggcggatctgaaacaatacggtgaaggccatgaccagtcactgctcaaataagatggtcctactattgcgagctgaggagcacataaggctgcaccggagatagtaccaacaacactcatactagatctagcagctatggagtcagagaaaccaggaacactagcagccacatgaggacgtgaagtgattgcacgcctcgcttgataatcaaccaacttctttgggtgaagatgaaagcaatcatggaaagtatgaccgaccttcttgcaataagagcaaataattgtaaccgaatctagggacactccccataggaactccaacacgatgagttgctgccaggacattatgagcaaccgaatgagtggaagtaatttctagggtgctaagacgcgtctcctcagcaatcagatctgcaagagcctctgtcatagttggaagtgtactacgcgcaagcaattgaacccgtttaggttcaaatttagggagaagtcgcatggcaaactgatatactcccttcgtcccaaaatataagcatttttgactttgatatagtcttcgagatgcatctttgaccaacaatatttataaaagtaatatgttttaaataaaaagagttgtatattgctccagtatgatagtttgtttaatgataaatctagtgacatcaaatttatatgattgatctttttttggctattaatagttaaaatttaaaaagtttaacttgcactattccaaaaatacttatattttaggatggagaaagtactaaattttcctgatcatgcttctctctcgccttgcattgtgcacatccttaaacaactttttgaatctgtacctcaaattgtccggttaaccgagtaaaaacattgtaaaactcttcaatggactgattttgttgctgctgtaagttgttcagattttgcaacaaggagaagcgtaaggctccactttcttgagtgtatctctgtttgagatagttccacatctccttagcacttgtgtgagccttaaaacctatccgaatagccacatcaacgctcataaatatgaatcccatcacacgatcatcagcaattttccaagcctttacctttgttgcatctgttttctcatcaggaggatcatctgtgaggtgtgatgcttgaccaattgaccgcaaaagcataagtgctgatagttcgataattttgaccatttaacttaatgtctgtacaaagcaaagccccacctcccaggaaaggatcagttgttctcatcaagatcagcgcaagaagtacatcaagatcagcacaagaagtacaggaagtagatggttgtacgatgttatctgaagttctgaacttggcactagcacacagcagcagagagcagcaatagtagtagagagcagagagtaccacagcttcaggaacattcaggagtagtaccaaacagtggaggagcagcttgttgatgagggccttatccatcaatagtccatatgcacagggttgcagcttcagcttattgatgacgagcttgataaaatggcagcctgatgaggtcgatcagcagcaacaggtacggccagtgcaaaatttctcatctttcggtaaaaccagtgcaaaatttctcatctttgggtaaaattcctcattttcaagttgttcaggtggtatattgtgttaaaatatgcttatgctcccaaacgtctcatctttgggtaaaatttcttatttgaggattaaggatcatcattttttttcaaaaaaatcaaacctgagccctcaattagatacatagaaataaaaataaaacatcaaatgaaatgaaattcaaaagacacaacaaaaacatgtccaaaagacaaaaaaaatttaaaatactttagacaaaaacgaaattcaattcgaaataaagaaaaaaacccttacagaattaacaaaaaaatattataagatttaaaaacttagattcgggatcagatggtaaaatattggagtgccctgttgtcgtaacaggcttggttggggcagacacccctctcgcaacattaattagcgagatgttaccactcatcatctccctttaactgcctgaaggatcatgccctcctcgtcccacccacccgcccttttatagcctctctccctctcgccatccgcctgcgccgccgaggtgggactaaaacccccctcacgcagcagactagcacgcactagcgctgatagttagtaagacgcttatttgggcctagctctcagcccaaaggtttagttgggccgggccgagttgggctttacggatggtaaaacatgtgacacgatgacgcagttgagcgaactgcttggttgggaatggcggcgcccgtggccggccgcctctccgggctcctccggcgatgcgcggcggccggggcggtccggccgggagagcaggcgcacgcgagggcggtggtgggcgggtggctccccgacgccaccctggagaccgacctcgtgctgatgtactgcaggtgcggcgagcgtcggcgcgcacgcagggtgttcgacggaatgcgtgcgccgtccatgcacgcgtacaacgtgctcctcgcggcgtcgcctccccgcgacgcgatggaggtgttctcccgcctcctcgcgtcggggctccgccctgacggttactctgtccccgccgtggtacgtgcctgcgctgagctccccgacgcggtgcttggcggggtgatccacggcttcgccgtccggctcggcttgatggggaacgttgttgtggccgctgcgcttctggatatgtatgccaaggctggtttcctggatgatgcggtgagggtgttcgacgagatgacggagagggatgctgtcgtctggaactgcatggttgcagggtatgcgagggctgggagggcagtagaaacctttgagattttcagcagagcgcaggttgaggcggtgaacatggtgaatggtctgcaggctgtgcccagcgtgttgaatatctgcgcgaaggaaggggagctgatgaagggtagggaaatccatggtaggatggtgaggtgccttgcatttgattcggatatcgcagtggggaacgctttgatcaacatgtatgcaaagtgcggccgggtcaatgtatcacaagcagtgttttctggcatgcagcagagggatgtggtgagctggtctacaatgattcatagctacagcattcatggcaagggggaacaggcattgaaggtttacatggaaatgttgtctgagggagtgaaaccaaattggatcacattcacatcagttctgtcaagttgcagccactccgggcttgtaaccgagggtcggaagatcttcgagtcgatgactaaggttcatggtgtccaccctgctgctgagcactatgcatgtatggttgacctcttagggcgtgctggagccattgaagaagctgttgggcttataaggaagatgcccatggaaccttgtgctagcgtgtggggagctttgctctctgcatgtgctatgcataataacgtcgatgttggagagattgcagcttttaggctatttgagttagaagaaggcagtgctagcaattatgttaccctctgtggaatttatgacgcagttggtcaatctgatggtgttgcagggttgagatcaaggatgagagaactcggcatggtgaagacgcctgggtgcagtcggatcgatgtgaagggaagagctcatgctttctaccaggggagcatcccacgttatttgaggagatgaatgctttgggtattagatcagttactagacgatatggcaaattcagattcagaagatgagcatgctgacttgtactttgagttaactctgcactgaagttctgatgctgaaagtcatgtattgctacaatcaattttgttcaaggaaaagcatggatcttccttgatggctgccatgctactcatgaacaaagttgaatgaagaccaacaaagaatcctaagaaattggtcaatctagatgtcttggaagctgaaacttttcaggaccagtatctggagcaacatcctgcatcatggtatggtgccaggatgagagcaagagggtggctcttctggtcgaaacgactggtatctagtctgaggtgactgcaatgacagtaatacatgtgtaatgttgtcagtctaatttatcggcatgtggctcaaatatagtgcttctgaaaatatgcgacaatattggatgcaggagaaactgtgaaaatctcctgcaagggtaattcttaagagttcccttcatccaactggaagggatgaggagtattcattcaaactagtcaatcatggcaatggccattctgggcttaaaggatcatcaagcactaaccaagtatccaatgatatttatggtttccttagcttaaagtacagcatcacctttgtctccatacgaatttcagtacagttacaaaaagaagctgtgtatcctgtcactctccaagatcaccaatgggttgttgcatctggtgctatggttgccagcatgcaaatctgtcttttgaggtcattttgcttggatccacatacccactcttttaaggtaaggaaaccgtcatttggaagctccatttatgagaatttgtctttgtcacgagatggttgaacaactgactcgttttctccgcatagctatccctgtatttgtctgtattccaacctgttacctggcaatactatcaaaacaggtatatgtaaaatagtgtattcttgtatcttttctaagcttcattacagcactgaaatgtggtccttatttgtatgccacacatcgcaatagatagtgcagcaactttggatgtggtccttatttgtatgtcatacatagcaatagatatcgcagcactgaaatctttgtgcaagttgggaacaattcatcatcttttcaaccaagccagggaggttacaaatacattttgtactggggatttttgtacttactacactatatatgagacagtgcaaatgagggtgaaactactcattgatttcgtcccaagcaagattggagagcacataatgacaatggcaaagttaagttgtttataaccatatagtataaaattgctgatgaaaaagttgtcaagttttatcaaatgcaagttgctaaacctggcacctcgatactatccaacatagctcccatccagaactcacttggtgacaacaatttggtactgcccaagaacaacaaaaaaaaaaatgtattttcaattgctgttgtcagcttttggcctttggggagcaaagagacgacatccagcttccaactggggtagcttctatgctgcgtgttctctccaggtcttaacctaccattacatttcattctttgtatcttccaaagcagataagcctgaatatttttacccttgatgcagtttatactcccttgaccttgtggtgttgcacactggtcaagcataaatttcttcaaaaaggactggttaaaggtatgatcctgtccctgccgactagcattgccggtagtttagttcacagcttggataatgtgacattagaagataaagtttgtcaccctatctcaactaaaaaaaaaacttatggatcaaggtgttacagttgttccattttttcagtaagatcccgagcatatgtaaatcacaatactccaattagatagactcaattagaacattcattctaaaatttaggcagcaacttcttcaatgagccaactttttccatcagtttgcactaatgaaattcctcagacatagataggtacagttgcaaaatgcagtgtgcccccaaaacccctaaaatgacatagttatacagattgctcaatgttccagacttccaggaatgcaatctgacaatccagatagagaacaataaagaatttaatctagtattatttccctgttctctctaatagataaaatattcgtatttgaccatctaatacacccttatgaactaatcttctgtagcaaaactgaaaatcctagactatttgtttgtatcttcagctcctttcgtaggtacacttagttaataggtgggtgggttgtattcgggagtctccgtccaagtgcgaatgattgaaaaagtccgagagctcggtctggctgcgcaaatggcaccatgtgagatgctcctcgcaccgtcgcaaaggtcagaatattaccatactctgttacccagcctccaaccttgaatgccaaagggtcacatatttcaactattagtaactttcacaaatttgcattatgttttcatagtgtatcagctaatttgtttaaaagggcgaaagtatacctgccctctgcggaaccagctgctgtatgggactgtgacatgcaagcccatgtcatgagctagctctcgtacaagagttcgggagcccaataggggcaccacagagtcttgatctccactgtagtgtcaattgatattgtcataacattcttcacattaaacagaaacaaattatctggaatataagtggaaatacacattacctgaacacccaaactggtattttgtgctctacaattctctgaagtaatggcaagatgttgatgttgccatccttattgctgtagttcagcacactggcacatgtaaatgttcaatatgagttagacttggaaactaaggcctgttcactaaatactatttggcattctatacatgataaatattttctaaaaaaatttcaaatcatcggtagtttcattagaaaaatatctatttgaaactttactagaagggcctacagttatactcattgagtccgtacttacagcatccgaagtacttagaagaaacagataatagacagaagttgacagataaatacttactcgctgcacatgctccagccatagggcaaatgtgttctgttagcatgaagagcttgctgcacttctggaaggttgaaatagaaatacctttcgtaagtcatacaaacatccacacctacactcattttagtcacctgcatagaacaacaattcagtcataccacaagggaccatatgttctcaagtagaagattgtatcaacaagagtaagcatacatatttccgcagccgtagctcctgcatcacaattgatgggtagcacacatcaagaataacatcgtaattgttcacataatccccaactatactgtttgcctctgcaatggcatcattgcatgacttgctctcattgtgggggttgctaaaggtatagtcctcaaaatcacaactgtggctgattgatagaaatatttcgtcagagatcatgccatgggaccagaaatactcatatgttgcggggacatctctgtcaagcttgagaagcggattcccgatctattcaaggtaatatcagagttacagaaaacatttagaagaacaaagttaacagatattgaccaatgtgcgatcaaattcttacagctactcccttgatgttgaatttgaacccatttgatttctcattatgtgtgagaagtacatcggtgagttgcggtatataatgccctgaattattcgccaatcagtcaaagtgcacgacagaatttaaacatttaaatgtgaaataagactcaggaatactctctgacctgcatagctctctccactaagaagtagccctcttgacctgtattcagggaacttcttgtaccatcccaacagaaatttgtacatgtcattagctgcatagttgagcaggcatacatacagtcaggccaacatattcaagtttaactggtccttttcatctgaagaaacatcattagaacttaccggtctgtgcatcgccagtattgtaatctgatgaagtgttggagtaggaccatccaactccagccggtgattcaacaaacagaagattggatactgcaaaatttgaggtaaggtaacacagttagagctaaagctacattttttatgcattctgaaaacatgtgctgggtggagattgcaactaaaagttcaacctttgttccaagacttcttgttcaatctcaggcctctgccatctcctctcggataaaatgggccgagctctgtgaacgcgccacctccaaccgaagaacatccaggacctgataacaacatggccagcggttataaatcagttaatcttacagcaaacattggcaatcagcaagtcacatttgattctgtagcattaaagttgttcacagttcattatgtgacaatgtattgttccatggaaaaaattcacccctaacttcattttgtgcatggaatgatggagatgaaaccaaatgatacctaaaactggtctaaaaatgctacctaaaactttaggtagtcttttgctacatggaaatcatttctttaggtagtcttttgctacatggaaatcaaatgatgcatcacttctttttaaatgctctaggaccacatcacacagacaccaatgaggcaagggtccaaggacacatggtgacctcaaagataccctattcctcctttgcaagttgcaaagtagtaggagtactagtgaaaaggatatcaacatgcaagttaaaattatttttgatttcttttttcttggaaggtgtagagcagatgtagttctttttatgtttccagttcaggaaacacctcctgccatcatagtcccctgatgaaaaaacatggagaatatatatgaacaaaatgaaaatagaaaaaaaatacatttttgcatctgagaagagatcagagaagatggtaaatggaagctcatttcctggcttcacaactcataaaatggccaaaaaaaaagttgtctccattaaaatattaatggaacagtagtacacagtaccattgacaatgacaactccaattccatctgttcatgaaaagaattcagaaatagttgcacaaacagtggagatccaaacggatacaaaaagaaaaccatactagaaggaatcaaccgaaagccatgcacataaagggagcaatctctatcaaacaacagtgagactctaccatctccacagtcagcatacctccataagaaaaattcagaagaaaacaatcagagaaagttcagagaaccgagtgagacactgacatgcagcaagagacaaaaacatcaaggaagaaatccacaccaatctccaagattaaaacaaaacaaaacaaaaaatccaaacctctcttcaagaatcacatctcattctcaacttgaaaaagatgagaaaaaaacacaatgcttcaagatcaaatccaataaacacaacacatcacatcacatcacacagtatgatccaagaactcagcagagagagtcagagagagagagaaaagcagagagactgacctccgttgagccagagggtgagcggcttggcggcggcgccctccgccgcctcggcgaagtagtagaagaggctcctcccggccttctcgtcgacgtcgacgtatccggcgaactgcctgaacccgacgacgggctgccccggcagccgcgccaccaaatcctcctccgggaacccccacacaccaccaagaagaacgcaaccaaccaccaccgccaccgccgccgccattgtcgccggcgagcgagctcgcagcaactgaattgcgcgcttgccgcagcggatggagaagaggaggagaagtgggtgggttcttgaagttgaagcttgggaagagatgaagaacagtgcttgactcttggggactttatactgggggcttctagcctttttgaattgggatgtgggaaaaataataattgaaaatattgtttttttaaatccggattattagctcataagttgttgcgagtttaggtttggattttctgttcgtttaatgttttttttgggatctcactaacagatagagtatttaatttggtgtgaggaaataattttgaattgaaaatattttgtggtgtggtacagtgaatgtagacgaggatgaaaatggatgaggagataactaatgtacctggacaatttttttccattatttttcttatgccagatttgctaattgttcatagcatgctgtaagtaattctcctcgcacttggcatattgttagttctgattattatgtcatgtttgtgttacttgtcaattttaggagaggtgtaaaacataataaaagaaatgcaaggaccttcactcctattcgaatatggctcatatgacatgctcataataatttttcaattacatgaaagataaaggagtgtttggctaatgggaatggaaaataattttccatccactaaaagacatctttaaatcctagctatttatccccctcttccatttaatcctaacccttcatttattttccaatcccaatcccactcctcattttctcattatccaaacacacccaaaggcgacactaacaccattatacatacactccacactcacatatagtacacaattgtaccctctaagagcaggtacaatagtgctattaggaaggctccaaaacctgttaattagcctaaaacgagattaaggaaagaaaatcacatattgagaaagaagccggcgcttgtactggcgccggcgcttgcacagcgccccacgctgtatcggccaggagataaaataaaaaatccgtttgtgacctaaaatgcttgttaatttgtttgaatcaaggcaacttatagctaacttgtagttagcttgttatatgaattgctctttaagttagctctacctgagacatgacaaaaggctggagcctactgctagctgcactattgaccttgctctaacagaaagaatcattttagtgggactaggaatttacaacaccactggtaggtggactcttgtacctggaactgtcattgtgctaatcagaatttcctcaaatatactcactatattattgcttctttctaaaatgctcaaatttttttattgacacccatagtttttgctttgagaattaccactttcttgctattgactttccatgttcatgagaaaaggaaaaaaatggtatagtagtttgccatttttggcatgaggaaaactggtgaaggctcaagtaggacctgagatgaataggtagccgttgggaagggtaaatggagataatgagacatttattacaggcatgccatggcagccatgccaatatgccattgattgacctggcacccttgcgtcaggcatagtacggcggtcgtctagctcgtgagccatcaataccaccggatctcctgaaacttgttcggattatacacctttctgcatatctgtttttcattattggggtgatatcttttctaaaggaatttatgtggaatatcattgggtttcctctattttggggtgcataattattttttcttaaatgttgtggtgttgcacattctaatttatatacaggggcggatccagcatagaggcggcggggtttcgaaccctattattggcgtgaagactttgagaatctctacgaaaaccccactaaatttttttaccatatgtagataggaggggggactgtaactcgatctactttgcttagaccctactgctatttctttctggatccgccactgatttatatatatatatgtactaagtcgattatctgtcatcagtacagtacttaagagattgtctatatgaacctagtcgcttgtcacacataagaggagagatagagaaggtgactggtcatcattttcattttcatagccgatagtccgacattgttagaaagatctggtcatatatatttttttctatgcgtccaactagcaaaaccaataataatgttatattttatgttttattgacagttgacacttgcccgatgacaaatagtagtaaatatctctccttttaagtgtgtgatggtgaaatctggttgctttggtagctgacatccattacagtcatcatttcacttatgctgattataagcaaatattttttgaataaaacttttatatgtgctcttagtatttaaaaaacaaattctggaaaataaaccatgataaaagatatctcaagttttaaaatttaaaatttggttgcagtttataatgtaaagggtactccctctgtcccataatataagtgattttggagatatgtgatacttcctaagactacgaatctgaacaggaaaagtatcgcatccctccaaaatcccttatattatgggactgatggagtaaatgatatgtgtgcatgttacattttgtttggtgcatagattaaacaccaccacaccatcttactataatacgttacatatgaaaatttacaaaataattactcttaactaaatatattgcaccatgaagctctcatttgttcaatcatttataacatgttcatgtgatatgctacacattagtatattactatccatgatactcccttcgttttatactataagttgttttaatttttttaagtttgatcaagtttataaacaaatattgtaatatttcatactatgctatttgccatgatctctaacaatcttactcctgtgattccttatcatggtactgtactagaaatactaaatgtcaataaaggtaagtagaaattaaaaggtttgttaataatttgtttgaagcaatccttgggagtatatattctgaaccacaaggcagtgcccgtagaagatccggacggagtcaggccgagcgtgtggctctatgcaatcttacttgtcagtatatgtggagtctcagaacaattatgacacacaaattcagctcaaatatcagtattttttaaatctgtttttccttaaatcagtaaactgcagtatactccgtattttcttttaaaaaaaacatcttcctcattgtaagttgaacttgcgcataatctgcatttttttagaaaagaacttttatgctgtaaagatcacgtgcgaataccaatcatagagctctttttgtcccacgggccagctagtattattgcataaaggatttcagtttttttttttgtttggtcagcttgaggaccatattttggtatgtggagtttaagatttaaaaaaacggtttggtagtcagcttttaaaaatacggagaagttggtaattttttagattctacaactatattttagcataatctgagtaaaaaacctgtcaaaactccccaaataaacccttagggcccctttgaatcaaaggatttatgtaggaatttcataggattcaaatcctataggaaattttcctatttgaccctttgattcaaaggattgaagctttccaaatcctatgaaattcctatggaatgacacattgcatgtagattttggaggaaatttagcaagagctccaatctcttggaaaatttcctttgagtctatctctctcatccgattcctgcgtttttcctgcgctccaatcaaacgaccattcctgtgtttttcctgtgttttgcaatcctctgttttacacttcaattcctgtcagaatcctatgtttttcctattcctccgttttttctaccctgcgattcaaaggggcccttagtatgctagtggagtactactgtagtagtactagtcgtctccagctcactcgtccatgatataacatgggctcactattcactaacatgatactagtaatgtagcacatgcatatttaaaaacattattagtttcactcaatacaatttaactcctccgctcgcggaaaactgacgttgtattgttgaggacagctatcacgatttgaccacaaattagtacattttgatgattatattttggcactgtttagattaaaaaaattttgaccaaaaacgtcacgtcaaattgtttagacacatgcatgggacattaaatatagagaaaaaaaccaattgcacagtttgtatgtaaattgcgagacgaattttttgagcctaattacgcgatgatttgacaatgtgatgctacagtaaacatttactaataatagattaattaggtttaataaattcgtctcgcagtttacaggtggaatttgtaatttgttttgttattagtctatatttaatacttcaaacgtgcgtctgtatacttcaaaaactttacacgcaaaaaactaaacacaccctttgatgattgaaagttgtatggttgtatttatgatgttgcacactttcataatataaaatattttcaagtatttgtaaattttctaagaaaaaaagactaggagtgaaagtttgaacttgaatagtgctaatatcaattcaagaacggagaaagtcataattttgttcttttgaagataaaatataatgtatatttaatcctatttgttaatatctaaatacaatccagttatacataaaaatgaatagaattattaataatctaacagaaagtatccatagtagtagtcgtccctccgttccaatatacaggaaattttgggtggctatgacatattttagtagtactatcttcgtcccatattacttgtctttttgagtttttgtttatcaatgtttgatcattcttcttattcaaaaaattttagaattattatttattttgtttgtcatttgctttattatcaaaagtactttacatatgacttatctttttttatatttgcactaatttttcaaataaaatgaatggtcaaacgttgtaaataaaaagtcaaaaacatcacctattatgggacggagggagtataaatctggattcatagtgtattaaaatatgttccatcccgctaaaataccgggagagtagtacagtggttatgagcagatttggctttgcttgttcagaaccagacaaggagcaagcttctgctcagtgcaggttgccaatgctaaccatgatattagcaaaatgcagattaattagtactactaatataatatccccaggcgtgggtacgtatgtctgcacctgattaattagtccaatgagagatgctctttggattagtgtttgtagcatatggtgtcagaatctcatatggtccaggtccagccaagtatatttccaaaccaaaaaaataaaaataaaattacatatgctccctcgagaagaacgagagatttggatataaaaacagatcgtatgctatgtatatatattaagcacttgcattagtcattggtcattagggctaattaatcgagttttccaatgcaatgagctgtaggaaaatgagagacatgacaaccttgtacctaggaaactcctatggcagaaatgactagcatt

SEQ ID NO: 69248 - DNA, 1071 bp, Oryza sativa
tttcgcagtcttccctggcgtcctgcaacatctgaccaaaatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatctattgccgatccatctacatgagtcaaaaaaaccgcacacaaataattattcttacaataatgacagtcatacaataattataagatatctttattcatacaaaaattataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaaacattggaggatgaagttgcaaaccttttaggcacctccgatttgatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccggatcattagtcccggttggtattaccaaccgggactaaagttaagatctttagtctcggttggtaccaccaaccggggc

SEQ ID NO: 69249 - DNA, 6618 bp, Oryza sativa
ccggagcctgagcacgagcgtggcgcagcaggtcgacggcgagaacccaaacatcgggctccacgccggcgacgtgatcctgtgcgcgctgcccatgttccacatctactcgctcaacaccatcatgatgtgcggcctccgcgtcggcgccgccatcgtcgtcatgcgccgcttcgacctcgccgccatgatggacctcgtcgagcgccaccgcgtcaccatcgcgccgctcgtgccgcccatcgtcgtggccgtggccaagagcgaggcggcggcggcgcgagacctctcgtcggtgcggatggtgctctccggcgcggcgcccatgggcaaggacatcgaggacgcgttcatggccaagctccccggcgccgtgctcggacaggtacaatacaagaaaaatattttcctttttttggttgaattggttgtcattttttgtgcgccgttggatcatccgatgggcggctcggattccatgttgactttggcgtctgacggtcaacgtgtaatctgagccctccatttggctggtgtacagatccaatggcgggaaatcttaacgtgtgaaggactcaagaagcccttcttttcacgtttttatttaggttttgatacaatatatacgcaataggtgttgttttttaaaaaaaataaacaaaatggacattacattattggctgtgtttagatccaaaatttagatccaaacttcaatccttttccatcacatcaacctgtcatacacacacaacttttcagtcacatcatctccaatttcaaccaaaatccaaactttggatccaactaaacacaaccattgttattattattattataaacttataaaaaggacatgaaaacaattaatgaaactaaggacagatttcatttcactgacatgcttagaaagtatagttgccaatatatgttatctttttaatgcgtgtgtgtgtgtgtgtaaagtggagctccactcccacacacaaacatgatggcatgactatttaataagctaagttggctcaagtcaacatctgaggccaataatatctttctagctagtttttcttttaaaaaaaatcctagctaactgatatgatataaaattagcttgccatttactcaaaagaaaagaagtattcttattccccaatgcaataacatggtagtattattttaaatcccacatacatagcactaaattcacctttggtttgttctatatgacatagatatcaaattagtcctacaaaaatgttatattctaagcatgtccagctaattaagcaaatgtggtgatgatctttgctgcccactatgtggcattcaggggtatggaatgactgaggcagggccagtgctgtcaatgtgcctagcattcgccaaggagcccttcaaggtgaagtccggtgcgtgcgggacggtggtgcgcaacgccgagctgaagatcatcgaccccgacaccgggaagtcgcttggccggaacctgcccggcgagatctgcatcagggggcaacagatcatgaaaggtacagaagatccctgaacatcttggcatgttcaactgttgacttctcagttatgttttgcccctgcaatagagaatgtactacactaccactggcccagatctctagatcaaatctgacttggaaaacatatgataatcaccagtggataaccagctacacaaaaaattatactacaagccattgatctggatttctttttgactattattaaacctgaattatgacaagtagttgtctggagatgatgtgcaataaaacaaggtcaaaaatatggatggccctctctttctaatggaagtaaaagaaagtgttgctttggagaaatgataatacatgttgtagtgttgcttttttatagggtcattgtgcaagaagtccacagtaggtaggatattgtaatcctaattgagtagatgctccagctagcgaattatgttgatgcaactttgatgtcaagatctcaactagcgtgcactggcatgtcacatatccgatgccgttggttcaaatcattcctagcaattccatcgcgctattaatgttcgcctcccatctttcgccctataactttataagccatagctgaaattaaaattttgaaaattaattttggagttaattttgttttttatgtagtttctttcctagtattggtttttcaattgctaatggcataaatataaaagtttcactcataaattaaaacgggttatcagctctaggccaaacggtagcgctgttgccaaacgatatcaatggaattatgcgagttcttaaggccgtattcacaattataggtcttttttttttaggacacaattataggtctaacagagtaaggatgttgctgttcgtcattgtattagagcggaaggtctgaaaggctgaaacaatcaaacaattgttgtttaatttccacactactaatatatggcgtccaagacctgggtaaagtttagaaaatgagagatgtcaaatttgtcactttcagttgcatcactgcaaatgtactattaaatatatatcagtagctaatagtaatttttcaagttgcagtttaaatgcaaatattcccagcccaagtgactcgcattcaaaaaagaaacagtgacagtgacaacgaaaggtccttggaataatatcagaactgaaattttatagcctcatcgtctcgcttatactcataagggacatggctcatagtgatttaaaactagtttgtgggtatatgtgttcttagtgactaaaaacaaatgctaaaaaataaattacgatgaaaaaaccataaaattaaattttaaattttaaatttttcgcttatgcttatgagtgatcacctgtatctaaccacctattcgttgtactaatttccatgaaaattaacatgctaaaaaaaccgttatttttcaggttacctgaacaacccagaggccacgaagaacaccattgatgcagaagggtggctgcacaccggcgacatcggctacgtcgacgacgacgacgagatcttcatcgtggataggctcaaggagatcatcaaatacaggggcttccaggtagcccctgcagagctggaggcccttctcatcacccatccaagcattgctgatgctgctgttgttgggtatgtctttaactagctcctgttctgaaaatgtagtaaggtttaatttgcttgatagataatgttgcagagttttgacatggatttgaatgaatcagttcttgaaatggcgttttcatgatatgattggccacttgcaggaaacaaattgagcctgaaatcggagaaataccagtcgccttcgtggcgaaaaccgaagggagtgagctgagtgaagatgatgtcaaacaattcgtagcaaaggaggtaaattcctttaccatggttattcataggacaaaaagagaacactttaccatggctgagtattgtttttttttttacttttccttcattaaattattcatttatatgtggttttaggtgatctactacaagaagatccgggaggtcttcttcgttgacaaaatccccaaggcgccgtcagggaagatcctgagaaaggaactgaggaagcagctgcaacatcttcaacaagaagcttaatttacaaccggcctcagacatgaaaagaatttagcatgaacaagcaagttccatgattctaatgttgcaaattacacattctgttctgaatagtttgtgtcttccatttatatgtgatgggggaaaaaaacccaggtacaaatggattctgtgcaatacaaagggtggtgttaccgtgttaggtcggctaggtttgctcatttgcagagagacaggacactggggaagccatgtacaaaaatgttcagacctgtttattgttcttgctggtgtctttgtaatattttgtttaaacatttatatcattcattattattgttactactactgttagagaaggggcgagaattctatctatatagaaagtcttttttttatctggtcctaatttatatcacaaagttcataccttctccagggaatgacacactctgtattttatttctattagttatttttgttccatttcgactacatcctgaagaaataaaaactttatgatgttaatagatttacataatataaaaactccaataatacaacaaggcgcccatggcctaatggataaggcgtctgacttctaatcaggcgattgtgggttcgagtcccactgggcgtgtcttactttttaggctgtgttcggctccatccattcccagcgcgcacagtgtacacggaaaacggagcgattaattaagtattagctaaattttttttcaaaaatggattaatttgatttttttaagcaacttttgtatagaaactttttgtaaaaaattgcaccatgtagtagtttgaaaagcgtgcacggaggaaaagtactttagtttacctttttagtaactcaaattcttaccagtttttttagtacctcgaaatctttattacctttttagtaactcaaattcttacctcgaattctcctttgtagtaactcaaattcttacctcgaaatctttgaatgacaggtttgtttgtttttaacattctttttttagtaacgcaaattctttttaccgaatgacacaggtttatttttagtgttgtaagtatctctgcatcttaaatcatatttcatccataacatacacaatacgtgtaaaaaaaactaacgtaccgtggccgcaactgcaaacaaagcaacactgaatgattggatcaaacacagcgtccttgtttgattgtttccccgctaaaaccattattgtccttgcagaagagcagttctcattttgtttttgttttggacaaaccaaattgctttaatgctaaaacactaaattacatcaaaatcatcggtgctggatccttctgccaaattaagccttaggaaccaccaggctcaatcaaaacgatgacagcatattggcgtgtatcgaaaacttcacaaaaatacccagttttacagatggccacaaactcgtgtgaacataaccagatagcatgtctcacaccccaccttttatatggttccaattatgtcaatagtaatgacatatttcaaaaccgtgaaagttataatatcatggatacaattaacccttttattttacgggtactgtctgacacctcattattctgctcattaaatattattggcaaactcaattcaacgcgaaaattataatggcatggacacaaacccttttattttatgggactgtctgatacctcattattctgctcactattgttagtggcgaactcaattcaacttttgaagtctacgatgcactttggcgagctggcgagtgcagctatcttgagttgtgcatggaccacacataaggtatatcacattacccaggggccgagcgtagatgttatcctcctcacgaagttgtcggattaaggaactcgcataaagtgatgcgtacctgcaggaataacagaaccaaacatgttaagtggaatacaacaatagtaccaagaactggagcgagaaagggtaaaggtattacataacagcgtagattatattgaaaagataatatgtgcagggcaaaggagagatttgtgtacccacgctgagggttaaccagctaaattaagaatctaaacagttatgagaggggcaaaggtatttgaatattttatttgctaagcaaatctgcaaatatagaggtacttccttcttataaaaaaaacttccagttttgcattggatgctagatattttcactgcttccaaatacgtcaattacctttttttttgtttaaatgaacagtcatatgccccatataaaggtcgcatcaactcctaactatttggcaactagatcttaaaactatgatattactagttttttggacaagcatagaatatcaacaggaaactaaattatctagaagctaagcacaacacagaatgctaaactgcccattgggtgctcttaaccgagcagttatataaaaaaaatatagaataatatcagcgaaggacaccagctataaatgactcaagattgtcatacccagcatctgatccctcagcctttagctcgattgcacacagagttcctaaggacaccactcttttcacatttggcagggacgataaatggttcactagtgcactatcccatagctgcaaataccagagtgaacttttaagtgtcaatatacttaaataaattgactgtatatagcattagcaaaaaagaggtgttcctggaaattgtattactccctctgtcaaacctggcagagtcttcaaaaataatctttgaatttaaatttctcatatctacaatgtttgtaacaacatcataaccatgtgaaagtaaatttaaatgtcaactaatgatattatttttatcaactaaactttaatttatattagactaatcgttggtcaaatatttgaagagttgaatttcaaaaaggcatgtgccttattcagtgggacagagggagtactgtatatttctatatgaaagatagattgaaatacaaacatcataagctgcagga

SEQ ID NO: 69250 - DNA, 17653 bp, Oryza sativa
tagcttttactgctgcgggacagcccatgggatgcgcggtataggaatggccatgcaagagtgctgttagctgggtcagataaaagataagtcaatgttaacctaaaagagtagactccttgtgatactctctgatataacatcataaaaatcgttaatgaactgtttgtgcatgccaaaaatacattcatgataattagatgaataccttagagtcacttctgaaggcttcaaaaataggctctgtagctaaagttgcagccaatggtacaatgccaccagtcatcaatttagcataacaagagatatcaggaaaacagccaagcaactctgaagcagactggaagagaggaaagtagtcaagagtttgaatacactagttacccccaccatccatttctataagatgtcgtttgacttggcacaagtccattgaagtgtagtttcaccacaaatttatcttgcagttactactaagaaaaccaaaacatggaagtgcattgaaatgataatgtgatggtgacacttttatgtcactaaacatctaaacctgtacaaagctggcctaattcgtcaaagcttactaagtttgaatcacagaatacttgtgagccatataaacttggatggatggagtaacttttaaggtataatcatccaaaagaacatattttatacattacctccacaccgagacgccaaaatcctgtaaatacctcatcaaatatgacaggaatttttcgatttttacactctttgacaagtaatctctggaaaaggggatctatcaaatgcattccccctgcaccttgtattactgcatgaataagagttaatgatgttaaaatcctatattagagtttacacaaattaaaagaggcaaccaaattagactattgaagtacatcccaccctaacacacaaatacttagtccgatttaaaatagtgaatgtgaatgcaattgcacaagcaaagttatctgtgggcacacatttgccagaaaatatcagcatcagattttgtatagtccaaacataacaagtactaaagtaccagaatagacaatatagagagattaaattcagcatgagtgacatcatatattggaaaagaggtactcaaaacagggaatatttatagtaacctggctctataattaatgctgcaatatgctctgaattatttgacatagcatactgtgatagttgttgtgatatgtatgaaacatatacattagcagcagacgatgtgtccctggtcttgcaaaaaacttcagttaatgaggaaaaacctgcagtcccaacaaaagaataatcagataagaacctatataaaatataacttcatgtaaaatttgtgttactgacatgtatcacaagaactcagttgatcatgcattatcgatgggggaagagaaaggttggcgcttttgtttttaatgtacactgtaggaggatctagaaaaagtcctcgccccgagtacctacagaacaaaactcaagtgaatgatctcagctttattgatttcagaagtgaaaattcaatgataatgcttccagtacaggaaaaaaatatgcaccatgctttaacgacaagataagaaatctctactaggccatataaacagataaacaaagttgctatagcaaatcacttaagaaggctacagatacatcaatgcacatgaaattcatggttaccatggctgctgaagaaaagatgtgtaagctgatggagcttgtgcttccatagcacccaaagtatccccgtggtaggaaccatttaaagcaaggacctagagaggattcaattaaaaatgcatatatcaaaagaagaaacatggagcaagaattccacattgcattatttcttcatcatattagtattaactacaaaatggtgagatgaactgtaaatacaggttttcctttaaaaatgcaaggtcagcatatgtagttcactgagaacacgtgaatagcatggcggtaagccacctagttatggggctgctaaccagggttcgattcctgggtcccaccaaaaaagatcctcgctgagatagctgctttcagagtcatacacgaaaagcaccttggtagtcagtgttcggggctttctcgatctgagctcaaagccttgtggggcacctctccccaagagtcagtttaatataggcagttcactgtgatcaaatgagcatggtggtggataagaaaagaaaagaccagaatagtgcacagaaatcagcttacttgttgagctggaggtgtaactacttcatgatactttgagttttactccatatttcagtcttttggagttctggttctactaacttgattttcctgatacaaaatatctgccagtgtggatgggtagatgaccacaacattcaccacgttttatgagagctatatctaagcatgccaatgaccacagcacagatgaaaaatctgctagacgtggcaagtgatgaggtattgtgaaatcaggaaatgtaaaggagcagctcagatacaacagtttctaatgccttgcaagaactcgccaggaggataagcaggaagaagaggccactaaatcagagttaaagcatctagaggggtgaaaactgctggccctacagctgtccaggaacatagctatgtcgctggaaaactccgctctctggtgggcctagacgttggccctgatagctataatggtgaaaccatcaactactgcagtatgcattaaccatgtccatccatgatcttccatggacacttaaatagacttgtatcagatcacacagagggatgaaaggacatcagcattacagattgtcgagatcagcaaggatggcataagaattggaggggaatggggaagagggagcgcactgagccagggaggaagaaaatagaatgcatgtaggggtccaacaggtataggtaaataaggaaaattgatgcctgtactattctacagtggcgatctgccacgtggaaatttgggcactgttacaaaaagggttcattcctaaacaatttactcgattttaaatgcatttcctgaatcaatcaaaaggtaaatttagcatgcattacacacttaagactgatgctgcgctccagtcaatgcacacattcatcatgtcaaataaaaataaaaataaaaacaattccacaccattgatcattgcatagaaaatataatgaattaaacatcaaatccacacaaacatgtgcaaaaaatctactttgttcatttgtcactaagaaaatatgcaaaataactagtggtttagaaaatgtattgccaaattcgagtagctggatgattattgaagttactatgcagatattgcccagcattcaactaaaagcataagaaacaacagtgcatcaagccatcaatgcatatagagatcatgtcgattcaacatctatggactatagggaaaaaaaaaatttcttgcagtgaactttaatatagttgaaaaaacaaagtagattgacaaggatattcgatataaccagaacagaccttaaaatgaacacttccttcacttctgatatctttttcgctgtccactataatcccatggtcacatgcatatttacgaaatgccatcttcaaagcaatttcaattgcagtagatccattgtctgaaaaataaactcgagaagcccaatctaacatacaagagaaggtgtctaatgaatgaagtgtttctcaacaacgtgacttgtatagtaacataaaagtaacattaaacaacagctgtacttagaatttgtcagtgataataattatgcaaaatcatagtgaagttacagcacatacctttaccaacaccaccaagcaaaagttctgcacaacgaagagcaggttcatgaacattctctggaaacatcacatgaccataccttgcagcagcataacccatatctcttgcaagttcaatctaatgagcaaagagaaatttaggctacaaaaattgcctgtcaaaagttcaacatacagagctttagaaataaaacactactaacaatagttcccttagcaaacgagaagacaagaaatttcacggatgatggaagatgtgtagacaataacctgtaagttagaatcaggtccttgtgtccaccaactagcacatgcatcaaactggggaacaatcgttttgtctttaacctgcaccaaaagaatgagcaacaatgtaactaaaattctattagattttcatcataattttcctttttacaaaatagtcctagatgcttggcaaaccttgtatgctgagaaattctcaccaaaacgcgaatcaataactgtaacagaatctacaggtacaagatcatgctgagtgaaaggccaccacaacaaatactttgattttctctgcatactgtttagcctttgaactcttcgtgaatgaaaagattgcagactatctttaagtgaactaaaagctgaggatgactcagaaaaccaatcagttaggtcgtctttgggatcctcaggaattggtggcaggacatgcacaggtaccctaaataacagaaatagcacaaatcagtcatacattgaaatacagaaacaatacaagcaagttgcagtaggtttatcatatatccaaatgaaagactgaaataattattattaacaggataatataattaaaataaaagagatgcttctatgctcctgcacactttcagagtgatttgacaaagaacagaaaggcattaatcacctctttctcaagtatgagagcaggaatctgtcattcgacaagccacgatcttccaaaataactgagcccacatcatatcctctgagcaacagagtttcgtaggcagataaagtagatgaaataccacctagacgaccatctccaacaagaactgcaggtaacctagaggacctgttaagagttgtatgtgatcaattacaccagaaagtaaagcaaaccagcatgtagagataccaaagtttaactttgacatattacaaggttctccataaatcattctaagaaattcaaggtatctacggtactttaatgcatgataagaaatattaggtggcattgccagttcaccacaggtgataacttctgaacgaataaaacatatattaaaagaagtgacaaatggatatgccactgtgtacagtagtgtaaattgaacatagaaattgatgtaggacatgaatatttactcagctcatgaatatcaactactcaaatgaaaaatcctaacatgtacagaacataaaacctcacaaaatattaaaacaacaagattgctcgccacaatttagcatagctaatatgttcattcacaacgtgcacattactctcttacatctgtaagaggcagatgaaatttgctagcgttgagctctcctaagtagaggaactatacagcgcaagcatcacatcaattagctcgaccaagcaaatgtcattgaatgaataatatgcacgaaacaaaacatgctaaagtaatcaaatgtacccaatttaatttctacttgaacgaacgcatacacattcaagtacttgaattcactacgactagccaaaaatgaagaatgacataaatcagaagctgaaccgcgcgcaccgatagagatcacattggagcgtgccagaagggccagggctggcgacgccgccggccgtctcgagcaccttccacacctccccacccccgtcctcctccgccagccaccggtccacgagccacctgacctcctcgtcctccaccggcatcccctccctctccgccgccaggtgcggcgacacgggctcccgccacgcgtacaccgtcctgcacacgagcgccttctcctccaccccctcctcaccgccgtagttcaccaccgtgtcctggcgctcggggaggggatccacggcgggggaagggaagagggtgtggttggacgcgacgaggcgggtggaggcgccgccgccggcgaggcggaggcggcggaggagcgcgggggcccggtcgaagacgaagcgcgcgtcggagtcatcggggaagccggtctggagcggcttgaggtaggcgacggtggaaggggaaggggagggggaggcgagaagggaggcgacgaggcccgcggaaacgagcgtcttgccgacgcccgtgttggcgccgaaaacggcgaaggccggcgaggtgagggcacggcggcggcggcggcggaggaggaggaggaggtggagtggcggcgagcgtggcggaggaggcggagcatggcggcgggggttgggtttttggacggggttaattgccggggtaatcggtttttggacggggttttggcacagtccgactggtgttgggtccgtggctccgtgccagcacgacctgatctttgagtcgtgcctgggccgctgcctcgacagtcgacacgatgtgctggtctggccggtccggtcggagttaaatagatgagagaactaaaatagacttattctagaagatattagataagcaaaatagatttttttcaagaaggagcacagtgggttttcgtgccttccggctgacccgagtcttactagaccatgcctagaccaatggtgcagcaagtggactggcacggcctggcacgtgtaggttgtgtcgtgtcggcccatctgatctcgccctgggcctggccatgtccgggccggacatttggctatccatactgttatctatacatttatcgataaatatatattaatataataataaagtaatttacatgtataactacagtgtggtaactaatatgtaacttttatctaattttaaaaccattagatttgctttaatgtttgtgcaagtggagaagaaaaaatcacaacatgcgcaagtgaggggatttagtctagtgacctccgctttgtaaaaatagcatgttatcgcaatattttcaaaagttacatgcaagttgtagttacatacatgtaagttataatgcaattatactacaattacattatatttacatctgacaatttttttaaagaaatttatcgacaaattatagcaaaactgattctagtttactccggacaacgtgggtaataaatcttgaacattgtatcatatttattaaaggaaaaagtacaaattaccccctgaactatcgcggtcatccgaattaccccataaaccagaaaaccaatcatcattcaccctaaacttttaataccggatgatttacccccccccctccacactgtttcgagcggttttgacttgagtttgcatatgtggcgccaacgtggcaatctagttagtaaataaaaataaaaatagcttccttgggcccacctgtcaccctctctctcccgtgtacgcactcaggcaggcggctccgcaaacggaggcagaccaatcagtcgacggtagaggcggagctcgcctgggcggcgggtggctgaggcaaagctcgcccgggtggccggtggctgaggcggacgcagaactagcggctaaggctgaggcagacctggcggccgacgatggaggcggaggccgaccaggcgacggtggttgcctcctggggaccagaccacgggggccgcgtcggcgccgtagcgcacgtggagagggagcgggcaaggccgcccgagatggcgccggtgaggcggcagagcatcttgcgcggggacgtggaggttgcggcaaagcatctctctcactcttcttctctcgcgcgcgcggtcgaacggtggtaggtgttcagcgcgcacggcgagcggtgggcggcgccccgggacatagaggcggtggtggcggcgcgagacgacgaggcggtaacggcgaactccgggaggatttggtcaccaggaacggaggatggacggcgacggagaagagggccgacagccggggaggggattggggaagcagaaaggacttccgggggtgcaaccaattggaaggaacccaacggcggcgcttggcgggcgcggcggcgatggtggcaggacgatggcgccgactggtttcccctcccgcccgaacctaccgccggcatccgggggctgcgtcaccccccggaggtgaggaaggcggccgtctcggcgtgggaccactgcgggaggcactcccacttgactgacagcgggtcggcggggagcagcggtggcggaggtggaggagggagtggtcgggggcaaagtggtggggcgggcaggcgaggagggggtggaaggggttggacagctcactctcggtgttcgccgctctcgtttccgcgtccctcaccgccgtccaccgtccgccgcccgcccctctgcgcgtgccgtgcgcacctgcgcccacatgcgtgcccccgtgcgtagtgccgccgcgccgtgcgtgcccccgtgcgctgtgccgccgtgcgcaccgccgcgccgtgccgaccacccccgcccaccgcgctgaccgtccctgcccaccgcccatccctgcactgttgtgcatgccatgcgcgcgtgagagagaggaagagtcaggcgagagagagaagagagagaggaagaggggaaagagaggtgagagagtatgatagatgggtcccacttttttaataaataaaatgttgatttgattgccacgcgtacgccatgtaggacaaacccgctctggattaggtcaagggggtattttgtccggtattgaaagttcagggtgaacgatgactggtttttgggtttaggggtaattcggatgaccgtgatagttctgggggtaattcgtactttttcctttattaaaagggatatagcatgtggttttggtataaactgtgcgcaaaatataaagagaaataacttttgattttagatagaagtaactttgtgttttctgataatgaaatatccgtttgatgtagaagtaactttggtttagatataaataacctagtgctagttatatctcaccacaaagcagatgtggagattctttttagcaacaattatttttttaaaaaaaagttgatactatgcaaaaacaaaagagattgatgataagtataaagtgtacatgttgcactgatattgtattgttttgtaggaattttgtgtcccgtttggcttgcgacaaagagagacgaggcaaggggccaagggcttatggtttgggaagtgcgtaaagtttggttcagtttagttaatttgatgatagtaattacggaaagaaggggtagtgcgtttagacaatcgcacgactgtgcgtaatacaatcgtgtcctttttgttaggcatagcgtcttgctatcgagcaacaaagcgaggaagatcctgatatgataagtgtaagtgaaatagtagacaactagtagataaacaattaaattagagtatatcgtaccagcattccttaaacttataagcatgtttcatttagatccacgaacttacaaattgtgcattgagatcccttaacttggtttattatattattccgatccaaagtctcgtttggtcctggtcttatctaatatgacatgccacgtagatttggcatgttaatgctccacgctctgccttatccatttattgtaattttggattgtttctttggcgcagtttaaaagcccattcttgcatggatagatttctccttcacttttagtctgattttcctcccaacttcggtggtttatgacatgcatcgaatattcaccaacactcgtggaatatgttagaaataatccctatcactatgttggatgttttattatctgtgctttatacaagtgttggtggtataaattgggcacttaacagccgctaacaggcgacacgacggcgacggcgcaacagtggcggcggcggcagcacaagggcgacggcgcggcggcacaggagcggcggcgcggcacaggataggggcggcaacgcagcggcgtagctagggcagcggcggcgaggcacaggagcggcggcactacaagggttttgacaggtaacactattagggttacaacaacgacgctaaaagaattaacacctaaactaggagatcacgagaaggttcctcaccaaaccgagacgatcggcgaggatgagacggtgacgacgatccagcggcaacccacggggacgacggcgacggtagatgagaaacaaacggaatagattacatagatgaattgatggttgcagcggcaaacacatcaatggagaaggagaacggagtaccggcgatgacggcggcggcgggaggcggaggcaccggcgggcggcggcggggctaggggcgaccggcggctagggctagggttttgcaatatgagggaaataataaaaattaaggggcatgaagacttatatagggggaaaatagatggattaggtgggtcctacaaggactaggattggggggaggagggggaagaatccgactcggctggagaggggagagggggcgcgcgcggccgaaatagggagggagaggaaaaatccgattaggaaaaaggttaccggaaaaaggaaaagaaaataaaaggacacggtgccgttttgggaaagaatgaaaacggaaccggaaactgactcggactcggctcgttatgcaaaacgaaaccgcagacgaagagaggagtgaatcgggcacgattcacgaccaaaggtggggagaaaaattattattaattcaaatcctgggaattcaaattaataacattaattccgatgctctgaatattccactttaagtcccgttaatgattttagagcaaagagaattcgaaaaaaaaattctccctgacattttcgattattaatacattgttaattagggttttctcctggttaatcaaagtaatttttatagacaatttattggtgaattagaaactacgaaaaaggggaaactctccgggtgtgacaagcacccacaagacggcggcgccgagcacgagtgcgtgctggctgggaacaacgggttcttgccatcgatggtgttcgcggagagcactgcccactcaccagggttgcacgggtacacagcgcaagcgcaccttccctcgaccttacacatgttggagctacaagggatcgtgcggtccatggacgggcacgtcgaccagagcagcggatcggcaaggtcgacgacgagcagcgtgtgtgcactactacagagccataggtgccggttcacaactgggtataggtaccggttttctaaccgacacctattggtcggcacccatactagctgaatttttcacattttggtccttttaaaaaacttatttcgcaaatagacccctaaaaaaacttatcccagaaatagtcttttttggggcaccagagtggctggcgccgtcgtccaacgggacggcaccagcctctccggcgccgtccccccgccgacgtggcggggcgatgctgaggtggcattgggggggggggggggcggcgccagagtggctggcgcccccccccagaaattttttatttttgttttatttttttgatatttttttcacgcttaggaacgcacaagaaccaaccatagaaaaaataagctcaaatggacggaatttgtgacttgtagaatttttcctttcttctcatctctctctaaactagtgcagaagagagagatgtgcaacttttttttttattttatttctttgatatttttttcacgcttaggagcacacaagaaccaaccatataaaaaataaactcaaacggacaaaatatgtggcctgtagaattttccaaagctctaccgaaaaacttctctcctcaaaaacataatcttgcaagcgcaattcggaggttttaatctcgccaaacccggcaaagcggggaagaatcggatgtaaccttttctgtagatgtccgtggatatattatttgcctgattccgagtccgtatgagaaagttacacctattttaataaatggcacccgaatgacttttcggtagagctttggaaaattctacaagtcacatattttgtccgtttgagtttattttttctatggttggttcctgtattctcccaagtgtgaaaaaaatatcaaaaaaataaaataaaaataaaaaaagtgcatctctatgtactgtttaacttatggctatcatttcatttggttatattttgaattagattaagtaatttcatatagtggtggagtgcattatatttaatatgcagatcaaatggttttactaaaggagttatggtctaattttaatgaaggtgcaaagtagactaagtggtatgctatttctaggcttctaactaagtggtatataagtatattacatttgagtttaaatttttttgtggttggttgtatcgtgatcctaaatatgaaaaaacatccgaaaaaataaaacaaaaataaaaaagttgcaattccatatagagaaataggaatggaggcgaggggtggggtgggggggcggcgccagccatgctagcgccctcctcctgccacgtcgattcgcgtgtgccacggtggcaggaggacggcgccagagaggctggacgacggcgccagccactctggcacccaaaaagaactatttatgggataagtttttctagggatctatttgtgaaataagttttttaaaaggaccaaaatgtgaaaaatccagccaatactagccaccggcacctatgaacaaaataaaaccggcacctttagctttactcaagccaaaaaaaaccagctcggctcagctcactgaacactgtcactacgtcatcgcccgagttgctctcaaatcaaattaaaatccccaaatccccaaatcatccataaatcgccaccaaaatcaattcacaatcacatatcacagtatgaacatactccaatccacaaatccaccaaaacatctaaaataaatcccaattccaccatccgcttcgtcgccgacgagcccctcttccgctgccacccgccgcctcccctcctgccagatccagcggaggggagggcgctgcctccgccgccgcctgccgcctctcctcccgccagatccggcggaagggagggcaccacctccgccgctgcccaccgcccgctgcctcccctctcgccagatccagcaaaggggagggcaccagctccgccgccgcgcgccgcccgttgcccggccgcctcccctcccgtcggatctggcggaggggagggcgcggcatccgccgccgccgccgggcatccgctagagagagagagagggagtggataaggacgcaacgacgtgggtgggagtagttgatcgagtagataaggacggcgctcggctcgtcggctcgtttttgtatatgtgtcggttacaggtgccggtttttaaataaaccgacacctataaaaatcggtgtcggttcttttaaataaaccgacacctataaaaaccaacacctataaaatattataggtgtcagttcttttaaaaaaccgacacctatagcattggtatcggttattactaatgaaacgacacctataataatgccttaaaggtgtcggttcttattttttttccacgtgcggaggtgggaaaaggcctataggtgtcggttttaaaggaaccggcacctataaggccgatccctatgagggtttttgtagtgtggtggtagtggtgcaggggcacgggaacaagagagcggactatgcccggctcgcggtggcactgcggcaggaccatggcatgccggccgtcgttgtcgctcgagtgtcggcgtgccccgactggctccgcaaagccgtcgcgtgggcatcgtgggagcatggatgcgcaggacatccatctcggtctgaggcagcagcgccaccaccaccctcttcctcggtcccctccgcccgaggcgacgagcttatccatctacttcctcctggcgtttgggcggcagcagcggcaacaccccgcgcagacgccacggtgggcacactgttgatgcgaaaacacgaggcctgggagatctgcttaactccagtgcaggtccaaaaaatcttgctttcggatctatgagcgtgccagttgatttgatcctgcaatcaataagaaataaaaataggaaaatagcagttaaatccataaatgatagccgatcggctagttgccgatgacatatcatttatctttgagccgatgtcatatctgaatcgatcggcagatataaataagtgagaagagactaaatctactcgatcggctgtagatattaacaatatataacccttatatcgatatatacttaaaccaagtgattgggatagatctgtcaccatgccgagacagtataaaccacttagatcaaaatatatattaaaaataagattatagatgttcatagcatagccgatcagatagatctagcatgtatcggctaatactccgatactattctatattaagatattaaaacaagtaaaatatatcaaacaaaaagcctaatatatctagatgaaacaatatcttaatgtaaaggacagatctagcatatcaataaagcacataaaatataaagctaaatcaggtaagatcggctgaaaccccgatactaccctaatcggcaaccaaaaggcaggctagagattgatattctaatcacgacttataaggtcaaactcaactgatgcagctataagtatgaaaagagggacaatatctagacaatcaagctattggctgtttcatagggtggtggataccttatataatctaagccaacattgatatctaacctaatcggctgccttccaatgatagatgttagccggttggaggttaaatagcaatattgtcaaagattatataagatatatgataactcgacgaattacataaacaagattagagtatcataaagatggaagcactaatctcgagaacgcaagccgccataacaagttttacctctagttgaagatcgaaaccgatgcaactcaacccgaaagaaagaactcgtcgaaacaaaacgaaagtaaaagggtggcgatgcgccaagattgttattgaacatgtgttgttgttttacatgaggctcggggtctatttatacccgagattacaaaatatgtccatgtcggacacgactcttatctctaacaaactctaagataccataagtctttgcggcagacttttgcccaagcttatctctaaggaaattaaataaaatatcctaattaatagatacaattgcctttccaggactcgatccgagtgtggcaatccatatgaagcatattaactcaacccgacaacgtgtaatgagtcgtattgtcagaatcggctcaatcggctaaccctgtccgactcgaactgggccaattaaggtcgcagccgattcggacttaaccgattcttgctttgtttccggaaccgatttttgtcttggattctgcttcgatctaatcttcatctccgatactcaaattaccaaatttggtcgttaacacacacggaccgcgcacgaggtctctcctggtcccggaacctatgggctctacatcgcgcgtcccatgtcgtggcggcggcgcccctctatgtcgtggagcttgagctcctatgcagccgtgaccattactccgcctccatccgccggttccactccttccgttcctctcccacccctcctctcctcttctcctcattgctactctaccgccgcttgcacccgtcgctccactcctcattacccgagcccctttctctcccttccatcaccacgcaaccggtgccagcggtacgccaatgccccaaccccttctcaagcgctggcaacacgccggtcccctagccccctctccggtgcccgccggtggctattgccaccgctccctccctcactagtcaccactgccgatgggggagagggaagggagataggagtgtagtgagtatgacaagtgggccatagctttttctctctagacacttagcatgtgggtctacttctactttgtattgtaactaggctgccacgtcagggtagggttgaccaagccaacgagctacgtcagtgaatttaaaactaccctcaaaaccgttgagggaattaaattgctctcaaaacagaatgctatatattttttttgcgcattctgcaagggagatgcggatcgtacggtcgcaaaaaaaaggtgacaaaccaaaatttttcagctatttgttacataaacagtcctataaatactactacgtgcaacccacaggttgttaactagttatgtaattttgcatccaaagtcaaacagcggctgtgttcttctcccatcttcttaacccacctctctcgttttccgcgcgcatgcgtttcaaactgccaaacggtgtgatttatgcaaaaaaaaaatttctatatgaaagttgttttaaaaaattatattaattcatttttcaaaaaaaatagctaatacttaaccaatcatacagtaatacgagctttgttttacgtgccagagagttcccaacccctcctcctgaacacagcctgcatatgtaaaaaaaaaaaggtagtacatatgaaaaatactgttgtcatatacgccatcgaaaggtttacattgcaaattataaagaaaattacaaagaagaaatcatgaaataaaagacaataaagactccctccgtccctttataattatcgtttgggagttgtacgcccctctcacaagcacagattcctagcgactaataaaaggggacagagggagtagtatacacgagagcaagaaggattttctcccgctatggtgatcactggagctcactggccatcgcttatcctccagtgggcttgttcccttgtcgcaggatcaatcttttttgtgaaagcaggatcaggccgcatgtgctctatctctaatctggaatccctgtcatctaatttgcccttttgaccatgaagtttttggcctaaaagccttctttccgcagttgagctgagcaagagagctgatttagagtcaacgacgtcttcactattttttgtaccagaaagctggtagtccaacgcctgatctggccattttctggtgctggatttttcacattttgatccttttgaaaaacttatttcgcaaatagacccctaaaaaaacttatcccagaaatggtcctttttggggcgccagagtggctggcgccgtcctcctatcaccgtggcgcacgcgaaccgacgtggcaggaggagggcgccagccatgctggcgccgccgcctccattcctgtttctctgtatggagttgcaacggtgtcatttttattttattttttcggatgtttttttacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgctaaacataatgcactctaccactatatgaaattacttaatctaattcaaaatataaccacatgaaataacatatataagttaaacagtacatagagatgcaatttttttatttttatttcatttttttgatatttttttcacacttaggagaacataggaactaaccgtataaaaaataaactcaaacggacaaaatatgtgacatgtagaattttccaaaactctaccgaaacgg

SEQ ID NO: 69251 - DNA, 756 bp, Oryza sativa
acttgagaattttcgtatcaatctttactacacatggggcatggtcagagatattcctagttagggggagaacagttgtattgcggaaggttaaagtccatgatgcagaggtgaaaactcaatcaagtctttctagcaaatgattttgttgcatattgctccaggcgacccttctcccttgtaaagggtaaggcttccgctacccagctaaaggctatactcaaaaagaaggcgaagatttctttgacacttactcacctgttgctagattgaccacaattcgtgtgctactttccctagcagcctcacatggtcttctcgttcatcaaatggacttctcgttcatcaaatggacgttaagacagcttttcttaatggagagctggatgaggagatctatatggatcaatctgatgggtttgtagttgaaggtcaagaaagcaaagtgtgcaaattgttgaagtctttgtatggtctgaaacaagctcctaagcaatggcatgagaaatttgacaaaacattgacatctgcaagctttgcagtcaatgaagcagataaatgtgtgtactatcgccatggtgggggtgagggagttaatttgtgcttgtatgttgacgacatcctgatatttggaacaaaccctgaggtgaaaaatgaggctaaatcatccttgcctcaaaatttgaaattaaaggattgggcatagctgatgttatcttaaacattaactaacttgaggggagaatgggattacac

SEQ ID NO: 69252 - DNA, 666 bp, Oryza sativa
tgcagttttgttttgctgcgggattcggatttgttttggtttggaaacattccaaaaaatcccgtgtgtgaaaaccggatggaattccgattgggtacccctgaattattccggttcggttaccccgacccccttgaaaggcaacttttttttttttaacccgacccgttgctttaacccaccacacccaaaatcaatctagggttggcctcctactttgtactgccccgtcgttcgtaaactactccatcccgctcgccggcgtgcaccggcaatcgggaaagcaggtctccggaacctctgccttcgatgtcctgcaccgggagaaggtagcaataaggtttttgggaagcgcttcgcgcgactgctccctgttcgttcgcgacggctcgtcttcctcttcgctcgcgtgcttcgcgccttcgtagacgctcgcaactgcgagtagttcctgccgagcaaccggtctttccgccacacctcggtattgtgttccaacattgtttgccgccaaatttaaaatttttttttgggggaaatttccccccttggggggtttttcaggttttactgcttattacatgtgtagatctaatgatgcgttcaatctagtttacatctgcaatgtcatgatttatttatggaataaattaaatcattatgtgc

SEQ ID NO: 69253 - DNA, 10476 bp, Oryza sativa
atgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagcgtgcatgctgataggcgatagctactactcgtactagtactctatttctgcctgaccggtacaacaatctcagtgtaaagtacacatgcatgcgtgcatgcggtggttcggttttagcctgcttagaatccaaactcggttttaaatatacagccatttacaattccacctttttttcgaatccagaatgactcacattgctcaaacctatccacattacactattttataattaagaatttaaatctccaactataactaccgctatagctaaagatacctacttaaaaaacaacagctaagatatgtactatacacattctatattgctattagctattgttagcgagggatagccactgccagggttacggatacgatataccctctacccttggatatatattgtataccgatacggtatacctgcgcgtatacgaatgtttcctgtatacgttaagggaatccatcacgtaatagaaaccgaatccacacatgagagaagtcctactcgaacaagactgggtcgttactgtatcataaggggtccgatatctccgagtcctacttggagatcaactgacccgcgatataaaagagacccccccgggaggacctaaggcatcgaatctcaccgccaacacatctaccacagcctacgaagccgtagcctgcagaagccaagtcgccgggtgatctagtcaaaccaactcgactacgatctcgtcggtattatcgagttctgttattccctttgtaatctgttatttccatcatataatcccagaccaactggattagggctattacctaccaaggagcctgaaccagtataatccctgtcttttgtttgcttgatgtcgtattacgtagatcctcgttccaacgtaccccaataccctctatatccggtctacgggtatccaccgtcgacagccaccaaatggatcttcaattagcgccagctaaactcgacgggctgaaattggtgaacgacccatataaccatacaacccataataaacttctaaactccaattctctccacctatcagtttcttagtctctcgccctctcctcttctctcctcaacagactatagcggcatctacagctgcgacctgcagcggcgatgagctgcaccaatccctccatccccactcttctctgtttctcccccgggtgctatggcggtggctgtggttgtggctgcggcctacaatgacaatggtggcggctgcgccctgaggtgacggtggttacgttactgctgtgtggcaccaatccatccccactcccccaagtggcagtggatgtgatattgtgagcctatgacgggtggcggtggctacatctggagatccacttctctcctccaagcggcaaccactacttttgtactagtttatttctccacatatctgcttttgtacacgtttaatattcacctttcaaattttatactagtttatttcctcaactattatcatttgtctgatcacttatacttttgctactcccctaatctttaaaataatatgtataatttattatattatgggacagagggagctttaaacttgctattagcagctactggctagccacgtacttctaattcgcatttactctttatataatgtaagcaattgttgtgacggacaatggcgtgacaatccgactactccaagctttcatcagtccgccgctctgagcccttcgcaccttcatttttgatgatgtgaagccacttgaccattggcatgtattcaagtaccgatttcgtctttcaaacttatatggactatgctatcaatagttacttttataatgattaaccaataagtggttgaaagatatacttgaaaaacaaaaggcatatacattaatacatatgtaattaaggaacgtattttagaaccccatgatgtcaaattcattctagggctcttcacagatatagagtcggtatggtgccgagagcaaattattagcatacaaaaatccataatttttttgtggccagaaaccgtaaaggataacatcgaaacttgacggctttcaccaccaataaaatcagctgaccgtcgagaaaatactactccctctattctataatataaagcacaactacttttaaaagttgtttcataatataagacgtgcatacatgcatgtcattaagtagcacatatttttcacttaaatattattatttaaatcctccaccatcaagatctctaattttattgggtgcatgcattctatttattagggtaatccaaactatgatgtgataataattatttcttggtctttgggttaagagtggttgtgccttatatctagaatggagggagtaggtttttgtagtttaggtccgttccccatttagggcccctttgaatcgcagggtaaaaaaaacagagaaataggaaaaacacatgactctgacaggaattgaagtgtaaaacagaggattgcaaaacacaagaaaagaatggtcgtttgattggagcgcaggaaaaacgcaggaatcggacgagagagattgactcaaaggaaattttccaagaggttggagctcttgctaaatttcctctaaaatccacatgcaatgtcccattccattggaatttcataggatttggacagcttcaatcctttgaatcaaagggccaaataagaaaatttcctatagaatttaaatactataaaatttttatataaattctttgattcaaatggacccttaaccagccgttcatcctccgaaacacggagcgctatcgcaagaaaggaaagttggtatcgtgcgcgggcgtgacacgcacgaacgacgtctggccgagatgcgccgccgcgcgcacgctccgtctgtctggtctcgatcgatccacaaaccacagcccgctgcacgcaggccaggggtctcaaaacgcacgcacgaacgcacgcacgtgatcgaccacctgatcagcgcgcgcacacacggcgcaccgcccgcctcctctctccagtggcacgcaccgcgcggtatgcacgtactcacgcatgtgcgagtgttaagtgagatttgcgagccgcatcgatcgatcgatcgatcctgcatggatggcgcatccagtgcccgggtcacatgccaaggcatatactcagtgcaggagtgtacagtatagtgattgggtagcgagcaaagctgaaagcttttgtgttctttttttttttcgtttagatttcgcagcaagtactgtagcaccttttcgtggccacgtaccctacacgcgcgcgactttacgtgcgtatatactgcgtacaacatgctgctgcgcctagacgtacgacatattttggtatagtaaaatactagtgtacgtacgaccagcacacaatattcataagagaccgacgaccaggtgaaacatgcttacctccgaagcaattaacagccgacacaaaagaaatacattatggattatgccattacgtattgctggtggcggtaatatataaatacgatgggtacattgcgcgctctctgtataatagtacttctgttggaacttttttaaaaagaaaaagactgaaattgtttgcttttcacacaactggatcatacacagcacaatttgacagtttgtgattagccggagggatcgactaaccttaccgttgatcattggtctcacaaaatttgcaaatgagccgttgtctcaagaacgcacgatatgccgaatgcatggccagccgtcgccgtcgtttccctgcaaatacatttgctgtcttccggactggttccatgcccgtaccacccccaaaattcgagccaagacacaaacactcttttttttttgtcaggcacgtgtatgtacagtaacgtaagcacacgtatcagcagctgctcacttagctagagagcttgtacttagagggtgtttggaaaagaggggctaaactctcaaaaccataaatcatgacttatggttttgagagactcctaaacatcccccttatatacgcctccatatggccgagaatcccctatttctctgtgcaatttcttaggatggtccctgctgatcagctacccgtctctcagcaatgcgaatcgtgggcattgggcaagccggctatatagccagcagagtagcagactgaccggggtcagggcagggtaggatgccattgattttcccaattcccagctgctgatgatgctaaattgctaagaacatgtacaatagcgggttataagccagctacaaatatattttaaggagataaataaggagagagaagagcagcgggctatagatttgtagctagctgtagcacggactttaagacacagtgtgtatatgacaggtgggaccagatattaatagtgtggtatgtaactattgtataaatgagttattagattggctatatataaattggagcaagtagttgggtatactattgtattgaacttttgatctaatgagtggcgattaggggctccacctcccaacacgcgtggctcgcgccgacgagtgctcgtcgtttgtttatcgcagccagaaccatgttacgcacgcgagtgaaaattggttgattctacataccaggctaccagcgccgcaaccacggtcactgacatgtgagccttgtaccgggcggttagcgtgggcccgtgttgtcagtagcagtatcatctcttgacgtgtgtgatagatcgtgagaatacaaccgttttttgctccatttttataaattatcaccggcccattcgggttctggcgttctgctactgttttggggcactctaatgctctaacactatagtatcatcgatggtttttcttttttttttttagaaattacacagtacaacacagacactcacaacacacgcgcactcattcttatgaacacacgcacataaaccctacccttatgaggatctttgaagactggaccggtaaatccctggagtttaatggtttttcttcttcttctttgagtgatcgatgttgagctttaggaaaagagaagaaaatggtcctgctcgtctgtacaggaccccggctttaactataattgcggtgtcgtctcccagggcactgtgcatgtactcctcaccgattagcagctgaaacgatgtcgagtggatgcatgcatcagtatcacgcggtcaaatttggaggtgaggccagtgttggatctcgtttcaaccccccggcattttggcagatttttgttttcttccgaaggatatatacaacttaggagtactaagctttaattgatctgagtgttttgtggagaactacttgttttttactccctgtcccaaaaaaaaatgttaactaagattagatatgacatattctattacaacgaatttgaaataaggtatgttcaaatttatagtactaagatgtgtcacattcaatattagatttgttttttatgggaaaaaaaaggtagatgagaagtagtagtacatggtgagtactgtaatgtgatgaactccctgttaaaacatgtgttaatactatcatcaattaatgtagggacccggatctgttgcacttaacactatagcactgcaacttaagcagtcgcactacagtagtccaatcaaaatctaaggatccaagcgtcacctagcacgataagcaacatagtatctgctcctcgtcctataatataccaatctagtatcagatggaacattagtcctacctatgttcattgtactatgtagtgtcccatctggtactaggttattatatttattatgggattgagaaagtcctccatacgatactatactataattctagtattgtacttctggtaaatctgaaccattcacctctgaaatggatggatgaaatggcacgcaaatgtgcaatcaataacttgtcgttacagggttaaactcttatacctctattgttatgaatttaaaattaattaaaggctaaagattacaatgaaatactcaagatcaattttaatattagattttaaaatttaagttttaactatggctaataagttaatgaatagacgatgaaaccactcgaaaaacatggtctattgttaccatggtgatgttagtcccgttccaacgggatcttgcgatcccggtaagactgtagctgctcgagcgctccatcttagagcttccccagcaactcatccaaattttatcctccatattctcattaggatggtcgtctaaaaagattctcactccatatttcttttcactctaatagatcatccatattacattcaccattttgtatcatcctatattttactaatatcttttaaccaccacacattttatattaatttctcactaactcttcctctcttctacttcgtatagacggcgaggatgaggagggctgatgggtgtttcgggggtggtgtggtgcggtcgttggtggagaagcagcacgacgggagggggaggtgcgatagaaggcgttggcggaggtggaagtcgcgggcgaaagggagcggcggcggaaggcgggagcaaagggggcggtggtggaagtcgtgggcggaggggaaatgcggcggtggaagttgcgagcagagggaaacggcgtcgaaggccggcacaacaccgggaagggaccgctttttctccaacgaactcccccaaatctggttggtgcctcctctctacctctctctccaactcttacaagtaatccagtcggagccacacctcattctccctttcttcccatgtctgccgctcctcatcctccctctccttctctgcctgtcactagcacagatgctgcgagagattgaatcggaacttcggatgggggcaggagctgcggcggttacgataggacgtgaggagagaggaaagctaaatttgacgttcccctctcttatttagtacacgcactatttttgacatagccaatggtgtatccgatgaaggctgattttttacccccctacgttatttttgggaaaagtacagacaaggtccctcaacttgttagccagatacaaaatcatccctcaaccgtaaaaccggacatccggcgtcccccaacttataaaaccggtcataataggtccctcggtggttttcatcctagttttgtcccacgtggcggctgacttagcgtgggacccacgtggaccccacatgtcagtaagccacatcagcaccctctctctctctttctctatttctctccttcctctcgctctctgctcttgcacaggaggtggcacgcgcggccgaagggtggtgcggccggcgacgacggctctcgggtggcggcgcgcgggctcagggcggtgcgagatcgccggcctccccatccccctcgtgcggtcggcgatggcggcgcgcggctgcggccatcataactgacgcggaaaggagggctgatgcggcggcggcggcggcggcgtcaccgacacggtggggaaaagggttggcacggccgacggggaaggagaaccggagaggaggaccggcgacggagctagaagccacacgcccggccgacggaggcgcggggaggccggtgagctcctcccaagtccaaatctggcggcgaggcgggaggaacccggtgacgacggcgggaaggcacagggaggccggcgtcggcgtcgaggcgggaggaatgcgtcggcgttggctcaaaggagcaaggcggcggtgaggggagcaaggtggcggcgtcagcttcctctccgtgctcgccaatgagaaggagcggcgggcgaccgtggcggccaagctagagccacacgcgcggccagcggaggcgcggggaggccagcgagctcgtcgactgggcggtggcgacgaggcaggaggaacgtgtcggcgtcagcttggcggtggcggggaggcgggaggaacgcggcgacgacggcgacgccatgacggcgctcgagaccgaagccgcgacgccctcgacggctgccacccgcgcccagctccttccccggtggctgaggctgggggagacgtcgacgccgtcttcctcggcttcgtctacaaccacgtgccgccaccgcccttcccgctgcccgtcccgtgcctgtttgttgggtgccgcgaccacgctgggctgccaccgcccttcccttttcccgtgttgccgccgccgcgtcgccggtcggcggtcgtcagacctcctctcccgcctcaccccggcgacctccccacccgccacccggcccgcccagcctgccgagaggagataagtgagagagagaggaagggagaggaaagattgagagaggtgatgacatggcttactgacatgttgggcccatgtgggtcccacgctgagtcagccgtcacgtgggataaaaccggggtcaaaaccgccgaaggatctattgtgaccggttttgtaagttgggggacgccggatgtccggttttgtggttgaggaatgattttgtatctagctaacaagttgagggaccttgcatgtatttttcccgttatttttcatatggatgatactccctccgtcccacaaaacatgacgttttaaggttagcagccaaaattagctgttgtgcaaaatgaccaaattgtccccatgatttgattaagctgtcatttacagcatttgtacatgcatccagattattctagagaagtttcctgaaaccacagctcagtgccacgtgttaacgaattggcgccttagccacacggttgatacagggcaaaaccatcattaacatattcaaaaatttgaatcaaccatgaagcttgctttgccgcccaggagtgcctcttcatttgctagttctggcgcccaagagtgcctcttcatatgctagaggtcatgaaagagccatccatttcattccatttcatcaacctacatatccaaccaaacactacacacatccaatccaaatgatcagagatctaaatttgctactggaagaggaaggagaggaaggagatcaaggggctttacctgatctcaatgaagaaattgatatggaagaagatggaagacatgttgttatccttggagataaccttcttggagttgatggccaggaacatggaggttttcttgatctcaacttgcatccttttgatctcaacatggtggctacagaagaagaagaaatgcagcaaggtaagatttcaatacttttggagaagcactggtgctatggttttataaaaccaataagatttcaataactgaagatctaccttggcttattagctggataaaattagagcaccagtccatcataacctgcagctgtgaacagatggtgttagctttgaggttaagtgatttacataaaccactttcaaacaaataacagcaaaacttgatcagatcaatctttttcaacataaggaaacataattcattgaacactcgcagcaaaaataattcattgagcaatgaactcatttgatcagtaatatctctaggaatctaagaggccatttgtgatatacagcagctacaccatgcttcacttaatcatttatatagcaagaatatatatagtaggtggacagcagtaccatgctttactcttattattgacttcagtactagactctaaggcctgttggattgcctacaagttgtagtagaactacatgtcaacagacttgtctatccttatggctgtattattaaaataacaatgtgtgcagtgtcaaaaataaatttacacagctaagccttggaaaagcattctctgattgcacatatatttaaagtgtgtaggtatagtgtgcatgcagatttaaaagtatactaaccaacaagtatttggatagacaacgtgatgcaccatgtggcgcacatcgtg

SEQ ID NO: 69254 - DNA, 554 bp, Oryza sativa
agctaaccggccttagaggttgcgtgtggcatgagcaaacgctacatcggtagtcgagccacgcactatgtcctggtgtacccctctcggcaacatggtagcagtgggaagcattgcaccgacggccgtacatgcaataaaaaatcatgagaagattagtatacgttagtaattaatctaaatatataaattacaaggaggttaggaaccggcagcacagccaaatcccatcactcattaaggaacgattttttgatctcgattgccatcctgtgcatgcgaccaaccatcgctccagtatacatgcaaaacaaacagatatagtttgattagccttaaaatattacacgcttaattgtgtaatgcatatatcaagctagggtttgatattaacccgtgcatatcagttgatcaacacatgcacgtgaagcactcagtcgctgttgatcccatggacatgaattgtccccgtgtcatatgaaggttacgcaagcacctgtacagatcgtaccaggtgacgagcagacacaccgggagttcgtctcgatctcagc

SEQ ID NO: 69255 - DNA, 11520 bp, Oryza sativa
gacatggatcttttttaaatagctatagataaccattgcgggtgcccttagagggtgtttgggtttgcccttcccaaacaccctcttaacctcaaagaaaatgtgaccttctagcgtaacaaatcttgataaagagcagtctagatttataatcatagaagaggtcatatttctttctggattagattttttttagacagaaggatggattagattgtttttagacagaaggaggaatattatagtggttcatggtcgccttcagaattttctttttaaaattttataccaaattttaaaattaaatatcccaacattcttaccgtgttgaaaataccgttatacgatagtaatatttagacagtaacaacgattatcccatgtaatgatcacatacattaccacaatatcttagattgttttattttgaaaatatactggaaaatggtttttcatgctttatcactccaaagaatcccttcgtgatcactgcagctgggtaccgctgtttgactaatattttctacacggaacttgaaaaaatgtattctgtgtcctacatagccccatccccttgtcagctttcagtttagccgattttaaagtacttcttgaagcacaacagttccgagatgaatatattaatctctttagtcttcttttcacgcggagctttatattagttaattatacataaaagatccttattgtgtggttaattaagtgttttcatggaatatactcgtaaacaaatgttatagctagtactagcttacaaccatggggcacaaaaactaaggaaagatcatgtaaaattacaaaggatgaaatataatttgtttttttgaatgaatttgctttggtccacttctgttaccaaagatttagtccggatcacatttatcaaactttttcactttgaacaatgtaatattatccctttcttattgctttggatcatcctaaccccctttatctcttgatatcaggcgcatcccatatataaaggtgtggcctacatatagcttgacaagtttactggtatgcaagactgatgtaattaaggcagagttaggagcggtctatgtacaacaaaagtatttttttatttaattatctaaagtgaaaacattaataataaagcgtgtggttcaaagcggaacttttataacaaaagaaaatccaaaccataatttactcattcttttaattgcatttttgggcttcaagcacgtgtaagagcaaatttaatagtatagctaactactagctctaatttatttatagcaaatctaatactccatccgtcctgtaatataagggattttagggcgatgtgcctgtccagatttgtagtcctagaaagtatcacatccccaaaatcccttgtattatgggacggaggaagtagctcattcatacaatagttacatataaacatatactatagtattaatatattgtcacacctctcatactcacacaacgtattagagtccgtattgcagctggctacaaatctgtagcccgcttttcttctctctcttgtcttctctcctccacatgtgtttacagcagacttgtatatgctactgtactcgctctaattgtaacatgctgttgatgtgctttatgttttcagaccaattgttcacccttgtcgcactttccaatctaaaaaaagcttggcctgtgctcgatctatcattaaagttgtcatgtgtctaattttgaattttagaactagttttttttaaagaaacatttaaccactttggctctagaaccttgagtagaaatttgttttcatttaatttattttcgatggatgacatactactataggcaaaatttgctacaggacacataaaatttgtataattagctgagggacaccgtaaaaacgtgacattgctctaggacactaaaaaactgtgaaatttaccgaccggacgcattattttattattttccagctaaaagtgatgagatttttttcgaaatgcccagattgcccccgcatgtcaccacacaccaaaaaaaaatctccatcgtccggaggggtgtggcgagcggcagcggcacacccgtgcggcggggcgcgacctggcggcggcagcgccggtgcgacgggggcgcggccgggcgtcggcactaggcgtgacggaccgaggatggcgcgacgtagcggcggggctaggatagtgcggcgcggcgatgccagcggctgggcggaggtagcgcggcgtttgcgggatgtgtggctatggaggcggcgtggtggccctacggcggccggcgacctggccagacaagatgccggtgtcgctggggagctcttacgatgcgtcatgcctagctgtcgtggcaccctcgctggccggcagctcagcgcggcacatcccgcaccacaagaagacgcaaccggcgtggtaccacttcccgccgggccgaagcagctccctcgcagctgcagctgccccaacatcgggctgagcaagctcccaccttcttcgtgagccccagccaaggtggtggtcgcgtcgctgccagacgagctcgcggagttctgtgggggcttcaatagcacgagcgttgcagcatgaggaggtctagcatcagcgcgtccgacgtgatgcggataaccccgttgagctccgccttacctgcgcgccgccgacgcccaaccgcgccggtaccacctcccatcctgttctagcgccacctccaccgcgtcgagccaaccccaacccctgcgcatgaccgcgcagcgcctccccgtccgaggcgccacactggcccacgcctcgctgtgcagccgtcctcggttgaagaaagagcagggagaaagagagaaagaatgagagagaagataaggaagaataaagaaaaaaaattgaaggtaaaactatagttatacatgtgtttatctctccaatttattcggatataataaaataatctgacaagtgtccagcagctaattaccgattttctgtggtgtccttcaacaaattcatgtttttactgtgtctcttagctaattacacgtttttttatgtcccatagtaaatattgtctactatatatacacaccctctatcctcaagtgaatcagcttctgggggtaaatcagaagatgattcattttgtggagaagggagtaggtacgattttttcgacaacacgtaattagttttacttgtaacccccaaaagttagtgtatttaatccttttagagcccctgtgagaattaggcataggtgatctttgatcagcgtagggacatgcatatcttcctggttggtagctcgtttccaatcctagattctttagcaagttccaacaaaagcacatcattctaagcaaactcgtcgcgattcaaactactactactggttgtcaatattaatatatatgtgcgcgcccttaaaagtttatttatgttttctggttagacaaagaaataccgcgattcatgttattcgtacgagttatagtactttgctactcctatatccttttgaaagaaaaacgagaggctgtatattgtgtaattgaagagacgatgatgattagatgtgcatgatgacgaagagcgtgtgcagagtacggagtggagtacttctagtaggagtacagtacgtgagagtagtatatactgtagtgtacgtgagagcaggtacactagcaggctataagccagctataaatatattttaaaaagataaagaaagaaagaagagcagcgagctacagatctgtagccagctacaacacggacttcaagatgtaatgtgtatgacaggtagaaccatatattaatagtatagttagtaactattgtatgaattaactattacattagctataaataattttaatctagtagtggactgtactattgaccttgctatgagagtactcctactaggagtagtatactgatcgtatttcagcagagcggaatcaaatcaatatgaatccaaagttcagaatagattttgtcggggagaaaagacagcgcaacatgagattcatgacaccgcggttcgcagctgtcttcattttctttgttgatatgataacctcctagctagagcatcaattttcacgacgttcatctcagtcactgtcgtttgaccgatcatatattctgttacaagtaatggatgcatttctattactccttccgtaccataatataagatattttaagtttttatttgcaatgtttaaccactcgtcttatttaattttttttaaaattattatttattttatttgtgacttattttattatccacagtactttaagcacaacttttcgttttttatatttgcaaaaaaaatttaaataggaagagtagttaaacattgtaaacaaaaactcaaaatacattatattgtgaaacagagggagtataaggtaagatacattataaaaatggtataaactactactatcaggtattagcatttttatatatggtgggtctcatctatcattttaattgtggtatgattcatgtttgaaagaaaattttagatgaatcccaacttattatctaacataaatacattatggtacgtgtctctctaaactactattactacttaatcaacaaggcttcgttttactatatgctacctccgtcttaagttagtggtcgctttaactttttcttacaacatttgaccattcattttatttagaaattagtgcaaatataaaaaagataagacatacttaaagtattttttaataataaagtaagtcaaaaaaaataattccatatttttgaataagacgaatggctaaaagttacaaataaaaactcaaaggacggagttagtagttttgtaataaatattaaagatactctgagattccaaagtccctgagggctgaaatggttcgatcttgacgggatatgggacctgaaatcaaacatgtgatcgtgatggacaggatttgcaatcgtaccagatcgaacagattgttcaagaaaaacaagagagagagagaaagagagaaagaaaagggagtacgaagtattccagtgacaataatattgctcagaagtacagtactactgtagaaattactcctctcttcattccaaaaatataaagaattgttggatgaatgtgacacattctaatatgtgtttagttcacgtcaaaattagaagtttgtttgaaattaaaacgatgtaacgaaaaaatgaaagtttatgtgtgtaggaaagttttgatgtgacagaaaagttaaaagtttgaagaaaaactttggacctaaactaggcctaagtttgattcggttagagggagtagtactcctaaatggcaacagcattataagttaccgtgatatgtaatgtccctgtcgctgataagattcgagcacttgacaatcaatttgtcccctaacctttctctgtaaaactgatggaccaccaaccattttgacaagcgcagcaagaaagaagaaaagctggtggaaatcataccaaacacgtactccagcttttcgcctttgtagcagttcaaagctttaaaatacaccaagctactccacattgctgcagctaggcgctttgcaacgagcctatctcgctgcaaacaagttccatgcaatgcaagttcccatgcagccacatgcacgtccatctacaggcaaagttcattgcatcggtagtgggctgtccccgtgaaaccctcaggcaacactacagctggttttgtccctagtctctacccttattttttttatctttccaaactttgattagctagagtagctctctactccttgccgacaacttcttcgaaatggtggcaatgcaatcacctgagcctgacatccgggacctttctttggacgatgcatggtccttgcaactatcggctactgtatgaccggattaagttttttcatgcgtgtatatggctgcattttgcacagagcccgcaactgctttcggagagatgatctagggcgttcacgtggaatatattcggcctttgttcggcaggataattatgtcatcaggatatagaatggcccaactggggtagtagtagagatgatgagaagatctgtctagggccttttcaacagcggagcatgtatatatggttgagttcagttacaaactttttcttcaaaattctaatttttttatcgcatcaaaactttcgtacaacataaactttcaatattttcatcacatcattttaatttcaaccaaacttttaattttgacgtgaactaaacacaccctacatcaaacactataaaaaaaaaagaaaatcgagacatcccatgcacgcaattgtctcaaattaccaggctattttcttcgcatattccggctcgcttcagaccttcagttaccacgaatctaaacagatgagcagaaccgcagatgctctgcactctgtagtacatatagtactatggatgcttagcggagaggcctgaactttggagcatttcttgtacacttggatcagttggggaagttactgaatcatataagcttgaacacacatgttcgacgtgttcaacaactggtgaccggttctattttatactgtactattattatattgcagaagtaacaggagtatgttttcttcccattcctagtagcttccttccctgataacacaaggactccacagttcacaccatgcgaacatgttccatgctgtcgactgcaacatcaaatcccacgatctgtttccaatactgtctacttactgtaagcaggtcatggcagtagacagccattgttggctctgtggtgcacaatagttgatggctacaaaacggctgcaatagtctcttgcgggaagtaaataaaatcccagctagctgtgacttgtaacactgcggtggatgatacaaaccagaggcatcaaggtaaagttatcacaagccacaacggtcaacatagcagcagaactgatggaattagatgaggatataaacgtagcactgaacccttcaaataaacgtatagcactgaagaggggagcgcatgcagccacatgtgatgtacttgagtttgttccaaggcatttcaatggacaggcagtgtattatttggtagtatagttggttttgaacttggcatcgccaatgtttacataaatggaacttcctctatacagtgtgtactgtgcaagatttttgcatttcctgtaatgaaaaatatatttcaactccgacctttgcacatatatagctagggcacccagctaaatttccagatcaaataaaaggattgttgcatatgtgcacgaacgccaacattctcgactatcacacacagaagaaatggcatatgtaaagtaactctaaacatgagaggtagaccaaagattaattaacatggtgcctaagataagtaatcgtggcctctgtaccgtaatataaaagattttctttcttttatttattttataatataaataattttggtgtactatttgtcacatccataaacactaattcaaatttctacctattttaaccaccaatatattatccaatcacccataaccaaatctcatttaatgtgtatattctagttttttcttgctatcattagtattataaaaaaagagaataatctcttatattatgggacaaaacgagtaataaaaaaccacatccaagcctaaaaattagtaaatctaagagaactatgtcatctagagagaaagtgaaacaaaaaaaaatcctaattaacacattccattacacataaatcttttcccttcagtcgtagcatcatataccagaaaagaaaccaatgggaacacacatagataatctgtaatgaattagaaaactacccattatcaaacaatatcattttggcaacgtcataccgaccaacaatcctctctaatctccacaatatcgttgttccgccaaatcatggttcaataaggtgctatatatctagacagtaaggtaggccacaacctggcccggtggcccctatctagcgcactactaacccctccgtcaattcatggttagtcttattgcccaactgtagcacccctctcaaactatgcccctccttcctccgtcactttagcctgatttaacttcttctccttatctgttatttccccttctcataggtgcccctacattgttcttcttctatcaccgccgaacggcccttaactgaggttttcttgattcccctattgcccgccattgggccgtcattgcactgacctccctctaaccacccccacgtcctacactagctttacctgtaaaatcttattgtcatgtttcgttgttgaaggaatcacgagagttaaaggagaagatgggtccagcgcataaatctgcaaagtccatcggatatatcactataagatttcttcatcagttttctcaattttctatcacaaagtagttaccaaattggtatgatattaacttatatcatgatatatattcggcggggatgtgtgaacccatctcccacatgcataggttgaaaaaatatccttgaatttactctcttttggaatacaagattctagaacaacgaaaataggaaaaactttagaacagaatgtgacactgtgaaatcctatggtattctaaaacatgtgaatactaaagtttgttcctatagatagttgtcaagaaataaatatatgaatttcaaaggaacttgcttgtgatagagacggaaactaaagaggtaaaggaagagagttcacgaaggaaaataaaacatgaagtttgactcatgtgtatttttctatggaattgggttgggttggggttggggggggggcaaaggagggcaatttataggaattccaacatcctattcctttgcaataaagggttcaacaaaaaaattcccaaggatttgaatcctccataaagtccattaaaattccttcaatccaaaagagccccgcacgtcatatcactacagcatgcatgtttcctacattagtatgtactccctttgtttcatattaactgttatttcagcattatttttttgaaaaaatatttatcgttctcacatcccaaatcatttataggttgtgtaggttaccaacatctcctccctcgtttttcgcacgcacatttttaaaattgctaaatgttaacctttttttggcaaaaaaaaaacttctataggaaagttctcctaaaaatcatattaatatatctttcaagttttttagctaataattaattaatcattcgctaaaccacggctctattttgcatgctgtgagggaggggttcgcaatccctgcaatcgaacactgtctcagggaattcccaaccctatacctcatctagtttccatagctttaagtacattgtcatataagccaaaaggttgagttggcaatagagttaactaggagagagagagagagagaaaaaaaaaagatgaataaactatttcttatgcaggaaactagctctacacataaacaagaataaaaacaatgtgataaatagataaaaggagagaggagaggtgaacggatgaaaaattgttttgaagaaaccatccgttgagtatatagtttctacacgtagcgactatatgacatagcagatatagaaattacttgcagtttataggttggaattatctttcctacccatctttcatcaattaatacaatcatatattaataatcacacaactctcattcacttgtgtctcacgaaaaaataattatggtttacttatgaagttaacaatgtaatttaccatttcttcatggtttatgtagaaattttactgtaatgacaaggaatttgaattagaggaagtactaatagtaggttgtagtagtattaatttactcacgactcgtaatgacattttatttaggctaagttcgagcctgtttggtagagttttaactcttaaatttagctctaggagttgggtctgaagatgagttgtagagctgcctaaacccagcttcacctccttagtttattttgtgagagagttccacctaaatccactctcattttagatggaggtaaaactgtttggttgagctccaacttcagtagagatggagctggagttgtgcaaaacaggcccttcgttgcaatgtcctactacaccttaagcatgcagggagagattcctgtaggctacccgctaccatgtcaagaaacacgtcacgtgtggtaacgcgaaatctgccgctcgtacgtacttgagcccctgtagcctggcgcagcaggttagatggagtactacccgcgaacacgtcgacgtattctgccacaagcaatacacatgtacacacctgcacgcgcgaggacgtgcggtacagtaaacgcgcactgttcggcacgggccggtcgtacgcgtacgttgatcagtacgacgcgcgacggcctgcctctgactgatgatgaggtgacgggagccaaagcagcgtgcggtgcctgcggggcgcagcgctggcctcgccgcactggcaaatcaaaagggagcagcagtggcacgcgacgcagcgtgtcggccgatcgcctgcgtagtcccgggtggaaacgggtgttcgatctcccggtgcatcggccgtgaaggccgtggggggtggtatggtgggggaagaggaggaggagttgtcgactccagcggacaggggcgtgcaggtgcagatccgtagggtggcgatgggacgttggaagggacgggagctggcgctcgtgccgtgtggcgtgttgagtggctgggcagcgggcgggctcagctcacacgtcccatcgggtcgacgggtcgtgccgtgccgcggtaggctgcagcggatcgcaagccttggtgcatctcaatggatacgggacgccaggaggtggtaaatccgtgaaggagcagtgatagtgtttgagagatatttaactatttatcactcttacaactgatagttaagaatttattattggacccatatattatagattatgttgtaattcttaattttcacatcttaaaaataacaaacagttaaatgtctcagtatttgatttagttagttggaaattataataattaacctcagcgtacctcatatcttttggaaaaggtcaaatgggaaaacctttgcatgagaaaaccttttagcagtcttacccgagactcctgcttccggaaaagacggccaaaacataggatccgtctgctgaaatttttcactgtttgtgcaaagcactctgctagtaccaatgcgaggaacacgaacaccttgagaaaaagtaacgacattatgtaactagtctgcgttacaagtgaacagcactagagcagcatgccacctcccacttccagtaaaagttcgtcttgggacttggaggtcggggagatgcagccgttgaattttttttatttataattttttttattaaaagttttacaaaaataattttccattttgaaaattgacggaaatagtcgcctaccgccctctgggagggc

SEQ ID NO: 69256 - DNA, 1331 bp, Oryza sativa
  unsure (1)..(1331): unsure at all n locations
cgatgactgagccggttttgaaaccctaggccagtatatgctccgaagatcgtctctttgacagaaccgatgagaattgagaaaacgccaaagctgtgccggagataacaatagtataaatcttgaagtggcgttgccactttgtttcattaatctctgcaggttaaacaagacaaaaacaacaaattaattaggcaaccgtctcgcgggtttagcccggccccctactaccagcttattatatctcgcctccacgtcctcgtcgctcacaacgcgacacactcccaagcacacacacagagcgcgcgcgcgcgcgcccatgcagcagcagcagcagccgcgcatggcggacattgacctcgacgccgtgcgcgccgtccgcgtgctcggccgcggcgccatgggcaccgtgttcctcgtcgccgcggcggcggacgacgccgccggcggcggggcgtgctactacgcgctcaaggtcttcgacaagaggtccgtcgtcgcgtcggcggcgaggcagggggacgcggcgcggcgggcgaagtgggaggtgtcngtgctgtccgggctcgcgcacccgcacctcccgtcgctgctcgggcgcgccgagacgggcgacctcgtggcgtgggccgtgccgtactgccatggcggggacctcaacgagctccgccacgcgcagcccgaccgcgtcttctcccccgcggccatcaggttctacgtcgccgagctcgtctccgcgctcgccgagctccacgccgccgggattgcgtaccgcgacatcaagcccgagaacgtcttcttccgcgccgacggccacgtcacgctgaccgacttcgacctctcccggctgctcccgcccgtctccccctccgcgtccacctccacctcgtcgtcgtcgtgctcggccacgtcgtcgccgccgccgcagctgcagggacatggccggagccagctgaggcgaatcttcgcgagaagtgagtcgtcggtggccgcgacgacatcgacgtcgtcgcccgggcagtacacccacaacctggcctggttcctcaagagaagcgacggcggcggcggcgccgccgaccacctcaagaaggcgaagtcggcgagggtgtcgccggtaagccgcggcaagaagcaggcgagcttctgctcggccgcgagcgcgagcggcggcgccgccgccgcgtgcgagaggtcattctcgttcgtgggcacggaggagtacgtggcgccgaaggtggtgcgggcgaggggcacgagttcgccgtcgactggtgggcgctcggcgtgctcgtctacgagatggcgtacgggaggacgccgttccgggg

SEQ ID NO: 69257 - DNA, 730 bp, Oryza sativa
tctcccggctgaaacaaatatgccctattttccgatacctgattagttggtgtggacaagtaaccctgaatctggactgtcgctctatttaatcctcttatgttggcccttctgcatcatccagcaaggctcggaagtctgagctataaggtctagttgacgtataagaggccttcgatatgttaagggagagaggggagagtcattttagagttgggtgggaatcgttgatagaaaatttttttccctgaggtatgatagcgtctgaactaaagaaagggaatatggaaagtgaatgtggtaaaggataccaagagccctgaatgatttttaagcgtcttttctttgaacaaataaatctaactctctcaaaaatataagtccatctcctagagacttatatttttgagagaggggctaaagtttagcccctctcttccaaacaccccatagtgagggagtaaacaaaattaaagtatgtacatcgacgtgtgaaagtcctcgcccgacttaaaaaggtcaaagtacgtaatctccccccaaatagaaactcttagaacttggacgctcctactttgacccaagccccagcctcctatttgattttgcaatcacggaggttggggatggcgatgtgtcgaaagattctagtgttctgctcgcataatagcacccaaacgatgagggtctatattctgaattttcgtccaaagattgatgaattgtcaca

SEQ ID NO: 69258 - DNA, 19398 bp, Oryza sativa
tacctaacaaatagtgaaaccgggaaaatcggcgttccaattactcaactctcaccttttcccataaataatttcatttctgtttgaaataacgaaaaatatactagtagtaaacttaagaaacgtgtacacgcttcctacgtgtggccataggattcgcttttaaacccaacaggaagcaaaagaaagccgaaccaatgcatttgaatcactgctactacgacagttttgtttttttttttggaggtgaattgctactacgacgacagtagaagtatgataatatactcgctacaagatcgaacagaggatcttccggagtccggacgaaacgcgttaaaatttcagggacgaacgagggagggcttgggcttcctggctcctgctctccgctactacaaaccttcaccctcgcggcgaagtgctaaaacgaaagagaagacgaaccaggggccgggcattgcgcgtgaacacggagagggaggcagagatcggccgcgccgcgcgtaccttggatggatcgacgcccgcgtacggtgcagatcggtgcggcggcgcaggagcacgaagccgacggcgcgagcgtggaggtggtgggtactgaggctgaggcgcgcttcctttctcgtctgcgtgcggcggggtgctttgatttgacgggagggagaaggccttgcggggaaggggatgagtggggaggcggcgcggaaggaaagggtaccacgtcaggagacacgtgtcggctcgtgatacacggggtaggcccgagcgcgggctgtttcgctacgaggcacccggttcgtgtacccacagagttgggtgcagtttcgttaacaaaatctgttattatacaggtaaacagattcacagatatgcgtcgatttagcaaatacttttttagtcgctatctctaaattgtaactgtgagaccttaataaaaaaatcacgcattctctcatatgtctatatttctttattcacttttaataattgtaatagttattatcatcgtcatcatcattattctccgagaaaaataaaatatcattgttagagtacatgaggatgacatgtgggccatcctatgaataatggcgttcgttgggtcccttgcggaagcgccggtgtagagtgggtgggtgagccgggcaacgtggcggatagtttaatttcttgagtcacgctgtcacccgttgcttccggcacacgtgtctctaccggagcggctctacgcgtccacccgcgcctcccacgagggccagctgggtagcctagtcatgtgggtgacgtggtttgctgctccgccccctcctgggccccaccaacccgggggccgaaggttctcccctgcgtacacgcacgcaggaaagggttcggcgccgtggcatctcggtgatcagctgcatgcggatttggcttaactaaagtcagcagatctgctttatcagcacatagagtatagaattagtttttttttctatcgtttcattagcaatggttatagtatatttgataaaaattcacgggccggttcgtgacatagtcgtgggcggcaatttgcaaaaagtgtgctcttctagtgacaaatacgaactagtactcgtgttctgtgtgtagctaaaaatattactaactctagctactacgtgttccttagttttgatacacgtagatcgctagcacgagtggctggttgatcccgtgcttgatttcggtggcacacgctgcaaccaagctggaagtgcaacagatttcgagatcaccatctaacgtgcaattggagctcggagatgccgtgcacggcgcgccacgttgcacggtagctaggccctagctcgcgcgtgcgcgcagctgcagctgcgtcgcgatcgggttgccttctggccacgtagcccgctattcgcgtgcctgcgtgcgtgttgcccgtggggcccagaggtagcgtgcaaaaagattagagaagagccaacgacaaggcgccagatcgcggggcctccacattatcagcttatcctgtgccgtgcccgtctcaggatgggaatgggtaggacatggatcgagtctaaaccgttttaaataaaataagtttattgtactatggtttaatacggtcaatccattataagttcattagatcaatagattatctatgaatatataaatagatcatctacgctcctaatagataaaaaaagaagctcttattgcatgcttgtaaaacttgggcctgaaatttttagactcacattcacattataaaaacatatcaaatttagttgaattttatagagatgatttattatatggagaagcaactttgttcaaattttaagtcatttagacatacggggcccacgagcattactaagatttaaaaattctagttacatgcgtgtaaaactcgaacacaaaatttttaaactcacgttcacactataaaaacttgttaaatttagttgaattttataggaatgatttattatatagagaagcaactttgtacaaatttttaaaatatttatacatgtgaagttattttgggtcgaacctcttaaaccttaggttctaatgctttgagccatttgatccatttatattttttggaccgaccttaaaatccgttaggacaaatttacgaatagatttaatggataaatggatcgactctacccattcccatcctgatgcccgtctgaccggctatcatcgccggcgacacctaatcacctgccctgaaacggcggtatatactaattggtgaaggagacgtgatgctgcgccactccacggtggcacacttgaagattccgtaagaaggcagaggcaagatgcgatctgggctctttcatacttttatgtagactccctcctttccctttttatcagcgcctaaacaagatgaaactattctcatttagaaaagtaagaattaacctcgcgaactatcgcggtcgatcgaattaacctcttaacccgaaaaaccagacattgctcatcttgaactttcaataccggacgaattaccccctcaacccaatccagaatggttttgttctacgtagcctatgcgtggcaatctagttagccgttctcttttaaaaaaaataatgggacccacttatcatacctcctcttcacctattcctaatctctctctccctctctctctccccccttctctctctctctcggaagcacgtgcgcaagacgaggagggggaaccggtcagcgggctccggtcggtggcaagtagcggcgagcggtagggcacgagcggcggcagcgttttcgggaagaaaatggtcgacgatgggcggcgcttggcagtgcgataggcaacgatggcgtgcggcctagaggtggtggtatttgtggtcaacgacgagcgcttcagttctgtcgcgacaatggagccagcactggcgaccccgggggcaccctccttgagttcctccgctcccgcacctaattcaccaacgccaagcttcacgggtgtgctgctatcggtgtcggtcgcccgacgacatcttcactacctcccacctcctcctcgcctctccgccagatctggatgagacggtggatgccctccatgagctagcagagacgtcccccgagcaaactcgagctcctacgcacgggatcgacgagcccccgcctcaagcccacctcaccgttgctctgctgtcttcaacgccctcctcgccaatggcccaccatctccaacccctaccacgccatccccgtcgcgccccaccatatcctcccagctatcggccgtcgaccgcctactcgccatgctagggataggcgagctcgtgcagcccccttcctccccttccattcggactggacctcgccgccgacgctatgtcctcctctcgccgagaagcaaagaagggggacaatggggatatagaaaaaacaacgctgacaagcgggttccactggtttttatttatttttgctgaccgtatcgccacgtgtctgccacgtaggctgaaaaccactttgatttttgttagggggataattaacctggattcaaaagtttatggtgtcaaatatcccgtattgcagttatgggggtaattcaatcgacctccataattgagggggtaattcgttcttttttttttctttcatcaatgtataagcttgatggctgttcggttcatacactgattgtttgatctgcatgcagtaattgctttcacatgcatggtttggtagctctccagtttacatggccaattggttcgtatgcaaaggaacacagggacagtctttgcgccctggagtaaaatgggttacggggttatgcctcttttttttttatcttgttgtcagaactcaaaacaaaaatactgattatcagaagaaaatagagggagtatatagtttgtttttcaccgggacagccaataatacgttgtataatttttattagacatgtacaatgggatgtgaatgggatgtgagtgttgtaaataaaacaagacatgtttaattttcgctaaggtatatgagagagatcgaagagagagaatgaaactacttcctccattttaaaataagtatactcatctatatcatattggttttaaattaagtgtactattttgatacgaatagagcatataaggcatgttttttcagaaaaaagatttttttttagaaatgtaaatggttttttctggaatgtgggaccggtaagaacgggaggaggatatgactctcttttcatagtactagtaggagagagatttcaagaattaatgccatacaaaggataaaaatgggttattcgttggctcgaatagctatccaaacgacacccaggctaagcgttccaacatgtgcacaggaagtcagaaactactctaaaaaccaaccaccatacatgcattaggctgtgttcgcatgagctggataggaacttattccctccgcacggaaaacggagcggtccattagcgtgtgattaatgagagcagtccattagcgtgtgattaatactattaactcattaatcacatgctaatagaccgctctatttttcgtgcgggaaggattagttcccatccgttgaatccgaacacagccttagtttggatgcctgaagacctccatgccgccctcttctcatagaacacctccagtttagtgatgaagtttagtgatgttcatagagatagggtgtgcgtctatacattcacaggcgcgctatgagcacctacgtgtattctgtgattttttagaaaaatggttatgatagttgatgataataagtgaaattgggtttatgataattattcaatagtataaacgagatatataaatattataaagttgataagttgattttaaaaggttttgtagtaaataccgatgaagagtcctttctttcaaagtaattcacatcatttagaagtttataaaatatatccacgataatttataatctataaagaaattgaacaagcccattatcatggttggtaggttgtggaagctctgggtaaaagccttgctcaacctctagctattgcttgcatcgccgatgcctgcatgcgccagatccctatttggaggtgtcgtttagaagataatactctatattttggtgctcactgacttgtggtggtgcatgtttcgtttcttgtgggttttatgacttttgtcggttcccttataaataatcatgatgtcgtaaggtttttacccggtttaaaaataaaaaccatgctaactcccttggtctgaattttttaaaaaagaactcatgccttgcctaaaagtaaaaagaagaggatgcccaattaatcaacgatttcaacaaaaaaattatatttaattgaccgagaggatcttgcattttggtatagtacgaagctaacatctgtagtatcatttcttgttttaacatatagtaaaggccgtatttctttaaaaaatacttatcatccattcccacacacagcactaaagatgtatactagagtcaaaatggttaaatctagtaagaaatgattgtccggttttatgtactctagtcaagtcaaggggaaaaaaaaaggggagtgtttattttgccttgcctaataagcaattgcaacaataagacaaccgagaaaataggtacacgactcatccattttgcatggtgaatgcgagctacaaatagatagacactatgacctagttcatttcttgtaaagataaagattttaccttagtttttattatcacgctttttaaactattaaacgacttgttttgagtgaaaactttttatattaaagttgcttcaaaatattaaatgtatccatttttcaagtttgtaataattaaaacttaattaatcatatgctaatagctttttttttgcatgcccatatttaatctgaatctttataagattcgaacacaatctatgtttacaatgaatatggaaaggtacctgttcaaattcgtttggactaaactccatattatataacatccccaactatgctgtttttttaaaaagagggaatacctttttaccaatattttttctttttattatttaaataatcatgtccagattcgttaaactattgtgtctcatttttaactaggttgagttttttcttttacaaaaggagtacccttttacgaaccatatatatattttttctgtctcccttaatagagccttttattatctaaaggttatatccatgtacaacccatctcattatgaataaacataaatatgtatacacccttttgcagctcagtataacctgctattaataccaaagttgccaaacggaaatacttattctgcgaaattctttactaaaccacacctatcaaagatgttgtaacagtggcgctcaacttaacgaaaaaacagctgtcgacaaagccacagcgccacagacagcgaccgaaaacgagagagaaaagatcacggacccatggaccgcgtccacggaatgatcgacagggcagcggcaaccaagggcggcacgttgccccgcgcggctagaccgctagtagactagtcccacgactccccatccctcctccctctctcgaccactcccgtggactcctctctcctccccttccctcccctcccccgcgcgcggtggtggttcgccggagcgcagcagcagcagcagcaaaaggccgcgagggccgccgtcgggatccccgccgccgccaagatgaacgacgccgatgtcgccaagcagatccagcagatggtgcggttcatccgccaggaggccgaggagaaggccagcgagatctccgtctccgccgaggaggtcagtacttacccctcccctcgcctcgcctctcccccgcgcgtcgaagcttcgggaagcctctcgatccgcgcctccgaagcttttcacccgcccgatctgcctggtgcccccccgtgatctcgaagcgtcgagagctagaagttgatacttgatcctaccttgtttccgaggatccgagcggtttgactgttaggtttcggtttctgggacgagaattttgtagtcgaagcgtctaggcaataggctccctggttccgaggtagatcgagaggaatcgggatccggggtgtgtcgcttgagcagatctcggtgcgtggatctagaagcttccagatcacgagtttctagtccaataaagctcgttttcttactttggactaggaagtactgccacactggatggtcaattgttccgtttccgcccttctctgctactggttagtccgtacctgaatccagttgtggcttgaattgcgataagagaggctagtctaatccaaaggtctctagatcattctagaagcgagatttgggcttaagatgaactgaaacttgaatagggtatgcttgatctgttcactctcccatttcgcttctagattgtgctagaagcacaattggaggataaggttaacaatgagaagacggaaagaggtactaatacatggttaaaggaaatccttgcaacaactggtcaccaccctccatcacctgccaacttatgagctgtagttatccattaccattaaccagccataaacttttttattccttttttttatgtcaatgcaatcataatggagataggatgcatgaacacctctattgcttgttggcatgatgggttggccatgatgaatgtcaagcaacatacttgctgagtgggctgctactgttatgatcatttttacttgctctagcttgtcatttcagctgaatacaactgatccacctgcatggtttgatcgatcaccccttggtgtgcatgattggcaatcatgtttgctaccaacaagcatcatcaattgtgcaatcatgtatcacgccttttactatcataaggtccagcggacatgaacatgtttaatatgctttctgactacaactgtgctggaagtatgatttattcttgaagcaacaggggcatcctcatgtttgtaataaaagaaagtttcattacaatgagttattaatcttctggaaatacatgcttgttttgtttgcgtgtccattcttttcaaccccaccttttatcaataccaatgactgacaacaggtacttgtttgacgagtcagttgttcagattttagtaggctgtttggctttagaaaccaaaccatccagtatgtcttgataaatcatgggatgatcccatgaattttcgtgggatgatcctttcctcacttctccactaagtgtgtttttgagggataggtgatgatggtcaaacccattccgttcctcaaagtaaacaagtcatataggactgagttgtcaattagctccttagttggctgtgtgcatccttatttgatgcaaggcagagttatacttccatcatccgaaaaaaaaggctcaattaaccatctcattcctcaaaccagataaaccactatgcctttatcattgctgacagttggttaaccattctgatttccttccatatgttaacttatttgtataatgtgtttgcaggagttcaatattgagaagcttcaacttgttgaagctgagaaaaagaagatcaggcaagaatatgaacggaaagagaagcaagtcgaagttagaaagaaaatgtgagacttcgattcctcaaattatttatgttttcctgtgttctccgtatggtcccattaacagcatttcatgttgaggatttctgcagcatacagtacattacatcaatgcctcaatacattttagatacagctggaatgctggattctcatttgtgtgcaacattagtagtaaaagctagctacaaactacttcagccacatggttaaattggcagtaatcgtaatttgactgcactggttgttgagacacttaaaaatcaaattcggatgtgtagttcagtgcagtaaacttcactgatgagtcgactgtattttattttttagacaaaattgtgtgaactgctgcttgcagttcaatgtctgttgaagtgagagtatgtatcaatcatgatctggatgtaataaaagttgtacattaacaatcttacgatggaaaaagttagagaactatttgacaaaatggtaatacaaagtacaaactgacataacatgcatactcaaacattgtttaccttccttgcgtattacatttaatatggtactgattgcttgttagcataggtttcatagaatccacctgtatcactatttctgggtttatccatttgttaactgatgaggccttgttttctcctttatcagtgagtactctatgcagctgaatgcttctcgcatcaaagtgcttcaagctcaggatgatttggttaattccatgaaagaggatgctacaaagcaactcctgcgtgtcagccacaaccaccatgaatacaagaaccttttgaaagaactcgtcgttcaggtttgtatgaaatgttgaatacatcatctgctagattcttatccattaagcctttttgagcgatccttctgataattgtggaccccaagagggtttcacctatatagttaagttcgatacgcagaactgaattattggatattgaagtgttaaatcacattgtagttttgcaactctaactgcatgcacaaaagagctagtgctaaaagaacatctgtttatgattcacctttaaacttctcttatggacgtgtcaatttaattgatggaattaagtttgaaatgccatctccttgtttgttcactactgttattaacaaaataatcattcatcatattgactggaaatacagggtttgcttcggttgaaagagccagcggtacttctccgttgccgcaaagaagaccatcatcatgtggaatctgtactgcattcagcaaagaatgaatatgcgtcaaaagcagaagttcatcacccagagatacttgttgaccacgatgtgtacctaccgccttctccaagctctcatgattcccatgagaggttttggtaataaatagtttcttacccttgcagcctgccaatttgctactgtatatctgtactactagtaacagtctagcaaatatactaaaagaaagaaagctatcttttggactaacagataatctgctcagtaactctacaaacatgtataatttggaaaataacatcaatatgagtatacaggtcggtcttgggcctgttaatcagaagtttagtgctgaagactttaactctaccctgacctggacaatcagctcttatctggctattgctttggcatacattatgacatttattgaacagttgatatgctgaatagtgtaatactgcactaggttaagccacaaatacatccgtctaccttaaaactgattgaatatgggaagagagcactacagctcctgatatagcataatgaagtgatcattggcctgttgcagctctctctctctctctctctctctctctctctctctctgcatgttctagtataggacagcagttgggatttgaaatccatagcttcgtttcaatttcaatacttttactgtagttcttaatcctgatatggatcctgctgtttatgctaatataatgtgtttatgcagctctggaggtgttgtgctggcttctcgagatggaaagattgtgtgtgagaacacacttgatgccaggctggaagttgtcttccgcaagaaattaccggaggtgccttcgtttagctcgattttaatattcattttgttccaccaattccaaagtttcaaccatgtatacaagtagttcagtaccactagaacatttaaacatgatttgcatgttcttatttgtcaatttaacaatgaccctgataggctacagcacatgcagagcaaatggttataccttcatattttcattcttcttcccgtttccttgcagatccggaagcttctttttggtcaggtgacggcataatctgtgcatgtaatttcagctgcggtatagctgcttccatgtaattagctgcaggttcgaacctgcagctgcaaggaatttcacctgtttgtgccaaattgattgtttaaagtattcatccgctatgtaaaacactacctatttgttcattattatcgccgagcaccaactattcgcacgcttgtttgctcagaggtataataataataataaaggacggtcaaacgttccattgctgtgtaaacctatttgcctgttgtccctggcctgttggtctgtaattccgtatagtttgtgtaactctggtgtgggcctatttgattctctaccctacctatttattggtagtgctaaaatctaggcatattgtggcactaccaattttttggtagggtaaagttaattagcctacttttagtttgataccaatatggagccaaattttagtactatgatgaagaatatggccaaattgagtatcggccttatcaattgtttggcttcaaaccaaactaacatatttactatttaaattaccaaaattttggtagggcaccgttttagctttaatccaaaacggcctatagttcttaactgtactatccgccgccgccagttatacattgctgctgctgttcagctgcaaatactcaccagccccagaagttctacagaactcttgaggcttcagatttcagaagagtccagtaactatgggtggttattgttttctacaccccaacactagcgcttagtactactcaagggctgaagtcctggaagtgcattgagcaaatacactagcagtccacctgcgacatgactggcggaagccacggtcctcgccgctcagcacgaaacaagccggcgggtcgggccggatgacggtaaggccactctggcgaccagcgatgcgaaagggcggccggcggcagacgagacgagtgaatcgagcggcgcaatgctatcgatctaaagaaaggaaaacgaaccatgtggtctctcgttgtccttggttgggcaaacgctcctaccagcacaccaggccttcttgcttctggtccttgtctaataggccgatggacaagaacgtataggccacgtatatgggcctagggagcttggaaaacggggccctgcgagagcgcgcaggctgcacgccccggggacgggcctgagggtagggtgctacgtacaccttccattaaaaaaatcaactttgaagatgaatatggatatatgtttatccaattttgtccttagaaattggctctctattaaaaaaaataaatctaagattgaatgtggtgtaagtgttccgatttattatactaatttatatcacatttaattttagacatgtttttcaagggacggaaggagtacagtgcactggtgtacccaccaatctggcctccattgttaattcgctatgctgtggcaaatatggagttcatccatgacgcaagaatatggaatcttgtagtaacagcacctccacggctctactattgcctgacacagcgattggtggtttgttttgcgcgtatctgaacaggattagcatttggattaacagaaactaatctgaagctaggaacgctccacctgagctcctcgatctcgaccaatatcaaagtcttttcagtctgatggtcgtctctctctccatccctctctcttgactgattgatgctggttagattaatcgaagtgagacctgagagcgagcactattttattgttagaaaactatgggacaaattacttattttcagaccacggttcttcctctgcaagatttctattttattactgtttttgtgggcgtctgacattagttaattagtttcaagttgatacagattgcgtttgaccatctgcctatctaaagatacgaataaaacagaatcgatgaagatttgttgcgttcaacagttaaatatgcaataacatggattcagcaggttggttctgaccgattctattcatgtaggtgtgcgcatcttccgtgcagtgacttaaaaaaaaaacgtctactaatcgtggacgttgattgagagaaggatgatctagatcttttacgacaaacctagccgttgaaacgggaaatacatatgatacgaatccgtatcggaagtatgaccagggtataaaaacagtttggtcaggtttttcttttgttttctttagaacaagtttaatagtataggtcactactaactccaaatcatctataattaatgtaatagctaattcatataatatttgcttactatactattaatatctggtcccacctgtcatacacacattacgtcttggagtccgtgttgcagctggctacagatctgtagcccgttgctcatcgctcttcctttatctctttataatatgtttatagctggtttatagtatgctattgtacttgttcttatgcgacctactacttcgaacggttgatatcaaaatctcaatggtgtgctgcccacctgcaacagttagcgggtaaagtcactattcttaacaaacggaaagcgatctcagcgccgccatgatcttactaaagtacaacagtaagcaacagctgcaagctcgctactccgagtaataaagcagagtttgtgcggcacacgtgatcacttcgctcgccgtcgctccacacatccaccgacgtgcatgcagagcatggaatgcatcagagagcgccatggcagcttttgaacaaggcaattgttgcctactggagtactattagctagaatacgacccaccccacgcagcacctgcgctgcgatggttggatggagcgaatctggccgcccaccatgcaacccccccgtgcatggctggaagcgcgccatgtcacgcccagcttttctttaatctctcatcactggtctgctcaccatcacccttggcagcttgcttgctcatggttccgaacaaatttatggtgttgtaaacaagtttaatggcgtacacttgttcgaactcctcgggaaagcatgcatggtggcggtgtgtgaggaggagagagagagagaggcaacaacaacgtacaacaacgggggcatcgaaccgtggagagcatggcatggggaggagtaaacaatctcgtgggggcagcatatataggaattgaaaagaggcagcatacataggaaaagaccaccaccacacggtccacacaccatacgtacccctcgtgcagcggtggaggaattttagccgagcgagagcatcgatccaactcgcgtggcgcagcatctgggcgcgcggggggagcgggagcggagggagattcgccttggcgctggcttaatttggcgctagctggcggtggtggtggcgccgcgcgcgcgggtggccatgggcggcggcgcgcggcaacggcagatgcgcgtcgggatcggcgcggcaacggccgcggggcggcacgtgttacaaaaccggccgtgcgcccgcggatcattggcacctgccaccccccctatcgaccgcgcgcgcgcaagatcggtcgatctatcggctgctttattagggttttctccgatcaggccgggagctatgcacgtgggacgccgtacttttccgcggtggcggtgttagaaatttttttaagtacagtcaaacctagctataacttttatttgctacaaaaatttcatcaccaatttattcaaaaatattaaaatctaatagagttttcgccggtgagactgggctaaccggagcggtggctctgcacatgcttttccgcttctacggtatagcggggacagacaggcgagttttttttttctcttttagaaaagctgaattgatgtcgatagttttataggggaaattttcgattaatagacaattatattggctctaagatcagtgcaaacagggatgaaaaaaaatcaaaacttacttgcgcttatgatggatcaaaaccgtgaccttgccttcctgctaggagtgcgctaacactgcactacgtgatttttgtgatggaaatatgccatacatgcaagttacaatattattacatctaattaattacactataattacatttaaaaagttttcaaccacccccccccccccccaaaaaaatgttttcaaccaaaaatttgttgaatgttttctagatactccctttccttttttttttctaataactagctgaatgtccatgctttatgatggataaaagaaattataatattatctaaagcttgtatataaaatatattttaaatgtgttactcgtgtttttccgtcttaatttgattttatacacgactatccattcatatatttaattgaggagtaaagataaagattcacaataatcacatgatgtttctgcagaatgtggaaaggcttatatgaaataagagaacgaagcacgcccatctacaggactatagatttggcagctgcggaaatggtatatgatttatgacagaagttgtacagctattgtctctgttcagctcattacgtttgttgaattctacgtttcaatgttgtgctaataaatttaagaccagatacatgtagatgcttgatttatttctcacactatacatatatacataagaggtttcttcatcctcgcatatgtatatattttcacactatttgcaagctagtaaaaaaattaagggtgtgtttagttcatgctaaaattgaaagtttggttgaaattggaacgatgtgaaggaaaagttggaagtttatgtgtgtagaaaagttttgatgtgataacaaaagttgaaagtttgaagaaaaaatttggaactaaactcggcctaaaccttgaggaaccgattaattagatgaagaaagtcgacaatgtcatctcaggacttctctaatacattgaaggaactaattaatagagagggatgcatacatacatacactaaatatctattcctgttttatatatatatatatatatatatatatatatatatatatatatatatatatatatatatatatatatatatatatatatatataacaagaacaagtgtaaaagtgactttccgattatgttctcacttgtgatattagtttgtttacctttctttatgaagtgatatcgcttaaataacaaggatgtgcactctcaaaactggtttatacaattacagtacattccaagtatgctaatctcataatttgggatggagaggacggtagcgaagcttattgctgaagtcccaccctacaaggcttttgcagatgttgcacgtacggctctgtaatttttccttcttttttcccagccgtaacaggccgtacacatttcttttccttcatttataaaaagcctggataagatggttcgtcccacacacacacacacacacacacacacacacacaacaaaaaataattccacaccagcagaaactgggtcttctcgtggacaggcaaacagcaactacagctagcagtacatcttggactgtgttgaacacaatgtatgccctgcgacggtttacaatattgccataacgtaatcaccccgctctaaaaaaataataatcacgtaatcacttggtacttcgaatattaactaaaacacatgcgcttgaaatatgtatacttattatcatgaaaaaggatttaagtctcccattccagtaatttctgttcatacgttgtatcagctggtaatctggaatctcacattccagcgttacaggaatttcagttcatacgttatattcaaacgtttccaaattccaacacagaccggtagtcgtccttgactcctctcgccatttttcgagtatgcctttgagtcataactgcagcatactgatacgagaggatacattgacaaaatgaatttgtcagatgcctgatacacagagaatataattgtgatggagatgcaaaagaaaaatactacatgattgctaatttgatatatatgttccgggaaagccatccttaaccatatagtactagtatatgtcctctgggtttacatcctcctctgatgatgtatacaacagatcaatctcaatgtgtccaatgtgcatgcatgcatgtaagcaccactaatccttgaagttgcgtttaattccctacaacagatcctagagatagtagatccaatcactctttacacaaatataactcatcgatctctacccaaatagtaaattaaatataggtcttaatttatacaatagctagctagttacagaatgccgtaagagaattcattaacaaactgccaacttctgaattaactgacctgaagaatctgagtaacagaaagtcaatgtttagctggctagctgcccctgaaagtggatttcggcaatgatctcagtaaaaccttctaggcctcgtggtaatctgagcacttatgcaatatgtacgggccgcaggatgtgaataaagagatttccatgcatagacacatttacaataatgttaacgttgacatttttaactaataatgctttacatgcctgtagttttgaactgaggccgagtttactttcaaactttttcttcaaacttccaacttttctatcacattaaaactttcttacacacaaactttcaacttttccatcacatcgttccaattttaactaaactttaagttttagcgtgaactaaacacaccctgaatattgtatgtacaataacagcatacagttggggacatatattccttcctcaccagtatagtaaaaacacaaaccgaatcaaatcatacttcagtagatacagcttaagaatgatgataaagcactgttgatgacaagccatatccagacaggcttggatagtctagtcaatgcttcagtagatttctgtctgtagatttcccaggtcattgaccactgatataaaaaaaaagtccaaatcttgaaactgaacacactggacataaaactcatatagaaatctgaagattattattaacattagggcatgattttatgcacgagtgcttgagcaagggagcacccttcagtccaaccacaaacggcgcagagctaaattttagctcccgcgtcatccagtccgctaccaagagatacactcctgcaactttcttggtaggtgaatggatgattcggcagctaataaaaccctacagccatctgagagtggactgaagagagctctcttcttacacatgtagtcaaagccacaatcttggagcaccaaatgaattgcaaaacaagaaatacaatggaaatcttaaacaacgcggcaaagaaaaggaaacctggtaaatctgcatctgctaatccaatggagacgagaatagtgagggtgttcataaagaacttgtttacttcagattattatcgcaaagaacaccaattaagaaactaactaggtcacgaagatgacaggaataaaacataaatggaatgaggggggcaaagcattgagagaagctacgctgtaaccgggcaaaagaaagagcagatgtatatttgggtttaactggctatcggcctggaactgaaggagaagctggaaggaggcaaggagcaatgccatggctcaggaatctgcacacaagagctgccttaaatagtccgaaaggatggctgaatcattacggtcagtacagcctgtagagctactagcctatagatgactatggcctatactgtactcccatggtcctaaaaatacttagagaacccgcaatagtaaagtaaggtgttctctataaaacatatacatcttagcaatagactagattaacagtaaaccacctcaatagtatgtctacatgggtatctatagctctctaatacattgcctcgtttttctctataaattatcaccaggttagtagatagttttgctctctcacttcatttaatctcttccaaatagaaaaatatgctgacatggatcttttttaaatagctatagataaccattgcgggtgcccttagagggtgtttggg

SEQ ID NO: 69259 - DNA, 589 bp, Oryza sativa
atatcgccatctaacctacaatcggctatcgtctgttaatagaagccacccgagtaggttaaacaccaatgttgacttagattatatagaatatctaccactctatgaaacatccggcggcttgattgtctagatattgtccttctttttatacttatagctgcatcagttgagtctgatcttatgagtcgtgattagaatctcaatctctagcctgcttttggttgccgattagggtagcatcggggtttcagccgatcttacctgatttaactacttttatcttatgtgcttgattgacatgttaaatctgccctttatgttaagatcttgtagcatttaagtatattaggctttcgtttggtatattttacttgctttaatatgttaatatagagtggtatctgttaacaaccaaatttggtaatatcggcattgggaaagaagattagatcgatgcaaagtcggaggcggagatcgagttcggaaacagagcaggaatcggctggagtccagatcggctacaaattggatcggctgggtctgagtcgggctaggtaagccgatgcagccgattccgacaatgcaa

SEQ ID NO: 69260 - DNA, 30315 bp, Oryza sativa
taagcaatatagaaaaaatgcacgtgcgttgcaacaggtaaagacggttttttcagtgatatatcaagagaataagtggtaagcaataaataaattaaaatattaggatcactatacattataattgaaaatgttaatgaaaattctaacattgggatcgctatatatagattataattaaaaaaggtaatgaattttttttcttggtttttggccgaaagcatttctttcttttcaaacgtaggctagtccactacctccttcgacccacaaatggagctgtaagcccagctcgcaccgtatcgtccactatcatcttcaaccttccaaacatagtcacgtgctagtacggttgcctgtcacccaaaattggttgcggacttttaatctactcaatactctttctgtttttccaaaaatcagagcgtaaaacctgggataaaaatgaccggggaagatggccgtcatcatcggtaacggttaaacgaagattagatctggcaaattaaagccgaatcgaaagggaaaatcataaagaaaatgatgagggaggagtagggaatcgatttttgcaatcaaattggaggagaaaacgcactattgatatggcggcggtgggaggcatgcggcgaacggatcggattaaaaatccggatgagtaaaacaaaaggcacacgggataaaaaatggcgacaaaaaaatgacgaaaaaactgagtaaattgcacccacattgcaacaacttggtaggtggggtgcaatttggtgcaataacttgagaaatgagcattatagtgcaacaacttagcagaaatatgcaatttagtataataactttagaccatataaataaagtaggtacgattttgatacaataaattaagaagttatgtgacaacttaattatttggagcattttttatataaatttaattttttaagtatttattttgacaatatagtagcgtggatttgtataagcatatttatatttttatcctaataactaataactaaaagttaataaaactggatgtaggaattattacattttggttgatatttgagaaggtgaagaaaacaaaaaattcttaaaggtaattggatgcaaattttatgtgcactataattcttaaagattaagttcaatattataaggtaatatctgattgatatttgagaaggtgaagaaaacaaaaaattcttaaaggtaattggatgcaaattttatgtgcagtataattcttaaagattaagttcaatattataaggtaatatccgtaggaatactgtgtaatggcatattaacatcgtgaaaaaaactcacctagcatatgcttcgccaagttgatgcaccaaaatactaaattgttaagttcttgtactagaatgcacccacttgtcaagttgttgtactcggacgtccaattctcaagttcttgcactatatcgttgttataccgtgggtgcaatttactaaaaaaacaaaagcgcccgggaggcgcgcagtgaacacatcggaataaaaaaaagacgaaaataaccaaaagccttagcgtgtgggcaaaaaaaaaagtctttcgcgtgcaaaacaaagtcgggaaaaaaccggtgaaaaaaaccaaacggacttttttcttttttttttactggcaagattttttttctttttttttcgagagacaaacaatttttattacgacgacatatgtttttaccgactagagaagctttttttatcactttttagttggactttttcttttcttttttcacctttttgagtcggatttttttatttctttttttacagtcggacttcttcttttcttttcttttttacctttttaagttggactttttatttctgttttactaacaaagaaaatttcttgttctttttaagtagagatagagattagtaccgaaacataaaattaaaaccgattcatacacgaatgtaccggtaaaaacatcttttttttataatagtagagatagagatgtactttcagtcaataaatagtagagacatagattgaaagaagagtccatataaaacccaatacaagattaatcaaaattcagaaaaaaataaaataaaatccgatattatatatatatatatataaagaagattccaagtaggaatacaatttaaaaataactgaaattcggaattaaaaataagaaatattgaaagagagtccttataataacccaatacgatattaattaaaatttagaataaaaataaaataaaatacaaaatcagaaaaaaaaagaacagttcatgtaggaatataatttgaaaataactaaattcgaaattaaagttaagcaatattgaaacaagagtccatataagaaacaaatatgatattaattaaaattcaaaataaaaaataaaataaaataaaaaaacagaaaaaaataaaaaacaagttcatgttggaataaaatttttaaacaatttaaattggaaataaaattaagaaatatcaaaagaatagtctatatagaacacaatacgatattaattaaaattcgaaataaaaaataaaataaattcagaaaatagaaaaataaacataagagctcaagtagaataaaatttataaataactaaaatttgtaataaaaaaataaatactattgaaataagagaatctagaacacatgacaagattaattgaagttcaaaaataacaaataaaataaattttaaaaatagaaaaataattataagagttcaagtaggaatataatttatgaattaaaaatatcggaatgaaagatatgcaattttcaaaaaaaaaagtcaatctagaacacaacgatgacaaatgacaataaagagggaagaagcaataagcctataaaggagtagagtactagtggttgatgggatatctaaaaactataatcaaaaccccaaatagaatcccaatgatgattaagaggagtgacaatgggtatgtcgttaagcagcttggtcacgacggttggcgggacttatcgagcgtaaaaataaaccccaatgataatcatgtttgatttttaaaatctcaataacaataaggaggggaggcagcaggcaggctgtagaggaatatagtggcgaagccactaacaatttggcgagacatatagaaagtaaaaaaacaaaaacaataattatgttcgatttttaaaatcgaatgacaataaagggaggtggcagcggacggtccatagagtagtaaattggcgatgtttgacgatacttctaaaaaattatgaaaacgaaacccaacaaaacaatgagctcgaaaaactataaggcctaatttttaaagttctaaagagaatgaatagaattagtggtagatcgagtaagaaaataaaaaggtgacaaatgagcaagggtagtgagtgacgtggcttttaaaaactataaaattatgggatgtttatgtgctctaaaaaaagttgcacgaaaattaaagatcatcagtagctgagattaaaaataggattagcacttaatcaagggtattttagtacaccgatattgggcctatatccagcccactccaactccatcgatagcacgatattcctccagagccgttccttctccaaccacgattcctctgccctcttcttccctggcaactccatcgccgccactacgaatatgaagtgatgatcgtagcttgttgtaaccatacgtgaatatatacatgtaggaagagctataaaaaataggatagttagttcatgttagttagatgtgcgttcaaaatttaagagattttgcaacaaccaaaacaattacacatgcagttctattgggataaaattctctgcggtgcgtccccgatccgatgtcctgctaccgccaagcccttcctttgcagctatagccaagcccttcctttggagccgagcccttcctttggagctacagccaagcccttcggagccgagccgatgtgttttttaaagtatgacagtaacaaagccattggtattatgaggaagaagagggcatatgattattttttaaaagttttagttttgacttatattttaatcgacgcggtgcaaacagacaagatgaataggagattgaaacaaaataggtaatcggtttgatgactgtctcgagattttttaagccacaactcaacgatacaaacttattaaagaaaacaattgagttttctaatccacatattaataaaaaaaaatatttgttttcatacataattaattgtatatataagcaattcagcttcttagtctaattatttcaattatttatatagtaatcaaaataaagatgttgttgagcataatagatcacatcattccagatgggtgcataaactgttaaaaatatctttttttaatcttatttaattagattgtgatgaattatatttaaaattaaacctaaaactaaaggttgctacaactagttcagtcgtatagaaaaaaatgaaacatatttagctgtcaaaattagatctaaagagtattatctaagacaaaagattgaatcgtataatataagtattcagacttttattaattgtagagatactatgtttaagctgctatataacattttgttcattacattgcaaatgttggactaaggtaatcttagagctgactttttgcaataatcggaaggtgggctaagttaattttagagctaactttttgtaatcatcgaggctatggaaaatgaaatttattgtttaaaaacacataagaaagtaacattaaggtaagcaactttgctataacccaatatttttggaccgacttgaagatttagaaaacttttgtactttttttcaaacaaatagtaatggcaaaataagtacttggatttgggatgaatctttggcaagcaaataccctataatttacatctctatgatcaaataagcttattagaagctctctcctagttacatatgcttctatgctcatttgggtatgtaagttcagttgatgaatctagagtgttttcttctgatcattgactgtaccgtttatatcatctatttatatattaaaagttcattaaacttcattcctacaaacactcttcaactgccaaatggcactcatacataagctcctaagttgtcaggtggcactctaataaattagaaaaaaatcctataaattctaaaaaaaaaaaagaaccgttggattttattaaatctcatggatccattatttacaaccattagacctatcttacgaaaaaaaatctagctctcaacccagccccaccctaagctgtaggggcagacgtacatatgtactttgtaccctcctattcacatcatcatctttttcctccgattcctccctgtggtaaaaacaccatctccccgaaggtagcatgacaaagacatgatctatactctatacttaacataagccaacagggaaaaaaaaaaggattgtgacatatgttagggggatgtcgatactccagcaaaatttttgtaaaagaaatttaagcaactacagcatctaaatcatataggaatttttttatccgtttatgttgtttagattatttatgactaaatttacaattagagacatatattaattataattaacctttcaaaggaaatatgtaactgttggggccatattttctaactttgcatgtcattcgagcaattataaaaattacgaaaaaaataactatatagattttgtcatcgtacttgacatcacaataattaattagatctacaatgataaaaatattcatgtttcttattgtaggaaaagataagtattaatcaatcaataatttttttattctatttgtagttaataagtgtaatagttattacaaccccttaaacatgtaaaaatcttacaattatatgcacacatactatctcccgttcgacaattcccttccctcctctccttgttaatttcttcctctcctaactttgaattaacagtctaataaaaaacaatatatcaataactataaagctaaatgattataattcttaagttatctccaagttttgtttgtttgaactgttgttttatgtataattaaataaataatttgagacctatattaccatgtttcactatataaaaataaaaatacatcatttcaaaacccctatcctttgcatggcaaccaaatagcaacaagaatgaaacatgaaaaacatagacgataactattacatcatcttaatcattctacatcctctatagagctctggtcatcacatgttacgtcttaaatttattttttaaaaaaattagaagctacaggccatcgatttccttttaaatcggtgaatccattattttcaaccattagatctacttttagaaaaatcttaagccgtcatgtgttacatcataaaaattagaaaaaatatattagaagttcagagaaaaacaatcaaaacatcggatcatcagtttttacttaaatcatttagaagagaatagaaaaacaaacttccctccaccttgccctcctcctcacatatgcacagctgatcaactttagttaccttgctgatcaactccaatcagaccgatcgacatcgattcgagaaacttttaattccgctaaaagttttgatttttaggtactacaactattcaccccccctcccgggttggcttagttcttgctgttcgatcctacagtttcagcctctcttcagatatgcttgagaattaactactccctctgtttcacaatgtaagtcattctagcatttctcatattcatattgatattaatgaatctaaacatatatatctatctagattcattaacatcaatatgaatataagaaatgctagaataacttacattgtgaaacggaggaagtagtcaataccttgatagacagacatctcctgtacattttggttgaccgggttgtgtttggtgaaacattttgccatagagagaacacaggctcaaagtttatgtgtagtacttatggctccatcgataggaagcatagcacttaaggccatgaacaaggagtgctagctccgtgttcttcctcctcactttgaacgtcaacatactggagtgggcttatactttcagaatcaatgcttgctcaagttgacatctgtgtaatttgaatgtagatgcgcaaactatcgtcagtgcgaggttatgtggctattccattggacatctgtgtaagctgtttagttattatcagtagcgtgttcaatccattcaacgtatgcaaaaagcaaaagggaacaagaaaaaaaagtcaatcgagctatgaacttggttatttgcatcttggagggccaagattcaaggaaccactgcatttggaagcactgacttgttggcaagttgcaaacattatctgaccgaaaaaaaccaccagtttgatactattcgaaatcactgcaatgagtgagtgacacaatggagcaacaccaagagtgcactgcaaagccggttttgatccttacaccacacaaggcgagagggagacacacccgttgataatgttgttacaacatcgacatgtccatcgatatctgaggtgctacatggcgtacctctgagtccaggtccttgctgtgttctcgtacttgtgcctatctgtcttgtacatgtgggcgatctcagggaccagaggatcatcagggttcggatcagtcagcagggaacagattgacagcaacacctgaaagcaagcagagagcacatgtttttgcgggattcgttcagcccaactgcgagagaccaagcaaccgcctcgcaaaaggaaaatagcgttaagcgagaaaggaaaccttggaaatggttagtgctgggctccattggtccttaaggatgtcaaggcaaatgctcccgttgctgttgatgtttggatggaaaaccttggtgcgaaacgccacctgcatattgcatatcatagacgtcacattcttcagtcagtctcggtgctgttgtaaagctatagaacttaatggatattcagactgaaaaccagaaaccataagaatttataattgaagtgatattctttcagaatgaagtaaaagaacaccttagtgataagtgagaagacaatcactaccaaaccattattcggttatatagcacagtccaggaaacaactttgttatatactacaaagattcgagaacactggcaacataactgaattagcattattagacagcagctatgctttcacttttgcatgactacagccgtaacttgcaatatttatccaccttgatttcccaaaatttgatcttcaagaatcaggttcataagtggctttgattttaagttcattctaaagtctaaacctgtatgttttcaacaagttagttactggcatgacatgccaccagttgctcttgtgcacaacttcagcatgaactttataatttataccacgttctcaatcccttgaatgctttagaatagaataaaaaatatgaataaagcaccaattcaatcaaccacaaattatagcatctgccagagttctatttttatatgtgaaatgagcagaggaatagggttacagttttacaaaacagcagtaagaagatatatatgactaggaatagtggacagataaaaagggagtgataagtcactgccaagtaccttgggtggtttgaagggataatcaggagggaagtggatggtaactaggaaaactccaccagcatatgggctatcagatggacccattatcgttgcctgccagtggaacatgtcttcaccaacaggacctgtcaaatagtaataaatcatcactgttaagaaatgtggctaggtgcagtcctaggctactatccattgcctgataaccatatcatattatgggcatatggtctagctctacagctttgattagagatgaaattgcatgataaataagggtattgaaacagggtcaaacaaaacagaagtaggctgaaggacaaaagacaagtatccattgttatgtgcacagttaagctcaggttggtttttcttgaccccaaggaaaattggaagacattcctttgacaaaataacagtatgttaccattttcgcttaatggtatacaactagacaacatgaaattgtcacttcttacaggtatggacagggtgagctccaagctcaaaggaccaaacttattctagccacactaaatagtacttatgtttccaatgtgtaagcgtggccgccatggcacatgcgatccaactagttgaacgaagtttaaagtgcaagagtgaaggccacctgtccataaggcgaagaaagttcatacaagtagtctaacaaattaagtttattctattgaatattttgggccctgctataaattttaaaaactagtagaaccactacaaaagataaaagcatatgaactgaccaatggacaggatgacaggtctgacagatcctgggttctagaaacaaagatgcagcatggatgcagttgttttggtataaaagttctcctggatcattggaaacaaagatgaagaataacaactagacaaccaactagttttctctcgaataaggcaagctaatcacttttctatactgaactacatttccattgttttatgctatattagtaaatgatgagctaaattagaaggaatagtccgatttgatactcatggtatttatagtaccacaccagcaactcctttgacaaagcacttgacaggtaacatttacatttcagaatacaaatcgcacagcaccctatatgcaatattcagctcagttaattgacacttcttgagcatacttggatggtgagatttagtttgtaaagtagactaaatcacaacaataacaacaacaccagcctatatccgccatggaaagggaagtaattctaccagaattcatcagggcaaatatagtatccctgtcaatcataatagcataaactaatccctgcatgagtacgttcagacaaactctgccgtattaatcttaatcgatatatatataaaacctccatccgtaatcttcataagatgaaaactctaatcatacagtgatctgtctttcccctcttttgctggggcaaagctgagtacagagagttactccagatactgctaagctaagcccctttgatgtatatgacaaattggagagcaattttccattgctattctacggcaaagcagcaagcacgtggacaaagaagtcattcagaagcacatgtacaaaaatctgactcctgtgcaagatgtatggcctagaactgcaaaatccacgcccaaaagaagcaagcaaaagaaagaaagcaagacctgcactgcatgatgtagggggatccttctgcagatccttgagctccttctgtatcctctttgacgccatccccaattcccccttgcttttcctcttcctatctccaacaacaagaagaacaatcaaaccacaaatcaagcatcatcaaagcttaatcagtgcaaattagagagcactcgcaggaaaacaaacctgtctaacggagagatttcacttcttttcttgcctcgcctctagctgctcttcctccttgcaagaatcaataatggagttgggggaaaggaaccaagaggaaggaggggtatatatgtcaaagaactccccccacttgctaccacaggtttgcgtgctggttttgtttattcctttcaccaaatcatcggttcctgggggcctttactttagtgatgccatggctgatcaacaacggcaggtgaaagcggaatggtatcgatcaaatcaaaatcaaatgccatccactaactccccctttcatattagtggctgctcatgaacagaacaattattctcctctttttctttttccttctcttcttaaataaaaaattcgatttgatttgagatggagatgcaggtagtagagatgtatgcattgtacctgactgtatagcattccgagcattgaaattgacgtcaaaaacggtagtggttgaccggttagccggccgcgtttttcatcgtggtgatcaaaaaaataaaagcgttgaaatggcttgctgtacccacagattctgttgatgggccttcgccgactgatgattgattcctcgtggtctacatgtcagtggcaggatcgagaggatcgaattcttgcgtgtttttgccacaaattggatttgtggatcccagtttctgtttggtagtgtgaaccgaaagatttaagaatttggttctcagaagtttctcgagttacggacttgtggtgctcaccaatacggagtgctttagttgggaaaatgaaagctccttggttgggtttgggttttcttttgcatcttcctgaagtgatcgtaatccataggtagtacagtacttagtactaggtactctccaataaaggtctgccaatgcttggctgttgctttctaaatagacctgattaaatagaaaatttatttgcatgagatgcaagacaagttcctagttttatcacacaacaacaggagggttttgtaggtatgcttgtggaaatgaattaagttctgattacagtgttttttcagtcaaagatggacaggccaacatggcatttaacagcagcagcagtgaacagtaaggcagataaatatgtttggggaggacgtgatcagcgtcctggttggcaagaattctcgtcattcaaagatgctggtcaggataattgatctgccacacaggccccagacactaagccgaaaattttacaccttcatcatcagctgaagtgcccttaaaaatcgctgctttgcccttctgttccagtaacttcaaagccctcatgagaacaccacggtcaattccggcaagttctgcaacagaggtcgtatcataaaactatccaagagcccaacggaaaataaattatgtttcaagcttattaagccaattaaggacatatttagttcaagtagtacttttatgattttccttattggacaagtaggtattttcgaaatttggagaaagccaacagtgaaagtagggtggagggtggtgtaatagtatagattgtgagagccaacgatgaagtagggtggagggtggtgtaatagtatagattgtgagagacaacagaggtgatgtggcagaacagacaccaccactagtagtatagatagatatagataaatcaatttaagcctcacacttttaacaggccacttttaacaggccagaaacatctttattggatgatgatgatgaagaagaagaagtacaaaaaccaattaatgtatatgggtgttctgaaaaacagccaattagttggtcacagaggctaaattgtgttgaatagcgttcgctggagtgtcctaacaatgtcggtcaacaaaacttataaataatgaaatgtttggcacacaactcatgcttgcttagtcacaatttatcaatctttttgacaaataccttattgattaattttcggtatgaacagtatttgagacgttagctgtccattaaacactgattaatcgtctgtcttaattaatggctttgcagtgtcccatccatccagagactacctttgttcaaaataccgacgtacaagtgaaacatcaagccaaaatacaaaaaccaactacaatattagtacccctaccataggttattaggtttccaccacaaaattgttttcaggatagaaaatatgctttgagacacacaatattgacagttggagaaaaggaaaatttagtgccatgattctgaggtttgcagattaccagtcccacgtgtttcaattcctgaacgtatttcttcaacagtcattacactatcttccagcccattatcctttacctacaaacacagggtagagagaaatattatgacacaatgaagacaatgccactatgtattgttcacaaataattaatagatagcgcctaaacaaatgccgaatataaaacaatcgtacaaaatttaatatgtagttagcccaatcttgtatccgcaaccaaagaatgaggcacttcttatgacctttgtccatccattctgcacgtcctgcatgcagtttcaacatagatttaagaaggtgcagagcatcaaacaaatgattttgtaatgcacagaattactatagctgtgataaaagataagagatttaatggtaaaatggaccttcataaacaagagcagcaaggaatacttcctttgcttcatggctaagagatcctgcagaagagaacaatttatgtgaattcagtgcaacaggtaagagtgtaacgagctaatcaagtacaattattttgttcttatgtactcaaagcctccatagccctttgagtgcattgcagtcatgcctcgttgctgagtttttttttttttaacgaaccaaacagtttgatgattagctactgcgacacatttttttttatgaataacagaagaaactagtatgtaagattaagataggtaaatcttactctcgatctttggattggagaacaatgggaaatcttcttctagggagattatatatagcttttgacttctacaataatcaagtatcagatctttccacagctgcacttgcttttcacgtgtttctcgcacaggctgcaatctgagagacacaaattgtcatgctaccaatctcagttgtgttgtttgaccgaattgttaaagaaagttttaacagaagtcagaggtttttctgtagaataatccaaaagattgtggttgtgaatatcataaaatgcaagaagatgaaagcaagaaaatggttcaactgatacaaacctgttgaaacacaagatataccaggtatccagatcttaacatatataatgaaatttaattataaagccaagacataagatatctacatctagtgccaacaagataagaacataagcatacacttgcaagatatcaaatccaattatcaagtactgccgttctaagtagaagtgttccatgcagtgtgacattgtgaacatacacttgggcaaaggcatacttagaatcaaaaggtgcatattgtgttcttcacttgcaacaagttagttgttaacttgttaagttctagaaattttcattacaccttattgataaggtggtctcaagaatcactataaaacgcgttcgcgaaaaagaatcactataaaacaggggacgatctgccctcagcagagatgaataaagctaacaaaatttagagttgctagctaagtagttaactcacaagatcatatcgtacggtaccctaaatactgatgttacgattccgtaagcaactctgggagccaaacaagccagtcacttgtaggccctaaaaactggaaattccggcgatgccaaggaccactagtaagcaaagatcctaaccaattaaccgaatcaacatcccacggtcacctcttcctcctaaagaccgcaaattcacagatcacactgtacaaacatctgtactgaacctattgtcaccacgggaagagctttgggtccctctgtaaaactgaaagctggggaggaaaagttacgggggagagcgagagcaacgagggggggggggggaggggggagggattacgtgaagtaaggcgggtagttgaagaagggcgggagcctgaaatcccccagcctctgcatctcctccggcacggcgccccgctgagcaaccccacggatcaggaggggggaacgcgagcgctgggcggctgcctcgcggctaaccggcgccttcgtccaaggcgagcgccggtcgagtgctccctgcgcgtgcggcgccgtcgggccggcggctcgccgagcgacgggcagcggccgaggtgaggaggaggaggaggaggaagaagaagaagtcgcgacgtcgccgtgtcgccgactcgccgtgcgagatctcctcgcgcggtgggccggcggctgggagggagttactacttgggcttttttctgtggactaagcccatctaaaacttacgttgggcccgcggctctcaggccggccgagctgttggtttgccgttgttcgcgtccaacggcgcgcgcgccggcgtcggttgaggtgcgtcagctgaattcgccgggcacgttacgacgtttggccggaggcgtgcaaccgtgccaccgcgtcaggtggttggctggtggccggcgcacctaaccgcgcgcaaagtagaaagacagtatgggttgcgaaagagcacgtaatctagtcattgcagtgacctaggtagcatcatgaaatattagagttcgaatcttcctacgagtgaattttaggttggtttatttgtggagctaagtttccaatttaaaagactgtatatatccggttgggtctctaggtcgggtaaaaaatacatttttctaaaataaaagaaagatagtatagatagaatggctggattgatgagaaaatgatctcaacagaacctagtagaaagatagtatggataaaatggctggattgatgagaaaatgatctcagcagaacctagtagagaagaaaaaggaagaaagaaagatggtgcctctggtaaccaataggcgaggatgatgacattgattagtgacatctgtgctgaagaaataagagcagtaatttttttttgagaccaaaataagagcagtaattgacaagctagtgtgagaagtggatggcagccatgtgtcttgcagttgcaggttggatttgatcaaatggaagtcaaacatatggcgatgcttacacacgacttttcaggcgatctgttgcatgcactcacactgccgaggagtaaatcaaacatcggactagtttgcatttgttctataaacaaaatagtatagtagcaggggcgtatatatcgttggggcttgtcagggctcaagccccagctctgccgccaaatctatcatcccttgcaacatagtacagtactgatagccaatgagaatggtgaaaacttaaaaagctgtgagtactaattagctagaatatatgccagattgcttcttactagtagtttgataattctatcacataatcgatcccaatttgttaacgttgagattaccagtttactaattttggttgatttttcattgtaatgttcaaaaacctctaaagtaatagataattcggaaatttggttatacggttaaacttttgatatggccatgcgcagcacaaatagttttaaatcatactttggttaaacaatgcatatttcttttgttttatttatgtattaattaattgagttagaaaagtgataagcatatgtatatttacttttgccgctaagataatttctattatgtgagcacacccttaatttgtatcctaaattcaccactgtacagtagaacacactagcctatatatctccctctcgagtgcagcgtgagttgacgcgccaaggcctactagcaacagagctgcaagcagagtggcagtgtgagtcgtaccgagagttgaagcacacatagccatctctctcgttgtttctccacgtaagctttttgtagcactagctttctagttgcaacgatggggttcatcagcggcgaggagctcgccgtgacgctggcgccggtggccgtgtactggctctactcggggatctacgaggcgttggggagcgtcagggctctggacaggtacaggctgcactcgaggagggacgaggagagcaataacatggcgtccaagaaggaggtggtgaagggcgtgctgctgcagcaggccatccaggtcgccatctcacttgccgtgctcaaggtttgtcgtctcacaaccctcgacgttcagctagctagcttttgattgttgagtgatctttgtttggaacctcctgctgtagatggaaaatattactgtgtttatccataatgcagagagcaagaaaaaaaaaaaagcaaatccgtcgcattatggacgtgacggcatactggtacaccactgagtacagtcgctagctctagcggtttctaccccacatcagtaggtgatacggctgcattgtttaagaagaaccccctgattcacccatatcggcatatctgcagactgcagtgcctagcttcttccggcaagaagatgaacaacaacagtgcaacactaacttcgcatcaccctgcactcctgcctgacaaaacgcattaatcgatcaagagtaaccttggcccttaaactacactacaggttctgtacacgcgtgcgcacggtggagcagagcacagctcgtgatacgtgatagttacaaggctgcctagttacaactggttgattgatcttgtctttcttttatcgatcttacgcagctgacaagtgagaaagacggtggcgccggcgacgtcaaggccggtcacgcgagcgccccggcagcggcgccatcgtcgtcgtcggcggcggcggcgctactggacgtggcggcgcggttcggggtggccatgttcgtgctggacgcgtggcagtacttcgcgcaccggctgatgcactcgagccggtacatgtaccgtcggttccactcgtggcaccaccgcgtcgtggccccctacgcgttcgcggcgcagtacggccaccccgtggacggcgtgctcacggaggcgctctccggcgccgccgcgtacctcgcctcgggcctgcccccccgcgccgcggccttcttcctcgcgttcgccaccgtcaaggggatcgacgaccactgcggcctcctggtgccctggaacccgctgcacgccgcgttcgccaacaacacggcctaccacgacgtgcaccaccagctcagcggcggccggcgcaacttctcgcagccgttcttcgtggtctgggaccgtctgctcggcacgcacgccggctacaccgtcaccgcgcgggagaggaacaacggcggcggcctcgaggccaagccgatctgcaacgatcgccacgttctcctgtaatgtcaacctgtttttgctgagactttgtttgtagctaccagccgtagtgtccgtcacgttgctgtgtacaaaagaaggtcttcacggcaaatactttttcagaaaactcaagtgaagtcttgtcacaacaactttgcatctgaatatatagtagtatctgacaaatgacacgggtagactgatcagcaacaggctgatcaagacgacggacctagctagcgcccccatgttgtacaatgaaaaacgtagtacacactcccatgtacaaggaaaaacgtagtacatgattttcgatttagggggggcaaaactaagcatctgaatatagctactggaacgcattataggaacactggagctagctacaagggtagtccagatggtcgctgcagttggtggaagcgacggcggacagctccagcttccccgtccactcctcgcctggcttcagcgtgatggctcgctcgactgcggcagcgtccacacacagcatctgcttgtactcctcgtcgccaaaatccgccatcgttttcgacttcttgtcccatgggttccaaacaactgatagccaagatagagagcatgaaacccattgtttatttatgattaccaggacagaaagtaatttttcatccatccggcttaacaatgctaaaactggtttggagtggtacatgaaggaaatcatcttaccgacgtcaggaagcccttctttccttacaatgaaggtgcgtttcttctcatggtcaagcacagcaattacgcttggggaaccaacgtagactctgtcaacctgtaaacatggttactttttatgaatcagtaaatctgttgtcatgcgcatcattttggtgcagaagttcacaacacacaactgaggatgaaaggactgaccaaattcagattcaagatcattagctatttagtgttcaaatgcaagcacgcggtataggcaggcttgctatagtataccgacaaaatgcaacacccatctctaccaaagaaatgtaagacctataaagttggagtaagtacacaaacatataaatagtgaaaatttacctcagactcaaatgttatagcatctccttgttctgtaaaacgttctctttggctaaggttgtcaagataatcaagtgtctccagaccttctattctcacctcactgcaatgagaaaggtgcagcacaccatcttatgcacattgttcatcagaaaatcacaaaaccccaaatgttctattgattgtgaaagcatgagatgtacagcttcaatggatgacaggaaatgttatgctacattatctaaaaaaaaggaaatgctaattgcttatggcataaatatgtactataccttaagctattattatattctactgagaaggaataatatttgtaactcgaaagagtgtatagcatcagcggtaagcacataacatgaaattcagtgagcaacaagatttatttgctcaaacaatgccttacctgatgtcagagactgaaagatatgtatggtaagcaaacgaaaaactgaatggcttcccattaacattcctgactcgtgatactaacgagagatctccatccgtcgaaagagaaactctgagacggaattcaaagctggaattcacattataataagtatatcagacaaatgacaaatcttccggaatgaatatgcagatatcaaaatgctcaatgaaactactaaagcattccatccactatacgcttgaaatagttcagatttacagtttcaaatctcatcaaacagaacatctgcctaaccctaaactcttttttattaatccttgaaagttcatctatcatatttataaaatatatcacagaattaatgtaatatagctcgaggttgaagtattgagcttattgcacacagaacatccctgtccacatcaataacaggtgtacactatttagacttaagatttccttggtaataaaaatatatatttggtataatatttactttggtactaaaaaacctttggtctgaagcaatataatatttagtttgtccaatgtttctgatccaaaaagtagtttctctcatttctacccagttgctatattcaacagaatcagtctattctgatgaatagtcatttagaaatttttataccgaaggcccatagaagtacttattactttatggcctgagctatttaaccaaccacctccctgacacactagctaaccagaattggacattttactcacctagctgtaacagacaaactactcaaggacagttaaatatatatgtccccagaataagttatcataccagtgtggccaacatttgagatcatcttcagatggctttaacagaaggtcaacagaaactttgccgttgttatcattatgatttagtggtggagcctcatcatctatggcccatagcctgttccttgcaaatccatgctgctccaatgttccacaatttccaaactgacaaagttttacagttaaaaacgttcattttttcaccagttcagaagtaaaattgcatcccctcaagggatgaaaatccatctcccaaactggtgcagatgtgcacttttcactgcaaacatatagggaatattgcagtacctgtggaaagcatatgggaattccacctcgcatcgcttttggtggcttgaagatagcctgtatgtacacacaatagctatcaaaaatcttaaaactaactgaaagcacgcaaattataatgtgttattatatctacttttctagcacacaaatatttcagaaacaaaggagaatccaaggccttaagcaggtaattcagaggtagagaaaaaagaaaaccaaatttgagcctgtaatttaccatcctaaattaataatagattagtctctcctttcaaaaaaaataaataaataatagattagtctcatactctcattatacagtatgccccaaagaaaggcttctactgttttaaaaaaaagtctacctttcttttacccaatcacaaacagacgaatttcagttcacatgcatgtctatcagagaaatttcagcacaaggacgttgctccagcataaattgcatcaactaagcgcaaaaaaaaaaaaggaacacgcacattccggctgcaattatgcaagtacttcgtatatccacaagagagaaacctgatgaaaccaaacccttccccaaccacatcgcacgaatccgatcatcagttgcagaaacaaccacattgccaggaaacagaggcaggatcggtacgcagaggcctcaccttgctgctggtgaagaggagctcctcgccgcggtcgttcctccaggagacgacctgcccgccgtgcaggctgacctacaaccaccgcatcaacccaagggacccgcatcagagtagcgcgtgcgcaggagataaaatgccggcgagctaatctaatcgccagccagaaacccgcaaaaagaagagtgaaaatttgcgcggcgactcaccaggacggacgccccccgcggcgaccggatcatgacctggtcggcgccgttccagtccttggtcacctcgaaccccggcctctgctcggagtaatgccccatgctcatcaaccaatggcaggagcgagagagcacacgaacccaccccacacgatcgtcgcaagaacttcgctggcgcgcacgaacgcacgcacgcaacccacaagactacgacgacgacaaccaccacttgtaccactactactaccccctcccctagtaccggcctcaccaatacatcgcgcaaagcaacgccaccgccaccgccccccagagggtcgccattagaacagttcggatgtctacggctcccccaacacttcccttgcgagcaaaagcaaaccaccccctgaatctcgtgaccgcaaagcgccacggcttttctctcctctgtcctagcttagttagccttttttttttcccgctgctgctgctgctgcgcgttgcgcgcgcactcaccaaccacccgcgcccgcccgcgcgccgggctcccctactcctaccacgctacgacgacgcccgcaaggcaagaaagcaggatacggcgagctgcacccgggagggggagaaatggagaatgcggcgtggatctctacgtttttttctctctctccgtctctcggtctcgaaaaagcggcgtggcgcgcgggtcacatggcgaggcggcgagagcgcatcatgggagccacctcggcaacgccatgggtacgtggggcgggggagccgcgggccggggggcgggggaatccaagaaaggccacgggggaacagctggaatccgagaagaagcggatggagcgaatgcgaatcaggtggcgcgcgggcgggcgggcggcgtgcggggcggaaacccatatgcgtcgctcacccgcagcgccgacccggctcgctcgctcgcctccagacgaggagcgaagccagcgagaccagctgctggggacagcgtcgcaacggaatccgagaggcgcggacacgtgcaccggcgggcgccacctcgatcaagtgggaacaggcgtgtgcagacatcggccgaccgcttaacattttcgctctgtacacgcatatgacgatatgattagtactgttttttcctatatgatatactacaaatgaattgtttctttatattttagaaaaattagatctaagttcttacgttttgaaacggatagagtagtttacactactttaataggtttaaaagtatatatctgtattttactagttttttttttgaacacgtaaaaaaattacacgtcaatatattagaagaaaagaataattgttacacaatacattaagccagaccgacttatgctaagagaggagggaaatagaagaccaaagaaaaaaaagactcggatactacgacactaaacatcgggaagggggtgtattttactagttcatagccctctatatcatctgcatacaagatacaacttcaagaaacattggagcattttactcatgttgcatcaatcagtttatttaaaaagagtaccaattttatacttttcataatatgtacgatataattttattttaatttatttttcataaagcaatgcgagtgtcaacatgggctataaaggtgctagatttgaccagatcaccagagacggcaaggatagcaatttgtggtgaggatgcaatgctcaacaaggcgtgttttgtcagtggcaccaagcatgacctcgacggtggccaggggcaatatgcggccaaggacaacgaatgtgtcagaaacttgaaggatatgtagtaatctcatagggcatcgatggatcttcaagatggtccggaccacccaaaaatgtgtcggcccaagacatgcataggtaggtatggtaaaaagaaaactaaagttgaagtgacgtcaattcgtttctgctccttctttgtgaccgcggctccgcctcatgcccatctcgtacaattgagcgacgatctatcgtacccatgactagggttagggctcctacctcttggtttgctcggctactcctttcctggtttcctatttacacgttcccgccgcctagcctatagtgatcaagtgacgacagcaaggcagcaagggcgggacgcgagtgcgccggccggtgacggcacggtgtcacagtgtgcagggacacatcaagaaagaaaggcaagtggccaaggggtaagtgattattgattagctgaataggtcttctagacttgtactcttcttttcaattttttactttggattcttctcatctcaaaatgtacttattgtattacggattgttaagacgtgaagaaagatgaaaatattacatctttctttagtaatatggaacatagaagaatgcttcttgattgcctcccacagttatatcagaagaataaactcagaaataagatgatggggtaaccttcttcaaacttttgtagccgtataagcttcttcaagtcaaatttcttacttaacgttaattttaagatgtttgtaagatgatagtaatatatcatgatgcatttttggccaattctattagatatacatgtattgtatatgttggcatagttatatttgtgatgtttaatttttttctatcaatcggaccacccatgcccttctagatacacagctatcgcagggtcatacggagcagcaaataaagagaacaaccatgagaagatggagtgattaaaaatgcatataaatatccgctagtcaattttacctcgtatgtttttaaaagacagtggctagataatgtgaacaatgcaaaaggagattactggattttccgtcaccttaaatattcacatgtttcaacctatatgtttgggtttcgagggttaggaggtgatgaaggtagtaggaagtaacaagggtggctttagaggatggcctaggacgtggtggacacaagtagacaacaaagtgaagccatgagtttggagaagggtagtagcaggggcatcatatctacaaaaggttaggaggcagagacgtctccacggcatgaactttatgttgctaagacaacgaagaacaacaggggctagggcaccttgccacttattagcttcaagagaaaggcgcctgggggggaggggtaagtcgagatcggtttggtaggcctcgctggtgccatttgcaggctcttgcactagctaggcagaaggaggcgatgcatgtggggaagagacaatggattacaagggaaaatgtgattacgtcgatcgacaacaatataggaaaataaggagatacagttagagaaacatgtgttacatgaatcttaaaatatcttcctatctaaaattggatgaatttaaaataggtatataaacattggacattctctagatttaatcattctcaaatgttggactgccgttttctttttactaatggaaatggcctactgtggtgtttgaatcttctgaagatgaagataaagattaagtatttcacgcaaaacgaggtggtaataatatgtgattaattgagttttaattattacaaacttgaaaaatgggttaatatgatattttaaaacaattttcatatagaaagttttcgcacgaaacacaccgtttagtcgtttgaaaagcgtgccacgagtatacaaaatttaatcctttacttgcagaagaaatgaacatggcctttggccaagatacataatagtggtattgttgcgctccttatgccctatttaattcagcttaggattattataatctggattattaggagtaagctgaaacaaacaagtaaattattatgctagattattataatctataagtcagattattataatctaataatctcctctagagaagctttttctagattattgagtggctaaagacccagtacccttagatgcctctaataatccagagaaacaaacaactcgtagtttattttatatcagcttattataatccagcttagagtaatctgatttaataatctagattacaataattttaagctgaaacaaacatggctttaatcacttctgtattaagagatgaaagctgtattaacaattttccactcgtacgtggcgtgcgcctgcctgtttgcccattgccatgagcccttgaggccttgacaggtgaaaattggttagcatgttcggactctgggtcgtggtggtgagctagcggccgacccgtttgcagcaattggatgcatcgatattaccaattcagtcaagggtcacgcgggtgctagtcgagtcaaaagaaagccggcctaataccgtgcagggcccaagctaacagcacagcactggaccatgcgtcaatccaaccacgcagtcagatcagctcatcagcaccgtacaagtacgacctcaccaaaaccatcacgaaattcacgcacctctctctcgagcctgaatttgctggcacaaaccatggcacttgagtcactctgccatactgataccgttttaaacgtaggagtagttagaatgcccaagttgtttcaagcctgaatttgctgtcacagtgttgtctcacacatgcccatagtcatggcaacagcatggcggatgtttgggaggtgcaggagcagcaaccggagattcccttgcctctgttctcgctttcaacggagtacagcgcttccgtcgacaagacgaatggcataggacgccggcgagtaattgcccaccggccaccgcatagtgatcatcgctgatgcaaccgtgtgatcttatcgatcatcaatagagagccgtatcaacagaaagccgtaaagaacatgtcgtacgccaaggacagaagcgaacaaccaccggtgttgatcgcatcggctacaatgttatgtgtcgaactaaccaaagaaaaagacgacgtttacacccgtaggagagaaaaatggatcatccaaaagcaggtaaaggtaaaagatcaaagttagaaggctttctgtcagtgttacagtatttacagagatcagtttgatatgaacaacgcgagccagcactgatgttacagatctacgagagtagagtaaaaactcagggaagaactgacggccaggggggcattcatatcccggtggagcggttggaatgctcgtctaaaaggcagctactagtaatttacaagggcgaatacagtgacaaaatcgtacctaatacttcgatgttaatcgtgcgggcaggttgagcttataaaattcaccaggccacatgctgcgtttgagcacgaacggcgggagggtcaagtcgttaagattaccttgcggctacagcatcagtcgccagaccagagcccaggagttgacgaagcttgggcgtggcaatggcatgatccatgtgcccgctgcttctcggcgtgccagtcttgtctatcattgacaggaaattttcgacgcctcgagcttgctgtgcttttgttttgactggaggcacttcttgtgcttcatcaggcccggtttccgttagtttctcctgttaaacaaggcgcatttgagagaagaaaaaaaaggactagtgctcaatgaaaatagctccaatactccaatgatcatattgttagaaaagatgtttaccattagagcagaattctctaatctaagtttcttggagctttccgttagcctgcttatttcacgtctaagggatgtgttctccgcagtcaatagctcaacttttctagccagttcctcagtctcggcctgttagaatgaaagaatatcattattgtacaagtatggtttaaatttctactagagtatggaatactgaaggggataccacaaaacattacaagttaaaactagctaagcatcttattatacctgcttcctcaaccttgacctccgagcagactccctgtttgattgcttccttctctcgcgcttcgattccttatcatcctgacaatttattaaggattataggtctatagtttaattcaagaagaaacgatcccatgaatcgaaagctgaaaattcctgatctcaagagtgaatctcattttttattgagtatctaggtactttgcatttaggtgtcctgacagtggtgtttggtgaggtgttttgttgctatctcagggtgtccttctgggacgggtcttgttctgtttctctctggaatgaatgtgtagttcttttttaaaagaaaaagaatgcaaagagctccagcaatctatttagcaaaaccatactagcgactcgagaattaatcccaaaaaataacagcagtaataaataagggatgttgtattctcaaaaaaaaaaggatgttctactgaagtcgtggtagtggaaacattaagaaatttgattgcttcgtccaagtatggatcatggttcactccacgaagttagtggcgccttttctaaatgataatttgctggcactttaacaagaaaaaaaactgcaactggcataccttagttggcacttcagttactggggtggcaataactctgaagtcactagcagtgctcacgtctggtttgattgctgtaaccggaatgcatagatttggcaaagctgcttgttcgctaggtctatcattaggtgttaaagctccaccagtttccacgcctggagaaaaggaaaaacaaaaaccaaatcacctcttagtgttgcttagtgctcagaatatatggccttcttatcatctgaaaacttaaacagaggattatattatgtttcagttatcaattagagaaataacaagaaatgccgcaaaattcacgatgagtcattgaactggatattataaaaatcaagtaccagatgataccaagattgagtacctgatttaggcctatcatctatgctccttttcttgggagttccacttgcctgaataatgatgaaatatatcagcatgttaagtataagcttgctggctcagaacatcttcaatggcattaaataactacagaacaataccttctggttgtttccatcactggatccttctaagctgcaatctccactgcattggcagcatcagatgcacatgaaatcagtttgtcactcataatagttgtatataagttgaactatcaatctggttatcgttttcattttgtaaaatcctgtatcaccttgttttttcactgttgccactgccagttgacacagccgcaccatcaatttccttcattttcttatttgaacagctatccttgctgttgacagactttgctggctccatgctcaatgggctcaccatcttgataaaaaatataagataaacaatcaataacagaagcataattaagatactagcaaaacgattagcaattcagcacagaacgttcacacaagtgaagcaagaaagacattaaagaaaagaacaattgaacaaatgatttaaaaatacatatatacttccacagaagaaaaaaaaataaaaaatccagcttccttctacagaaaaaatggcaatatatgaatgaatttattttcatgtagagataattcgtctgcaaggataggttttccaagttccaactacatatcatgaatacttcgaacggcagaaatcattcgtgttagttctgctcatagagaagtttccatgttaacatggctttatgcaagcattttaacaaattggatatcgctttaattccaaagcgtgatagttgactcaaatccatggtgccttccatgtttagttaaatgcaatgttctgaaaaatagataggtgaacaaaatgaaatgcttactaggggcatgaacggatgtgaaaaagctccaccaggaggataaattgcggcatatggcttcccaaaagcggatggcaccagaggctgtagaggcacagggaaataacttagaactcttaaagataagaatgacacctgatacatggagagtaaagtcaaaaacctgaggacccaagataaatggaggaggggtatgaccagcggctattccagggctaaaaaatgttggtggcaagatccctgggccgtaatatgcctgtgttgattatgataccttaaatttagttactcagttcaaaggaaaatccaaacttcagttatcaggaaaatatagattgtcagacacctaacctgcatatttgaccaatcaaggtatggactaagggctggatgatcctgcaaagtaatacagttgctacttaggcacctttaaggattccaccccttgtcaataatgtggctaattgacaaaatcatgcttcgcagctgtttgatgcagccctagcacatctaaaacctcaaagcggatttatgttgtcaaataaaagaagaaatgccaataatcaatttgacatcttgctcgtgcaatgttgtctgtgcccatatttggccttggttatctacttatatgcgtttaccttagggggcgatggtgctttccccatcttctgagtaactacagcttcgtcatttcccatgactttttatgagttcctgcatattttcatcgtacagattggtcatatgctaaaccatatcataagtactgaaaatagtcacacaaaaaagtatgtttcagtaaaaaatataattcactaaatgcacagatatgaaactcttgcaggcccatagatatcgcacaatcatgtacaaaaaccactagacacacctagcttgtgcaggcattcctgtacagcaatccgacacttaaaattcctcctttccagtgagccatcacggcgtcactgcttcatcgtcttactcatctctagtctctcctacgccatcctccttcttcgcctctagcgggattgggtgacatagggtagacatgtcacaaggtgacatagggtgaatcttggccctccaaaacaaatccaacggctgagattcgtccacgtcatcacgagtaaaaattttactcg

SEQ ID NO: 69261 - DNA, 2056 bp, Oryza sativa
atagctctaggaccgtgtttacaaaatagctttgagcaactaagtgtcttttagtgtagtttactgcaaaccctaaccccctatattatggctcccttgtactcccttgcatttattctgcacttgtggttttgtcttgttgagtacggtggttgtactcagtcttgctcaatttttcccaaacccagaagaggagcccctggaagataaaggcttttgtgtctagctcgtgcctgccgtcaagcgcctgtggtcgtcgccctagtcttccgctgtttttcgtttgtcttcttgtgtgctgggccttcgctgcccatgtaataaattaactatgtacgcttccgcttgtcaaactctgaattgtatcaacttttggtgtaccttgcctcctgggacaaggaataatgcacacacgtaaggaacgcccgttgggttatttccggtcgtgacatttgccgatgtacaatagccgatattgttatatcacccttagttgttttataattttatcaatgtttttgtcattgtaaaattaggggggcacatatatatcaaaagcatgttgacagaaaacacgaggcctgggagatctgcttaaatccagtgctggtccaaagctcgccttcgaatgtatgagcgtgccagttgatttgatcctgtaatcaacaagaaatagaagcaaagaaaccgcagttaaatctataaatgatagccgatcggctaggtgccgatgacatatcatttatctttgagccgatgtcatatatgcatcgatcggcagtcattaataaataagaagggactaaatctactcgattggctgtagatattaacaatatataatcattatatcgatatatacttaaatcaagtgattgggatagatcggtcgccatgccgagacagaataaatcacttagatcgaaatatatattaataatgagactatatacgttcatagcataaccgatcagatagatctagcatgtatcggctaatactccgataccactctatattaagatattaaagcaagtagaatatactaaacaaaagcctaatatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattataatcacgactcataagatcaaacttaactgatgcagctataagtatgaaaagaaggacaatatctagacaatcaagccattggatgtgtcatagagtggtagatatcctatataatctaagtcaacatcggtatttaacctaatcggctgccttctattgacggatgttagccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcaggttgcattgtcaaaatcggctgcatcggcttacctagcccgactcagacccagccgatcctaatcgtagccgatctggactccagccgattcctgctctatttctgaactcgatctccgcctccaactatgcttcgatctaatcttctttcccaatgccgatattacaaa

SEQ ID NO: 69262 - DNA, 2304 bp, Oryza sativa
atcggaggtgcctaaaaggtttgcaacttcatcatccaatgttttttttgtcatattacatttgcacctatgttttgcacacttttttgtctccaaaatttagttgtaagttgatgagagagaaaatttgtgtggggaagaaagaatatatagaaatttagttcatttgctaaagaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttactcatgtagatgacggcgtgcactatttttttactcattatggatgtacgctgaccggcggtccaaagagtttattgacggcgtgcactattttttgagagtggccgaagctaacaggcaaaggggttttatttgttgtccatgcaataagtgtaagaatcaaaaggagtattctacatccaggactattcatttccacctgtttgagtcggggttcatgccaagctataattgttggacatcccacggagagcaaggtgttgaaatggaagaaaatgaagtggaagacgacaatattccggactttgctcagtatgttggatttgaaggaaataaaacgggcgaggaggaaatagctgctgatggcaacgacgttgcggatgatcttggtcagatgttgcaggacgccagggaggacagcgaaagtgaaaaggaggcccataaattggacaagatgttggaggaccacagaacttcgttgtacccaggttgcgagcaggggcacaaaaggttggataccactctggagttcttgtaatggaaggcaaaaaatggggttagtgacaaggcatttggcgatttattgaaactcgtcaagaacattcttctggggggaaacaaattgcccgagacaacgttcgacgctaagaagatagtctgcccgctaggactggaagttcataagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccatggctaaggcgtttgttcaggaacaaggggaatgctagaatgatgcgatggcacgctgaagagcgtcaacaggacgggatgctgagacaccccgccgatggttcgcagtggtgaaacatcgacagaaaacttaaagaatttggaaaggacgcacgaaacatacggtttggtttgagtacggatggcatgaatccttttggagagatgagcagcggctatagcacttggcccgttacgatgtgtatctacaacctccccccctggctatgcatgaagaggaagtacataatgatgccgattattattcaaggccccaagtgtcacaccccgaagttttcctcccaagccaaaattgtaatttataaatgaccctaagaaaataccggtgcaaatcaggagaaaaccctaagaaagtaatgcaaataataatcggatttgacatgtggaactttttcttgagttctacaggtcgaaattcattaacaggatttttagtggaattttcagagctctagaaataattttaaccaattaaaattgagcaagcaatattttaattccagggaaaatcctttttcctttttctttttctttttcctctctttttcctcctttctttcgaatgggccgccggcccattccctccttccttccctcccccttactgggccggccgcaggccgaggcccagccaggcagcccgccgcctcctctctcggggtcgccgacaggtggggcccacctgtcgggcccgtctccctcctcccgccgatctcgcgctcgcgccgccgcgccaaaaccgccgccgcgcccacgtccccgccttccccgggccacgtcgaccacgcccgcgcgtgcgccgcgtctcccgcgcccactcccctctctctcccgctcgcgcccgcgcccgagatggccgggattcgattttcgaatccctcctctctctcctcccccactccccacgtcggccggcgattcccgcctctcccggccacgtccggttctctctccccctt

SEQ ID NO: 69263 - DNA, 15038 bp, Oryza sativa
ttaatgacttggattattcacttcatctctcaaatataatggaaggtccggagagcctatggagagcctatgacaatagcgccgtccacggcgatcttgggctttcggttcggcgcaatcgccctgcgccggcaccgaagggcttgtgcggaatcagaaccagcctcgaaggggatggtgtggtaaaaccacctcgccatccaatggcggtcccacttcgacatggcggcgttcaccggctagagatcggaccgctcggggcgaacattaaagtttacgctcccgaacactgtcttcttcgttccaactggggtaatcaccgtcttcgaattcacggtggcgaagaatatggcgccgaagagttcgtcgcttggctcaaacccggaagtccggcacgcccagtcgaagatagcgatccggaccagcgccgacgggctcaactgcgggagctccacctggaaaaggcgaagaatctccggcaacgagttgcacggaaaccggagccccgcctcaaaaaacacggcgaagaccactgtccggttgtcgacgggcttcggtacaacggctttccccggggcgaaagcctgtccctcgactaacgccctagagctgaccaactttgccagctcactatcgtttatgagagaaattcctaaataggcggtggtgtcatcgtcaatccggccggggtcgggccccttcgccgaagaggggttaggcttgcggggagccatgacgaaggacgtatgaagtggcgaagtgtgtgtgcagtggcgaacaaggggagtgagtgagaaatctaaagggccaaggggtgccgtgagagcaagaacggagaaagagagtgcgagcggtgaaaatggcaagtctggcggtgaaaagataacggggaagcatatatagcccaacaaggcgacgattcgcctacccaccagtaataaagcgccacgtgtcgtgagggtaggcgaaacggtaaattcccatcgaccgagctacacagtaaaaagcccacaaagggaaggcccattactgttcctttcggtccggtaaaaataaaaaatatatatcaccgtccgcaggaggcgaagagcggcaagtcaataccagccgcacagacaacaaactttatttgcaggaacaatgtaggtttcggcaggagcatcggttgaaagggggcgccacataccataccacataccacatgggttgcatggtctcggccgaagctccaatctcacccttgcccatgaggggcttgttggcggtatggcatgaggcccttcgaccaaaatctgccgaaggttatgcgaggggtggggatccaagcccgaaacgtcaaagttagtcggggcgaagccccccccccccatggcggaaactatggaacaaggacggtgagaggcgaaggatcgtgcgggtactctactaagccggaggcctcttgggcgaaggatgtagggcgaagagtatatgtcaaagggagccgacttcgccaaagcaagcttgcccccgcgagggccgaagaagcctttcccggcccatcaagcctaggggccattgggccgacgatcgcctaacggcccatcaggagtccatgaacctctattacactatgtacccatgtaaatgtccctttcataagggtaaccatgtaaattcccctgtataaccaaaaccctagtagtaagaacctgtaataggggctataaatagtctcatagggccatgtaatagggggatccaagaaaaattctctaatcaatacactttactttcaaccactgttgagtaaccacgtctttcgacgtatgcagttgtcgtttcgaccacaagctgggccggccattgggaatttcgagcgaaacccatgaaaagcgaatgccctgaaaaaagttgtaaaaggagaaggttcaaaggcgaaagaaaagcgacgctggggcgaatatggccgctgaagagggagcagagccttgggcgcctgtcgccgaagatggaggagcaccatctacttccgcacctgcgccatcactaccgccttcggcccctgctacctctgtgcaggtgccgaacgcggctgacatggcgaaggcggctgcggcggcgagggcactccagaccagggcggagatcctttcgacaagtcaactgctggtgccccaagccgctccgtcgcagccggcagcggcccaaactgcgcttgccgctatgcaagcccaagtcaaccctgaccccgagacacaaaccgaagccgacatggaagccatgcgacagaacatgacacgactccaagacatgcttcgccaaatgcaagaacagcagcaagcgtacgaggcggcaaggcggtctaaggtcgcttcggcaccaatcctccagtattcggcaggctatgtcccaccccaagtctatccacaagtgccgacccagccccttccgccacaagtcacgcaagcgccaatgtacttcgtcgggcagccattgaccgcagcagcgcatccagcccctcatgtgcaactgcaagctcaaccggtcgctacccaagtacatcctcaaccgcctggccaagtgccacaaacaatggtagaaggggcttcggctctgcaggcgcagctccaagctttccttcagcagctcagccaacctcacaacatttcaagtacagccccttcggcctgcccggaggggaatacaagtcaaggtgcgcctagttagttgccttcgaatcagccaggtctgggggcttcgccgtggagtcaaggaccacagttcgactctatcaatgctgctcaggcgccaaccgttcggccgcaagcaccaacgccaggcttcggagcaaaccaagcaccaaaccagatcgccatgacatggtcacagccaactttcgacccattcatggcggctcatcaagcatcaccaatcggggccgggcagccgaatgccatggcccaacctcatgcgcaagccgtgatttcgcccttcgccacgccgtacccgcagcaaggtgccatgaacagggcagggggcgaaaaggggctaccgctgagtgggggaatcaagacccgtccaatcccaccccagttcaagttcccacccgtcccacgctactcaggcgaaactgacccaaaggaattcctctccatttatgaatccgcaatcgaagcggctcatggcgacgaaaataccaaggcaaaggtaatacatctcaccctagacggtatcgcccgctcttgttatttcaatttgacagccaatagcatttactcatgggagcaattgcacgatgtctttgtccttaactttcgaggaacctatgaggagccgaagacgcagcagcatctactcggcattcgctagaggccgggggagtcgataagggagtacatgcgtcgcttctcgcaagcccggtgccaagttcaagacataactgaggcatcagtcataaacgccgcttcggccggtttactcgagggcgaactcacaagaaaaattgccaacaaggagccgcagacgcttgaacacctacttcgcatcattgacgggttcacaaggggcgaagatgattccaagcgacggcaagcaatacaagctgagtacgataaggcttccgtcaccgctgcttaagcccaacaacaagttcaagttgccgaaccacctcctctcgttgttcgccagccccagccggcgatccaagcacaaccgccaaggcaaggtcaagcccccatgacctggagaaagttcagaaccgaccgtgcaggcaaggctgtgatggctgtcgaagaagtgcaagccctccgcaaggagttcgacgcttagcaagcaagcaaccatcagcagcctttccacaagaaggtccgaaaagacctctactgcgccttccacggacgctcttcgcacaccacggagcaatgccgaaacattcggcaacgtggcaacgcgcaagatccaaggacgcagcagggagcagcggccgaagcaactcgtgaagtagctcaagaacaagcaccccccggccgaacagcgccaagatgcgcaatgccagagtgatccaagtgattacaatggccgacccgccgatccaactgtcgaagcgacagaagaagatgcagctgtgaacggtccacaatatcacttcggcaggcgaaggggctccgcaatatctgaaccagcaaatcttttttgggccagaagatgccgaaggagtaatgttctcgcatcaagatcctctggtgatctcagccgagatagctggttttgaggtccggtgaatcctggtcgacggaggaagttcggccgatgtcatctttgccgaagcgtatgccaagatggggttgactacccaagcccttaccctagcaccgacatcgctccgaggattcggcggagaagcagttcaagttcttggccaagcacagttgatagtagccttcggcacgggggaaaacagacgcgaagagcaagtattgtttgacgttgtcgacatcccacacaactacaatgccatcttcggccatgcaaccttgaataagttcgaagccatttcccatcacaattatctcaagttcaagatgctcggcccggcaggagtgatcgtggtcaaggggcttcagccttcggctgtttcaaaaggcgatttggccataatcaacagagcagtgcacaatgttgaggccgaaccgcatgaccgggcgaagcacgcgccaaagcccgcccctcacggcaagatagtcaagatgcagattgatgatgccgaccccacaaagctcgtatcactaggggcgacatgggcgaagaagaagctaagaacatcctagaggtactaaaaaagaacattgatatctttgcctggggccctgatgaagtgggaggtgtttcggcagatctcatcatgcatcacctggcagtcaagccagatgccaagccaaggaaacagaagctacacaagatgtccgctaatcgccaggaggcagcaaaagccgaagtcaaaaaattgctcaaggcaggggtcattcaagagatcgatcatcctgagtggctggcgaatccagtgctggtgcgtaagtcaaatggcaaatggcgcatgtgtgtcgatttcacagacttaaacaaagcatgtccgaaggatgatttccccttgccacggatcgaccagctcgtggattcgacagtcggctgcgaactcatgagcttcttagatgcatattccggctatcatcagattcgcatgaacccggccgacatccccaagacagcattcatcacaccgttcggcaccttttgtcacctcaggatgcctttcggtctgaagaatgccggagcaaccttcgccaggctggtgtacaaggtcctttacaagcaattggggcgaaacgtggaagcttatgtcgatgacatcgtcgtaaaaagccgcaaggctttcgaccacgcgtccgacctacaggagacttttgacaacttgtgcgcagcgggtatgaaactgaatcctgagaagtgtgttttcggcgttcgcacaggcaagctgttgggtttccttgtttctgaaagaggcatcgaggcgaatcccgagaaaatcgatgccattcagcaaatgaagcctccgtcgagcgtacgtgaagtacaaaagctcacgggccgaattgcggtactcagtcgattcctctcaaaggcagccgaaagaggtttgcccttcttcaaaaccctccggggcgcgggaaaattcaactggactcccgaatgccaagcagtgtttgacgagctaaagcaatacctgcaaagcccgccagctctgatcagcccagcatcaggaagcgaactgctactatacctggcagcttcgccagtggcagtcagtgctgctctcgtccaagaaacggattcaggccaaaaaccggtctatttcgtctccgaagcattgcaaggagcgaagacaagatacattgaaatggaaaagctcgcttacgccctggtgatggcttcactcaagcttaagcattactttcaggcccacaaagtcatagtgccatcacagtaccctttgggcgaaatactccggggtaaagaagttactggccggcttagcaagtgggcagcagagctatcccctttcgacttacattttgttgcccgcactgctgtcaagtcctaagtgctagccgactttgtggccgaatggacaccggcattcgcccctgaacccgagcccattgaacagccctgggtgatgtactccgacggttcgtggtcgcacaagggggcgggcgttgcggcagtactcacttcgccaaatggtgtgccaatttggtatgctgcaaggttacagttcgacacaaccaacaatgcggcagaatacgaagccattattttgggcctaagaaaggcgaaagcattggggattcggcgcctgctaatccgaaccgactccaagctggtggtgggccatgtcgacaagtcttttgaggcaaaagaagaagggatgaaaaggtatttggatgccgttcggtctatagaaaagtgcttcagcggcataacggtcgaacatttacctagaggccagaacgaggaagcaaatgccctggcgaaatctgccgcttgtggtggtccacattcgcctggcatcctttttgaggtcctgtatgcaccaagcgtgcccatggacagcttggaggtcctggcaatcgaccaggtcaaattggtcgaagacccatacgactagtgaaccccgtttgtgaagcaccttgaaactggctggcttccgatagacgaagcagaggcaaagcgcttgcaattcagagccacgaagtataagatggtctcgggccagttctatcgctccgggatacttcaacccttgcttcgctgtatttctttcgccgaaggcgaggaaatggcgaaggaaatacagcaggggctatgtggcgcgcaccaagccgcaagaatagttgccttcaaagtatttagacaaggagtttactggcccactgtgttaaaagtatgtgttgagcaaatcaagaagtgcgaaagttgccagcatcatggccgaagccaaaccacgccccagtatgagttgcagcccatcacaccaatctggcccttcgccagatggggactggacattattaggccgttcctggcggcgcgaaacgggcacaagttcgcaattgtggccgttgaatacttctctcgatggattgaggccgaaccccttggtgtgatcacttcggcaacagtacagaagtttgtatggaaaagcattgttagtcgtttcggagtgccaaaagagttcatcactgacaacggcaagtagtttgactctgacaagttcagagaaatgtgcgaagggcttaacctggaaatcaggttcacatcggtcacgcacccgcactcaaacggagcggccgaatgtataaatggtaaaattctagaagcactaaagaaaaggcttgagggggcagcgaagggcgaatggccagaggaaatgctatctgttctctgggtccttcggacgacccccacaagaccaaccaagttcagcccgttcatgcttctctatggcgatgaggcaatgaccccaacagagctaggggctaactcaccaagggtgacgttctttaggggcgaagaggggcgcgagttgttgctcgaactcttggagggggtaagagtcgaagcactcgagcacatgcaaaagtatgccacaggcacttcggcaacttacaacaaaaaagttcgaccgacggagttgttgcctggtcatcttgtcctaaggaaaaaggcgaaccctatagccgttggcaagcttgaatcgaagtgggaaggaccgtacctcatcaagcacaaatccaggacgggatcctttcgactggcgacactggaaggctaagatttcgaccattcctggaacgctgcctctctcaagcgtttctatgtctagaacgggtggcacccaaatcgccaacttgtaaaaatgtatatatcgttatgtaagcccttcggcactatgtaagcctttcggcaagaaaaaaaagagaaaaaaaagaggaaaaaaaagggaaaaaaagaggaaaatggaaaaagacaaaaaaactagatgtagggctattatccaccacggaggcccgaacgagtataaaatctttgtgtcctctgccttctttttatttgtttgtgcgattgataatttgcggaaaaaccccaaggcaaatgcctgatcagtgaaaaaggccagggggcgaaacgaatcggccgaagcatcgctcgccgaacgattgaaaccgcaacagcttgtttcggagaacaattagccgaacaccgttacactcgatcgaaaggaaagcacgagtgcttcctataacgtagaacaaaacggatcgaaaacggaagccgaaagctgaaaagtcaaaacctatttcgctaatatatgcaaaggggccgacacgttccgacccaacaaaaagcacgtgaagtgacaatgcaaaaatagcgaaaaggaaataagacgcacctttatggattttaaataaaaatgtatcgaagaatacatcacaatggtacaaatgaagagaaaggagcaatggcgttacagcccggcttacagataaattacatcttcgccctcacgatctctctctctctaaggagtgatcgaacgaactaggttcgtcatcactactaatatcatacacaaccctaagaggagaagggggtgaaatacagactagactgtaacgacgttgagagatcgcctcctgccgatcagtcttctgatggtttcgccaaaagcgagccatgtcctccaaacgtcttgaatgaacaagatcgtagtcttctaaggttcgcccagggtgcgcccgaagccacccggcaaccttaaaaaccttatagctgcgtccgtttatcaccatttcacgataaacaggccgaaatgggcatcacacctttggcaaatcctttaatgccacaaatttcttgttttggtttcgccaactcccagaagggggccgaatgcacaactttcggcgaacaccctggtagacaatgcaaaaagggcaaaaggcgaattgcatagtaagaataggcgaaaaaagaaaaaaatattgcataatgtgaaatgggcgtaatcataaatacgccaaagacatcgaccatcaaaaagtggctaagagtgagtcatatatattcaaaatatccaagggcccctttttcggctacaataagaagggttagcggcagcccgccgaatacacatcgtttgccactcctggcgaacacaaaaagaagaaggaaaactacaaaaatctaaggaaagggcggagggcctcacacctgtgggtaatcctgggcatcgcctcgacccccttcagccgtcgcgtcctcttcttcgcaaaggtctgccgcctctgccttcgctagttgctccaaaaggcgctccttggcggtggaccggccgtccttctgccagaactgtttccgccacgcacgaagtgcgggcgaaatgtcctgcgcgctaatctcccagtcccccttcgcatagttagggaactcggcgacgtgctcgcagccgaactgttgcaggagacccatagtaaaggccgctgatacacgcgcacaacaatcgccgtacgcagttgggcagtccgaaaccgaaccaccagctttctgggtccactcggagaagtcgaaggccgaggcatcttcggcagggacccctcgcacttttgcacccatgtcagtaagggtgaggcgaagcgtttggcacgccgttcttgcagattcggtagttttcgccatctcccgcgaaaaccgctgcgactcctccgcggcgctcgcttcggccttgctgacctctaggtgaagagcctccatcttcggctcagtaaggttataataatccatcagcacggcggaatgggccttttctttccttaattcggcctggaggcgatcaacctcagctatggcttctctcgctttctccagatcagccttgaggcgatcgacctcggccctagcctctctttctttctccaacttggattggagccgcttgttttcggctttcgcctctttcagggtgttggcgagggcctccatctccaagttcttgcggcctatttcgtcatcttggcccgaagacggttcttaaacccgtcaagacgagcccgcacggttcgctctgtcgaacagtgagctgcaagaatctggatgcaaaataggaacggcgaagatagcaaatgttaattatgggacatgtaaaaaagaagaggaaaactaggaatagataaaaagcatacccgaaccgtcaagcttttaatagcagaacacccctcatcgaactcattcagttcggtgaacaggctcggggtgctggcatgtaagacaagattgcttactccctccacaaagggaataaggtctgcccgggtctcgaaatcgccatgggcgaaatgaggcgccacaagggaatactccgaagcagatgtttcgacggccgcacccttccccttcgccttgactagcggcgaaacaaccggctgacgcagagggctaccgaagaccctcgccccagctgtcaggacccgttccgcggaggctgaagccccggcggcggcgctacctcctgctccatcagcaccaagtaaaagaacgggggcagtcgaaaggtccaggctgcggccagcgggtgaagtcagagtctcgtcagaagactcgtcgtcgctgaagacgcgagcgacatcgacgagtcctttcttcttggatatctttttgaccggacctcccttcgccgccttgcctgccgaaaacgcaattagcgccttcgccccatccaactcctttcgacgaaggggggagctgtttgattccaccccggtctcattgtgacccgggccatggaggtgacgaccatcgccatctccgtttgagtcaaggtcacctctatctttttcgcgtttccatctctccacacaatgccgaaccacttctctgttgaccacctcccgttttgtgcatcacagccaccggaacgtgaccacgccaacgacgccctggagcacgcaccggagcgccgccgcttcaaccatcgtcatcgtccgaccattctcgtccacctcggagcaagccgctgcgccatcatcatcgcctcaacctcctcttcaatacgcctcaagaaccccagccggagatgtgaaggacttggagaacgcaacttttcttcaccggcaccgatctagaatcgcctccgccgtcatcatcgattactgctgcctcggtgagccattgttcgattcctcgcgcatacaccatctccttgacctcacaaccctcgtgcatgcttgcttgtagcagctcatcgtcccatttgagccgtcgtcgttcacccaaggaggagcgccgtcgccgagccgttccacaagtcatcgctgccgccaagacctcgacaaccttaactcgacccacggtaagcatcctgaaggctagaagaccacatgcatgcatccttttcgttcggaatcgacttccatgcacacatgcactttcaccccatgaaccaccgccgctcacaccactgtcacgattgtttccgacaacctctgaccttgagttaaccatgggtagatgcgcgaggagcttaggaatgttttctcttttggtggcaccgcaagaacggccgctgtccattgccggcaccgacgagaagctcgtcgagtcgccgctgctctgctgctgcccttgccctcttgctgagagcctgagacactgaccagcggaccccacatcattaggcgctgagaattccgcttagagagagtttaaatcttgcaaggtctaaattgtaaaatatgttagaatgacatgtggaaccaaggactaattagtaatgaatgaaaagaatctgaggactcttaatgattttggttcatcacatactttggactgcgggttgattcctagaaatctcaagggcctttctgcatattggtccctcactgacacgtggaccccatccttaaaaaatctgaagaataattaataaaatgcccaaacaaatatatgtttagcagaaaaatgcacaaagttgtaaaatccatataaaatcaaatgaaactcattttgagatgattccagttgctgtagattcttaaagttatgaactctattttagaaatataaaacttgacactcactgtacaaataatgtctctaaaatttatctaagataggtcatacataaaacatgtacaagcttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagttttagataagctaaactttagaaattcatgtagaacacaatttagcttcaatttgagtaaacttaagttctgtaggatcaccaaaacatgtatttccatgttatgatataagattatatacttactgtgtagtaaaagtctctaaatattcatataaggatttactaacatagagcagccattaatttgtaaaacttgtagaaaattcatttttaatccaaatgaaatgaacaaagtttctatagaaccagcaaatagttatcttcaacatagtaaaataaaatttggcaccttttgtagagaacatagatcaaaaccttaacttagtgaaataagaatttaaacacatagtgttgtttaagtaatacataaacatgtatcagtatatatacactttaggtctaattaaacctaaataaaaacttgattgaccagtgaagccatagttccatcctcatccactaaaacttagaagaacttagctcatatacaatttctaggttaatataatatattgctagtctagattagagcatatctagtttataaaatatgaaccatagtagtaaagatcataaacatgtgaactaaaaatgttttagttaaccaaattattccttttattcaacttaaacatgaagtagcaagttctgaacctacaacttgagagtcatgcacatataaaacactatatgcctaaaacacgttgtaacttgtaaaatctataagaaaatcattataactccaaaaattgtgaaaccaaatgtattagtcttagaaaacacacctctacacctctgtgaagtctaatataataaaaatcactttacaaaagtatttcataacactacctaagactatactactataaaccgataaaacttctaaaattcataactcccaaatccaaatggaataagataaaataggaattatttcactaaattcattttagaccagtacctaatcactgtgcataaatcatgcattttagagcattttggatttttagctctttcggtgtttaattgcatatcgtgtcctttatctagataattgcataattggtgaagaagtggattaggtgctaacatttctctgatcaaggcaagttttctcctcccatcctttgaacacatttaatcccataatttgaggaatgaaaatatttgtttgcaaagttgcatgtgaatttagactatatcggtatttaaaattgggttaaggtagttatgacctatttgctgcataccccaccttgaataattgatcctcttactgtttgaacccttagaaatggttagagtacactctttgtgctcaaatgggtttatatatgctctatgtgcaactacttgcttagccatgcttagaaatatgcaaatgctcattccatctgtaattaaaatgtgaattttgatacatgaacccttgctggaataaaattaatatgatgggtatttggaactaaaatgtataaaatgtgattttatacttgggcggcaagtggtgcgcatatggtgctagttgcataccgatagggggagtgtttgcccaagtccataaggaccgaacttgtgtcacccatttaaagtattcggtatatccccatggctaagtatggaatggcctaagctaattaatgtatttaggaccagccttccattctagtagcccggtgtgtatgagttagtcgaaaattctaaggaattagtcgataattcagagaaactttctatttgccccaacgtggtagtttaggtgactaagtctatccaatacaacggtattgtgccacgtgggtgggttcccgttgtgtccgccaccacggcgttaagtttaaggcgtgggcccgccacttaacggttctaggcatattccaagtatgcctaggatggaggaacacgtatcgtgttggtgcaaggctaggttctaagttgtgtaaaggcttcgttatgacctctagatcacattcgacatgaagagtgtgatggagtcttgcaaactcaaaacaaactagagagttcatatcatgtgggtaaagctgtacaaactctgcagagttctttaaactaatcgattagccgtactcacggtcatgaacgctttggtgatgtgtcatgagtatagactttatgttttaaaatgtgatcatgtgacattggtttgaaattgataaatgtgttgagttgtgtgtgtgaggtgatatattatgatttgttgtcaaaggatgacaaccagagattgattacgatggaattatgatgaacttaatattgtaacttaaaattttgttttgttaattgaagcatcaactcctttacaaaagaattgcgaaacaaaacttgctttatgctgaaattgaactacatattgccttcctttgaatatttgccttcctttgaatatatgccttacatgtagtatggtaggattgacttgtgcttgccagtacattaacttgtttaatgtacggactcttgctgttgatataaccttttgtctgcaggtttagatttagtctttgagtgatgcgggttccgattgctgttgatataacccctagtcggtgtgcttgtgatcgggtatcaagcttctgctgttctctgataagtttatttggccggtcagcctatgtaattattaag

SEQ ID NO: 69264 - DNA, 7814 bp, Oryza sativa
cttttagatttcatattgttcagctattttgtttgtttacaacaaaatggaccatatccaaaactgcaacaactctatgcatggatcaatgatgctatataatcaggtaagtgtaattttgatcagtcttttgaattggtatccggaaattttgtgagcgctttagcatctttttaacctcataggtgctgctagatcaatagcattttttatctctctgtagttgtcgaatgaaacttcacaaatgtggatgtgtttttttttttcaaataatgagtggtagctgctacaagtatatcttcctatgtccagatccatcatgtttttcattgtcaatttgagtggaagctattctcaatatttttcttgactgcataggtcccttcttttttggcctcatagatactgctatggcaacttgattttgtaaattactcacttgacaacgatatggtgagagcttaaatatcttttttttacatgtgattgttatttaaatgcttaatatgtttataaggccagtcccaacccaagaaactagacatagtttccataaactctacatcatcaagaaactagtactatacactactttttcaatgcaaacaccactttttcatgcttaaaattaatgctacttatctcacatgatgtcttaaatgctgtgtagaaatcatgtctcatgcaagaccctcatttattcacttgccacatcatcttttactctaggtggcagcttatttaatgctatagacaccatcctagtcattaggttgggaatggcctaagagcaggaacaattgtagactattagacagctgtaaatatattttaatgagatgaaagatgagggagaagagcagccggctatagatctgtagccagctgcagcacggactccaatacacaatgtgtgtatgacaggtgggaccatataacagtatagtaagcaactattttatgaatttactgttagattagctaaagatgaactggagctagtagtgggctatactattaaacttgctctaatagagctgtttgtggaggtggttggtcccgagtgcatcatacccgagggatgagggatatagatcctctaatcttcttatcatcggcttcattttatcaagcgttattatgctagcactcatcaattcatcctttcctcacatactacgtgttttagctataactatcaattttatacatgatgccaatactcttatctacaaaatcctgttattttacctattatattagctaggttgattgtacaaattactaaacagaccgcgaaagtaatcatataaaatcctataaggccctgtttctttcagcttgggattattataatccagattattaggagtaagctgaaagaaacagacaacttattgaagtagcttattataatctggagctcagcttattataatctgataagctcatttaggtaagctttttctagattattgggtgaaaaattacccaccatgccatcccacttcctctttagacctgcaaacccaataatctatgctctaataatctagaaaagaaacaactaaccacttattctactacagattataacaatctagcttatagtaatctgactcaataatctagattataataatcctaatctgaaagaaccagggcctaaagctcatgtcgttgctgtacactgttcactcgcccgcgcggccacgtcacccaaaaaagcagcgccgtccgatgccccgcccagctacgcgttcgccatcgtatcaggccaccgcaacaggcagtcggtcgtgccctaatcccttatttcctctccccttcccacgctccgccgccgccaccgcgattcctcgcattcgtccccactccccagcggcaccgcatccgagccagcgcgacctcctcctcgagccagtggtcgcccgcccgcccgccgtcgctacctcctcctcgagccagcggctggcatagatccggttgtcgatgtggttgcagatcacggacgacgtcggccaccaggtggatgaggtcgagggaggcctggcggcgctgagcaacgatgtccaggtatggtgcttcttctccacctctctccctcatctcaggtcagtcccctctctccctcatctcgcttcttatcctgcttctccacctcgacctctgacgacgaccaccactgcgatggggacaggatgcgtcagatggtgctctccgggccgggatccttctctctcgcgcctcggtgtcgtcgacggcagcgtgaggaggccacggggcacaggatggagcacgcatgggctagcgagaccgcgaggtcgtcttaggtcgtcgtccccgtctcccccgagctgccccgttgtcgcttcttcctgtgagctctgttctttgacccaacaactatttggggtttagtctgtggcaagtgttctgctccaaatcactcgagagattggtgtcgatctgtaggtatgattgactgatttatgccctggattgagagagtaatatgtaattaggtgctttcttggtcattttttcctggggatttaactggcatccgtagatttcttggatttgggattgatttactgcttgattcgaagctctgtttcgttaatataatggcgagaacttgaactccatctatttaagacatttttttttgtttcagctctctggatcaaattaatctgagggtctcttgattccaattttttcatccaggatgctgctgccagtacatgcgttgcagctcttcttttccttctggatctggattttaatccacatgtctgccttttgttatttttaattattttgttcgattgattagtctcatcaacctttactctacaaatgatgatttacatggtcattattccatccagaagaaatgcattgactgttttacatggcaaacttattgaagggttgtgttctatctcgaccaaatgttctcaaattattttgcctgctgctgcattataatactcacaagctattttactatcatcgaatcctcatccggatacccagctgtgtttttgttgtatagtgtccaatggatctctgagcaacccagttatactagaacaaaatgaagatacacagctttgttattatttcgttaaatacttgcagattccatatttcttcacaagctttcattttctttactataatcttacaggcaggacacatgacttcgatcatggtttagcatcatctgtcttggaatctttggaattcctaaagctaaattgatcaggcactcagtgtcctatatatgcagcagatgaaatgattcaaaaacataatatacaagtatccgttgttgattagtccagtgaatattgtcgtagccacacaggtaaccaaaactgcacaaaaagctgcacaacaatttcacttggttttagttttcttattgcttttgcttatataagagttagggcatattacaaatagtaattattagctttaaatcttttttttacctaatgatttaactggaggaaaagttcaagctagctactgcagataatcagttttgctttaattatcttgatcagtctgtaagtgataacctgttttggttatgtttaattccttcattattaactttggttggaagttcaagcgttaattaaagtttcattggttggttcattcacattatcatgccatataatcctgtgacaaggcatatatttctagaggtttgtccaacatatctaaaattctgtatgggtgccgtgttgttcaagagttgtgttcttttctgccttagtaccaacagagttccgctttatggttcacttcacaaaattttctccgcatgttgtttatttatcttaaacgagcaggatggaatgcttcataggctgcttcaaggaatgggaggtaaaaaatgtgactagcaatcctatagttttggttctacatatatgtaatcgctgtacatatacgcagttaacttgctgctcactgatatttgtttttctggtcactgatggatgcttatattatttgtttctcaccgatatatctttcacgtatgatagttcattttagactaatttgtcattcaaattttatttcatacagataggcaagtcctctattttccagattaatacgggggagacatcgaaaagatatgcacctcttccttctttgtacagctgaagtaatgccttatgatagcacaccaaccacatgcaatttcttctaatgaacacacaattgtttatactttgctacatacagtggacagttacacctcaaatccctcctagaataaatcgaatgaaacagttacataccagtctgtactatgacatcagtatggcccttttggtctgtatagctgtcattattgtaaactatgcactatgtgtacatgtgcttaagattactagctacctattcatgttttcatgctatattatggtatgacatgtacattcattgtacaaataccacactaaaacttttttccttccgtgttcaggtacatcttgaacggcagttaatttccaaactgaaatcatgtttcttcaggttcaaagaaaaaaaaagccatgtttctggaaattcactttatttgattatcaacaccctttcacactgttaaattgtttgactcctatcatggatatagtatcaatacatgtactctattattgaacgtgtattactgacactgaaagtttctattatttcacaattcctattatcttcttcgttctaatgatttcctattattcaccatgcgatttttaaattattgcaccatgtattatgctattgaacttattaaattacatgtccttgcagaagaagttgacattggcattgtgcaagctctattgatgctatccaacctccacataaacattgtgccttcttttggtaatatgggcgctttaggcatagacctctgtagggatcttcatcctgtagtcaacggttatgcattcttctaattgttgtatattactcttagtctggtggtatatatgcagaaagatattcatacccttaccataaccccaaaaaatgtaattgttaagataaatgaaaatttttcaagatttattgtgacttagaacttcaattttcactttagtaatgatatctcactttcatggtacaaatctatatataaagatttgtactttggtatatcttttagtcggtgtaatatttcttttgttataacaaatttgttttgcgtggtttattgtaaaattagtgatgtaacaaataatgtgcccgcgcaacgcgcgggccgggcatcacctagttagggcacccacaatgttgtaaaaaaccaggtagtaagcattaaatggttgcttactacctggtattagtcattgtgggagtagttcattcttaaagccaggaagtagcgctgctgccggcaagaagggaataaaaaatgaaatgtgtacagtggagttctgacaaaaaattttaaattgcaagtagccgttgcttcttccaaccgttgctctcctccccagccaaccgttgcatggactgttcttcttgccatcttcatctcctacaaaaacagagatggctcataatttctttgaatcaacacaaacacattctgtgaaacttagctagctgagagcttgagatggatccctccaagagaggtttcatgaacttgttaaaccaaggctctccaagccaacaatctagccaaaactcccctcctactcaattcccctcaactttctcccaatcacaatttccccaatccccacattttacccaagcctcaccacctaatttccaaaccttcaacccttttggtcctccagccaactatcacctatatggtagttctcctccaaactttcaaggttttctgcagcaagcaagctggttacaatctgcaccaataagctttcaaggttttcgtccccaagaaagttggatgcactcaccaaatcaagttgtcgggtccgcctcatctcatggatccaaatcagcctctcagtgccctgcaagacaggaagagaacaatttggttaacatcgaagagtcaagtgacaatagccaagagacagggagaagagggacacacgtcaactggaccgaagaagaaaacttacgactcctcagctcttggttgaataactcactagattctataaatggcaatgacaagaagggagaatactattggagggatgttgctgcagagttcaatggtaatgcatctagcaataaccgcaaaaggacagtcgtgcaatgcaagacacattggggtggtgttaagaaggacattgcaaaattttgtggagcttattctcgagctagaagaacctggagcagtggattctctgatgatatgatcatggagaaagcccatgcattatataaatcagaaaacaatgataaaacttttacattagagtatatgtggagagaattaaaggatcaaccaaaatggcgacggatacttgaagaggacagcaagaacaagaggactaagatttctgaatctggtgcatatacatcatcatccaaccaagaaactgaggaggagaccagccgaaaagagaagcgtcctgaagggcagaaaaaagccaaagccaagcttaaagggaaaggaaaaaaacctgcaccgtctcctttgggggaccagccatctcaagattttgttctcttcaacgaagctgtaaaattgagagcagaagcagtgctgaaatctgcagaagcaaccaccaaatcagcggaagcaaagaaggaacaaactaggatggagaagtatcagacatatttaaagttgttggacaaagacactgccaattttagtgatgcaaaactcaagaggcatgaagctgtcctcgaaaagctagctacagaacttgcagaagaatagaagatccctaagttatgtttgtacccctagtacttagtgtgtcactgtttcattaagtttaacttgctagtaatatttagacttgtgataggtttgtagggcaagtaattgttgtattgtgaactcagtgaatgatgaatgtaatatttcactagtgagaaggcatatgaagtgataatatttgcccacaatcataatatgtctgaaccttcttctctgtagtctctgatttgtcccataacaacagcaattcgtttcttaagcagcctgcagaaaaatatacattgataataattagcacaacattttataatatggtggtttgaatagatagaaaaggaaggtatggttgtttaaaatctagctgttagaatacatccaaaaagcaagacatggttgtttaaaatctagctgttggaatacatccaaaaagcaagacacagttgtctaaaatttagctgttggaatacatccaaaaagaaagacatggctgttcagaatctagctgttggaaactagccgttgcaatggaagcaaaagcaaggcatcaatgttacacatagctagcaggatgaaccatatataaataagacatgcacatcacgaaggcagcattccccttcctttccttcaacttcttaccaacatagcaacccatctccaaaaaagatgtccactgagtcacaagataattctagtcattccgatgagtccatcactagtgagaagcttgatgatatgacatgggaagaaattaatgaccctatggaagctcagcttgaagctcggttggaagctcaacttgaagcgagattgatggctcacctagctggtagctctaatcagctggggggctacacaaggaggtacattagtagagatcatgaagatgaccaca

SEQ ID NO: 69265 - DNA, 1313 bp, Oryza sativa
ggttttgcgggtcgcccccatggcagtaaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagttttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaatttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatccgtatgtcaacaattgtcgtttgtgtaccctggctggtcctggacagggattcaatgcacattcagcttagaaattctggttcgagaatttctgggcgtgacatgtgccgtctacgtacttcttgttgttagtccaaaatacgaactcataattagtcaggtgcatagtggcatcctatcatgttatatattatgtggttctgtttggtgacatcttttggaatatatggttattcaacatcttattgaaatgtcatgcatctctatgaaatactagtgcttgtttttttattgtgcatatggacaatcaacttgttaatagaacctaggataaaacattcaaacaagcaaacatattatatatttagtttccacaattacatagacgacacatgtacatagatgacaa

SEQ ID NO: 69266 - DNA, 8914 bp, Oryza sativa
  unsure (1)..(8914): unsure at all n locations
caccccacaccatttccccattcccctcttcctcccctctttcctttccaccgcgccgccgccctcagtaccgccgcgccgcgccgtgtgccgcgccgtgtgtcgccgccgccgccgccaccgtcgccgccgccgccgtcggtaagccttccgccccctcccttcgttgccggtagccgcgacgcgccgctcggccgtgagagagagaggagaagacagagaaagggagagggagaaaagagaagagagggtagagtgggccccacctgtcatttgctcctataaattcctttaggaagaaaaataaaagaaaagaaaaagaaaataggaagaccccacctgtcagtcactatagcttgtggataaggttgtattataaataaatgaattaggaacagtgcctttttacaatttctcggatttattcaaatttgaatctttacactagcataacttattcattttagctccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacggtagagtagatgtaataatatttgtctctaacatgtcttgccactgtaacaaccacacaaactaattttatgtgatgtctcaaatgaatggatgtattggaaaatactagtacttatttaatattcgatggccatataattaaatccatggcttataggttatttaaatcaagtgtagccttatgattatgtaactaaaatataaacacacatagatgaatctgtttaggagaataataatagagctaaatgtggaggaatcactaagtaaattaatcgatgcaataccatatagaatagcatatatatgcctaaattgattaccacttattagtaacccaatagaaccagtgcttaaacttgtcgcatcacatatacaatatcactcatagaaactagctaatgtataattaaactacaatatattcaggaatcacttggagcattgggtagtacactttctaaataagctcatgtacagtaggcgaccaaaacattatacgttgttgcacacatatattggacatcccattatagttatacaattaatttatctttttcatatattaaactggggagtatataacaaacatgcatagtagataagtactaattataaatcttgacctcatatgttcatagttcaattgtaactccggattgttcattaagagataatctgtaactataatattataaacctcccgaatttaacatatagagcatggataattattagcccttttataatttataatggcaagtaaaatatgttcataattaaagtaaagcttccatcaataaaataataatacaaatgattcactgtaattatttgattgatcctaaatccatctaacaacagaacctctgatatgtaaccgtgctatttagatatatgcatacgtagccataatccttccatagctatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaggcaagtcatcactattccttgaacatgttgatcccaattgcgaaattatttttatttacaaataagattgcatgcaatgatgaacatcctatttgtgaatatgccataccttgattattgtttaaccttattcccttgtaaccatgattacgtatgagtctctagtcaactatgacaaatgcttagagatgccactctagaatcatgtatactcatatttgtcaaatgctatatgcttgggcaattacctttgggaaggtaattgaaatgcggcatgtggagacatgagcgccacattgccatgatattgatgacatgatttgtgaaaggaaaataaagtgaaacaactgttttcgactggggcggctggaggatttgggtggtgtccggaaaaggctagtgccgtccctggtcaattaaggaccgagccatgaagttaagtatgaaacgaccccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaacataattataacttaatgcatgtgtgagtcttcccttccaaggtgcgccagaactcctcttactgctagaaaccgtatacgcctagagtgcatgaggatgtaaaagttcatggagcgggtactgccaatgcgaggttatcgaaaagctttgccgtgacacatctcatgtgttgggacgaggctcatgtattgggcagttgcggagtgcgggtaaagtgtacatccactgcagtgtgagtaaaccaatctattcgaatagccgtgctcacggttattgagcaccgggacatgtattacacttcgctagactctaaattcttaacttgtgtgggatgggatattgcatgatgaattttatgctgatggagccacttcctgagaggagggaaggtggacgtcctcagaaaaccatgaccactcaatggcgggaagctatccttgggattacaatggatggtggacagaaccatcgttgtttaatgtgaacactggtattaaaacttgatcagtctatgctaggtcttaggcttgtgaaaagatttgtaaaacttgctttgcgcaaaggaacctgaagccattccttgaaataccctctatcatatgcatcgttgctgtggtggcttgctgagtatggttggtactcacccttgctgtttatatatcttttaggagagtgttgaagagaagcccttgtcggtacgcttgcgtatccaacaagatgatcggagtgcggtcttgttctaggtctcgttccccagtcgactgcctgtggcatgttaaccgggcccttatattattttgtcttccgctgatgttctctgatagttgttggcctacctggccctaatgtaagtatttaactcttttagcctgaattcattcgtgatatgttgtgatccaactatgtatgtgtgtaccaactactgatccagagattggtacggataaacacagaagatttccgatttccaaaatcgggggtctacaccctctaagctacatcttcacctttcagtaactatatagatagtatatatccatttgttttaatgtcctcaatgctccttccatccatccatcccagtttgaccatcctctaagcaaagcgtaccaagaccaaggacaccaacatatccatcattcttaaattaatgctaaggtgttccatcgcttcgtatcccgtgaactgctcttattttaaatattatgatattgcactaatagaaattaatcaattttagttacatgcaacacatgcaatgatgtacatttactcatttcataaataaacgaaaagacactagttaaatgatgatcattttaggaagatcttagaaaccttaggggatgatcaaattgagatggagagagtacttttcactgaaaatatcttgatactagaatataagtaaattttgtttgttgaactcaaacaccacaaacttgtcacaattacatgtgatgatctacatgccatcttttttttttggtggttgggcgatcgattgcaccacgtatatataaaatcaattattttttagcacctagggtgaaaaatgaactttgagccaaattcaaggaccgaaataaactttaccatgccattataactttgtaaagtttgagatatgttatcggtatctcaatgacatgtaagacccacatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatataaatataagtaatgctagatgagtcaatgacatgtggatcaggatggcatataacaaattttgcaaaattataatggcatggttccaattttcccactaaaaattgtagcatgttgttgatgttacttggccaacttgggacttggcaaatacaaccttcatatgttacattttataacaatagtaaaatagaactcctgttgggttaaatagctactccatccatttcatattgtaagactttttagcattgcctatatttatatagatgttagtgaatctaaatacatatatatgtctaaatttattaacatctatatgaatataagtaatgctagaaactcttacatcatgaaacggaggaagtatattcttcgtatagtatgaaatatcttccgcctttccacatcacgcttacgctttctatccaaagaaaaaatatcctgatggagcgatctctccattacagtcaaacggacagaaatggccactccatccggtcatccgtattccccaaaacacccttaaaaagcgtccgctgctgccataaatatctaaggnnnnnnnnnnnnnnnnnnnnnnncaaccgcatccgccataaaagccgtcgggtttagcgataagggttttaacatttggctaaaaaattttcgagccaaaaactttaccaaaatcctccgaaattcctgcgtctttcagctcggatcaggcattcaggcccttctccccgccaggatcggtggtaagctagttcatccctcaatctctagaacgtccaactcttcaatttggtggtttctgccaattcgctgtggtctcatttcgctaattggacctctcgttcggtgaaaatcgcatcgattcctttctccaagttgagttctgatgtttctgttgcctttgagttcgtttatgacggtttggtttatggtaaaaattcaaggatggagatcatcaacgggccggttctcccgcgctatgctgctccggcgaccggcgccctgacctccgacgcgaagatcagcgggcagctgcttaggcgcgtgcacctgaggagacgagcctgtgggttgcagggagaccactaccgggcggcgcgcaggttcttcggtttcccgtccgagcggcatgcgcgaagcggctgggtctggcctgttttgtgcagttacggctcgtcttccgacggggaccgcgccgctgccccggataacgacgccagcggcgaggagttcgtcaactcaagcgtgatggaggcttgtaattgcttacttctggtacactgtaacttgtaacttcatttgggttttgatgcatagtcgttcgagcaatgtccgggtccggcccactgtttgttgggagttgggaagttcgctgtgagcctttgaaacagttgctgttgtttgatcagctacataccgtttatgccaagctactgttgcagtattagttacatatcactagtatatcatttatgccgattgccaaacaaccattgtacatttctgagattaaacttgtggttttatctgtccttgcagttgagctcagaagtgtatctgatggatttgtgattaaaatgcgtgatggcaaaaaccttagatgtgtccaaaacaacccgcgggtattaagattgcgggattctgcacctcaccatgctattgttctgaagatggaagatggaagtgatcttttgcttccaattatcgtcagtacgtattaattcttgcttgggcatgctttccacttatgcagatgcttttctaattgtgtgatatactcacattacttttttccagtggaaacaccaagtattatgttgctggctgcccttcggaacattcgaattgtaagagttggatgtagctttaataaatatatgttagatgttaagcatccacatgattctggttttaaattgttttcatgtactatatctgatttgcatgactattctgtctttccagccaaggccaactatttataatgtggtaaaggagatgaccgaaaggatgggatatgcggtgagtttaagatgagatcttataagcagactttcttttgcaactttcgtgtggcttcatggtttaggttttctgtttagtgtttcatgggtgtgcttatgtgtgttactattttagttttattacttaatgtatgctggttatcatgcactcggacaatacatacatcttttctaaagtgtcctagtggaaagctgttttccagagttcacggtctgcagatctgttctcttaaatgtcatataatatgttcatttatcagttacttgattacttcagatctgttccctttaggtacgtttggtgcggattacagaaatggtccatgatgcatactattctcgattgtatcttgctaaggtaaaatgacttcacatgaactactccctccatactcgtaaaggaagtcgttttggacagcaacacggtctccaaaacacaactttgacttcttgtttctataaaaatatttattgaaaagtgatatatgtatacttttatgaaagtatttttcaagacaaatctattcatataatttttacattttcaaactcaacaacttgagagttattcatgatttatattcctaaggtttgacttaaacattgttctaaacgattttctttacgagtacggagggagtatctattttacttttgtctgaagtatggtgtcatgatatccagattggcaatgaagaggagactattagcttagatctcaagccatcagatgccatcaacattgctttccggtgtaaggtgtgcattcatctcctgtgcagctgtgcttctgattaattgctgagtgctggccatatttcctttaaggctgctaatcccagaatattggaagtgctgtgacttagttgcatgttggggattataacatgcatctatctgtttgagcgctagccacaaaactgtaaaaccagcaaacaggattcccttgtcctgtcagaaaagtgatctattttttggtgctgttgcttaaccttgttatttgtggatgatatgatttgcatgcaatacttctagaggtactcctttttatttccttttaaatcatttgaggaaattttcgtaaccaatgatttgagtacagcagtcaaagaatgtggaaaaatcctgatcttcttggtgttttgctgctaaatggatgtttatgatactcattccaatttattctaactttacataggttcctatacaagtgaataggcgtatagcgtataacaatggattgaaagttgtacaaccaacaccatctgagagctatgtaagctcagaccaattccaatacacaagacttgacaggtttgtaacaaaagtagcttcataggtttcagtaaagaaaggtttattttaaagcactgctaatgcatcccgtaccatttgaaggcctgacgatcaaccttgctttgaggcccaagagtttgatttggtccgcaatatgctggtcgctgctgttgaggaacgctacaaagatgctggtaagctcttgttggcttaaaatgcatatagtaaaatagtcatacattgtgacagtgttgcattgcattattttgcctcctctggaacagataaattttatagtttttcttttgtggaaattgcaactaattcgtacaaaattcctgcgttcaaaatgggccctaaatgggaagtctttgtttttttttatccgcctcccgactcacaaatatatgcagcagattgttcatggcggctaatatctggtatcatctgtttcagctcaatacagagatcagcttttcatgttccgggcaaagaaaaagaacatgatttaacaggtaacagtcgcccatgccattcttgaaatcttcatatagtcaatttctttgtcaactttcacgtacactagctcgatcaaactgacaggatgacaattcacttttcttgatcagttcctgaagggaggtgtacatactagtcccgcctgaagtgcataaagccaaacatcaagaagaactttgtaaatacttacagaagaacctatacatagatacatatacatactagaacatgattttgggtgctttcaattcgtggtggcgttggtagtaaaat

SEQ ID NO: 69267 - DNA, 2791 bp, Oryza sativa
aacttattgtaagccatccttgaaattgttatccatattccttactgcctgagtctattatttataggatcgtaaagggccttttccaccccaaaagctagccattaaagtgaggggctcccccacttatatcttaagtcctttgcccttccacaaccaatgtgagactattcaacaatctcccccttcacacattggtgtccctcagcccttcaccgccccttcactgtattcgggccccaccgcccacggtccatcaggtatacgggccccgcaggcacccacggtactattcaacaatctcccccttcacacattggtgtccctcagcccttcaccgccccttcactgtattcgggccccaccgcccacggtccatcaggtatacgggccccgcaggcacccacggtacatcaggccttcacacgtgtccatcgggtcagagatgttaacctagcctggctctgataccaattgcaggatcgtaaagggcctttcccaccccaaaagctagccattgaggtgaggggctcccccacttatatcttaggtcctttgcccttccacaaccaatgtgggactattcaacattatctacgcgtagtcaattattgacactgcttagagatgaatttcttggaacattatgatctcagagtattcttcggaagggaacatttccaaggttactgaaatgtatcaaaggatgagaagagaggtgtctcctagctgccagaccttaaccacagcagttgctgcatttgccaagcgcaagtgtctccgagaaggtgagaaactgcattcttttgcatttaggagtggtgtcagcgatgcaattttggtggcatcctttgtgggttcttatgccaaatgcagcagattggcctcgtcagttcagttgtttgaagaattcagcgaaacagacagctgcatatggccagccttgaattgggggttcatttactgtggacagtttatagaagtaatcaatttgtttgggagaatgttgatttcttcatttgttcccagtgttaacatgctgcaaggattagtcatcagttacagagaacttggtgtgctacggctaggtaaagcaactcatgggtatatgataagaaacagttatgatgcacaatctgagaatagtgccttggagacatccatcgttaaactttatgctagctgtgggagcattaattcggcgcaaaggtgcttcgacagcatccatcagaaagatattgttgcatggagttcgatgattgaagcatacacgatccatggctatggtaaggaggctctggcattgttgcacaggatgctagatgaaggagtaaggccaaacggggagaccttcctgagcttgttgtcagcatgtagtcactccggtcttgttagtgaagctcatgaattgtgacaagaacgtttggcatcacacctgagcttggtcattacacctgcatgatatgagtgttaagccagatggaagaatttggggtgcgctccttgcttcttgcacaacacactcgaacagtaagcttgcttcttatgcggctcagaaacttatggaattggaaccaggtaatgttggctaccatgtggtgttcagcaatgcccgagctggtagtgatcgatgggatgaagttgaaagcattagaagctctatggtagagatggacctgcaaaagctgcctgcatggacctgtcacctgtgtttctaagaccgttagcccttgatttgtattttctatcacttcccaaaactcatgttgatttggtatctatggaagttgctgtgtattgagtatgttggattggccaagatgtctcactgtatcaactgttgatgtttcagtgtgagagtgaagtttctatagatgatcaggcaataaaaggtcctcgactcctcgttgaatgataaaacattccagccttcttggtaacttcagggatacatgtaataagaaaaccattgtaaaatttcagtatcgacagttaccagtgcagtcagcacactacctgttaacctgcttgggagcagtaacagaagccatctagcttgttgaagagctgaagctgtaagtccccgctaaccttccattgattctgcagatgcagcagcttgggtacttcacatttgcaaggcgcagatcgaaaatgaagagctgctgtgaagtggcaggagtgtggtcatggtgtcactctcacaagccaaggtggaggccgcaattacggggcgtcgcagaccaaggccactaggctggcatgatagcagagttgaacaagacctgtatgacaacggtaaaatttgtcgattaccagcccaccgtgccacatatttggagctcgtcatggaaaattttgtggcttataatttacattggttttagacttaaaaccatgtttaagcggcttcttaaccatattattttatggagcaaaggaagaaccattcaaacttctcaagattcagtcaaattctttgaatcgaactgattctgtcccaacagaagactaggaatagcaggtgcagatgatgacactgtatacgagtggcactaatttcatccgtagaagattctatcccaatggaagaccaggaatatcgcacaaattttgtgtgccagcccaagacttaattttttttaggtcagattttttgtagcacagcaaggaaaattttgtggattatgatttacactggtttaggacccaaaacttaagcaggtccttaactgcatcgttctacagggcaaaggaagaaccattccaagttttacagattctatcccaa

SEQ ID NO: 69268 - DNA, 1400 bp, Oryza sativa
ctgtgccaaacccttgccgctgagctgctcagcccgggtgcatgcaaggtgctcgacacggtgccgcaccgcacgtgcccagccaccatcaacccgaaccctgtcgcccgccgccttgccgtggtcgtcgcccggtgtgccactgccggccgcttaccagctgccgctcggtgagaacttggtcgtcctcccctctcctcatccctcgcgtgccgcgttcctatgttgtcgcagcccgcaagatcgtcggcgccgccgcactcggcatgctgccgcgcgcgcttttgtcgccggtggccgcgctcctccagtcacgccaagcgggggaaacgcttcccctagcaccgacgaagcctcccagagactcaaaacgcccagttgttgcctcggcccagaccaatttcgctagcgactcgagctccgccgccacaggcagctatggccaccgggaaccccgtgagcgccgctgtgtttagccaccttggaacccaccgtcgcactcctaggcaccccacaagccgccgccggcctcctttccgtcgagcaattgccgcttcactggtgcacccccataaacctgaagcctagccgccgcctagaccaccgcctcccatcgctccaggccacctcagccggtgtgctgccgtccataggtggccgtggtcccggctggccccctatcgtcgctcgccccggccgtgtcccggaccgggcagccgccgcgcaggccaaccctagtgccggcgccggcctgcgctcgggacagtgaagggaggaagaagagaagcagagaaagggaagagtgagagaccgacagtgagcccaacccgctagtttaaaatctgtgtcactgacgtgcaggccaccccttgattaaaatcagttctaaaaccttatttaaagttcatatgtgtgcccatggccatgaaatggtcagattgaccaggtcaaggttgactatggccccacctgtcattgactcactgtattcctttacaaaaataattgttttactaaagaaaaggttgtgggacctgactgttagtgacagaaggaatttttcctatacaaaataattccaaattttgattaaatggctgaataggaggttttgcaattaatttgatttaattcaaattggaatctttgaaaggccataactcactcgttttaaatcagatttcaacgagacttttaccaaaattcctctaaaatcaagacctatccaatggcactggttttgcattttttccccttttctaagattttgccctctgcgttgggctaggggagccggccattgacccatcattcgccgagcaaattacatttgtgaagaagaaatcacagcagttgacgagggagccttgactgagcaaggcaagtcactacactcccct

SEQ ID NO: 69269 - DNA, 9004 bp, Oryza sativa
atagctattgcctttttctgatctgaatattgatcccatgttcttcagttttgtcagatttcagaatttataagttccaagtggcatacaaatagaaaaatagacagttcaatataattcccgtagatttaaactcccaacaaatggaaatggaatccgtctgttaaaattctatgcatccaaatgggggcaggaaggaatcagaaatcagaaacaggctatggtaaaaaaattatccccagtcatcatcagtaaagtaaaatatgagaaacaaaccgatgtcctaccagatcaaagtgatgcttaaagccatgattaaagtagcttaaatgctcctttcctgacatagcagtgacttcaatgcataaagtgtaaagattggcgagctgtttcaatcatctacatgtccagcaaatataatgtaatcagctacttgttcttcaaataatatctagtctgatgcctgtctccacttgtagatgacattgcagtgacttcaacgcgtgaagtataaacattgctgacctgtttcaatcatctacatttccagcaaataatatcgcccacagtttgtcttacaaatactgtttgtcaaatagtgtatgatcccaaaagtaataccatccacggtttgtcttaaaaatcctgcagctcacaagctctgaaactggttaatagaaggcggaaacacaaacgggctcactagaaggcgctcaatggttcttttgcgcctgttctcattcttaatcccatctggagctgtagaaccatcaggatgtgaagaaacacgatgagcaacagagtgggtatttcagcatcactcctagtaagtagatttcggtgttacagtaaaatttatgtcggatacacttcagagttggtttttgtagccttctgttgacctgctatgatccacttttttcttacctgtctgcacaagattttgattactggaaatgctttggcgatattggttttcctctatttgataagagaccatgatcttgtgcctctagttggtcattctgactctaaagctatttcaccttttggaccaaacagaggattttattttatatttcccctgctattattttttaaaaaaacattaacaataatagtatcacatatattgtaatttaacatgattgaactattatcttgtatttgtgtttttttatgttcttcactaatgaattagttcacagtaccatcaacttttgtttttgtatgctaggactgaagctgatgtgtagctattgctagtgctttgtgttcttaactaaaagcaaacatcatcatcgttgctatctatataataaccagatagaataaatggctgagtccgtgctccttatcgcactcggcaaaatcacggctgcactgggtgcagatgttctgcagcaaattcggaacctcttgccaacagaagtgtcgctatttgggcagctcactgggcgcatgaaccggatcaaaaaagagttgtttgtgattcatgcattcctgtcacaggccgacttgcagggtgttcagaccagaacagttgaagcatgggtggatgctgttaggaaggttgccttggatgttgaagacgtaattgatgagtacgttcatctattaggccagcaaaagtgtggatggttcacttcagtcaaaggaaaatttggaagatctcaacacctttgtttgtggcttcaaattgttgaacggctgaaggagattgagagagacctttggcacatctcggagatgaaagacagatggattcataccagtactgagctattgggcagaggcaatttggatggtgactatcattgtgcccttccatattcacctcagtgtggttacttcattaattcagatgatatgattgggtttggtaactacaaaatgttgttgatcaattggttagcacaaaaagattcgagtacttcggtaatggttattttgggaatggggggaataggcaagaccacacttgcttcaaatgtttatgagactgaaaagagtaggtatgattgtagtgcctggatagctacatcccaggtatataacatttgctctttgttgagaacgacaatcagacattgtttcaagaacacaaaagaaatcccacctaatgttgacataatggatcaacacagcctcattgttgaacttcgagaattcttaaaaggacgaagctgcttggttgttattgatgatgtctgggatcatgtatgtattggtactattctcaaggcgttttctcacaatgagcacagaaacaaaattatcataaccactagggaaattcagatagcaaagtttgtggatcaaagctatatgattcaaatggaaaaattagaggagagtgaagcatgggaccttttctgcagaaaggctttcctaaatgagaaagaaaagtcatgtcctgaagagttagtcggtattgcaaaggatattatgaagtggtgttgtggtctacaattagccctagttactatgggtggactcctgtccctgagagaaaaaaacaatagcgaatggaaacgtgtctacaacaacttgctttgcagttttgacaatgatccaggccttaatcatttgaaacatgtgctcaaccttagctaccgttatctaccagaatatctcaaagattgctttctgttctgcagcatattcctagagaacagtatgatcaagcggaagcacctgataagactttggattgcagaaggctttgtggaggacagggcaggaactacgatggaagagctagcgcatgattacttatcagaactcattcgtcgaggaatgttgcaggtcatgaagaggaacgagaatggcagggtgaagcactgtcggatgcattgcatcgtacgagaggtcacaatctcgctatgcaaatcgaggggtttccacatgatatggggcaacaaagaatcaacatctgcatatgaggcacgtcgttttgctatacatggaattaatcagtccagttccgaaatcctaactgatctaccacatgtacgcacattcctttcgtttgatgtcacaatgtctgacaccttgctgtcaagaatagtatgcagctctagatatttgacagtgttagatgtatcaggggcattatttatcaaggaagttccgaaacaagttgtatctctcttcaacctgcgttacttaggcttacgtaggactaaggtgaagaagcttcctagttctttgggaaggcttgcaaatctacaaacactggatcttcatcacagttgcataagtagactgcccagtggaataaccaaactagaaaagcttcgacatttgtttgtcgagacagtgaaggactccagttttcaaagtctgaatgcttgtagcggtgttggtgctcctagcggtatatgcaagcttaagtctttgcagacattgttcacaatagaggcaagcaagtgttttgtgcaacaggcaaacaaactggttcagctaaaaagcttccggatcacaaaagttagaggatctcattgctcagtgctgtctgagtcaatcaaaagaatgaagcagttggtgtacttagatatcttagctagtgacgaggaggaaatacttgacctggacatcagtccaccgccaagcacccttgagaagctttgcctgaggggaaaactgaatgattctaatctgcactctttcttcaattccttttgcaacaatctcacatgtctttttcttggttggagtagtctaagcagagaccccctcccattgttgtcccagatgacaaatcttgcattcctctggctccaacgggcattcgatggcccgcagttgaggtttgttctgggatggttcccaagattgagaaggctgcatctgaaagacatggaccatcttcattctttggagattgaagaaggttcagtggtcagtttggaggtgctggagatgactggtcttaatgagttgaatgatattcccggaggtattttctttctgaacaatcttcaagaggtgtacctcgattcaatgcacaaggacttcattaaccaccagagcgagggtgaaaatgttgaagatttcccaagattcatctacggccacagccccaacttttggagaggggaagatgtggcatattgtcaccaatacacatagagttcttcatccaaatttccacaaactagttcagacaagaaacaaccggtgagtttttaccgcatgatgatgctattatttttcatattctaacaagggtaacacaatcgggttacaatgatacacagttccacaaacgtacctaaacaactgattcaatcagaacttcagaagaggtaaatggagaaaatatagcagatagaatagaatgagagaaagaaccagccatttccctctctctcagagtatgttagttatacacgacaaagaagctgttctatatacaccagtgcaatacttagaattcgtccagttggtttactcgttttaaatttcaagaacatcccctgaagctgagatatttatttcaatttttagaattattaaaccacttcaaacaattctaaaaaaaatcagttctaaaatggaggatttagaaactacacaagtttgctctgtagtgaaatgaaactaatttatccctcagatttttattttatttttcaaacacagtgtttactggccaatataattatatttcatttcaattgtacaaaatttgtataggttagaaatactacctagcgcaagtgataatttgtttcaacttgtttgaaatcatttattgattttatgaaatttggaaagtagtccagacttttattctggatacgtccaaggttgaaaggtttttttgacttccgtgaggtggaatttcaaggttatgacataattaattttcctatttttccaaatatattgactgtggttttgatgtgacctaagttacagaattttcctagaggcacaaacgagaaaaaaatagtctaaatctacactaattcagtccacacaatggtctaccagactacctttaacggtcaacactgcactacaccagtgacatttgacaatgatacagctagtgcacacagacagctattacaatcgaaccggtgatcgaactgttaggacacttgttcactggctcattggttaaaccgatcaaacaaccggtttaaagcagttcaaatagatgtgtgttacagtagactctgtggaaacaaggaggtttgggttcgactccttcagttcagcagctttttcctatattctctaactccacgtgacgcccatgcacactgcagcttctgctcctccagcggtcgaaccacctccggtccagttcaattggttttcaccagatcggccgatgctgttctaataactaagcacacagactgatgcttcctactttaacaattttatttttcatgtttgtattcttcaaaagttgatgtgaaatgccgtttctttttatgtgatagaagtgaaaacccttgtatataaaatctatttgatatagacaattgagattaaaggcctccataccctaaccccgatcgagggatagtttgagcaccagatagcagaaaggagatgaacctcctctcttcaatagaaatagcaatgctcccactaattctcgtggctttactacagacacctctggcaactgcatctgtgagaaggcaagggtcaatcacagcctcccgtccatggcgatgcttgtgccagctgccccaagagttgcgggaacctgagcatccactacccatttggcatcggagcaggctgttctggcagcccgacttatcttacctgcgaccactgctggagatgcatcggagaaagaggcattagtgttggttggtaaccctttttttagtcctgttgtgtaatcggtatttttagtcctaattatacaatgtagaattaaaaactatctttaataccggttggtgttattaaccggtactaaagataattttttattttttttactgatggttgtttgctgtacatatatgtatgtatgtatgtactccctttgtttcatattataagactttttctagcattgcatatatttatatgatgttaattattctagatatatataaatttattaacatatatataaatgtgaataatgttataaagtattatataatatgaaagtatgtatgtatgtagataggtacatacatatatctgcatccatgttcttcattctctccatgaccgggtggtgttcgtcgactcttcttatcttggtcaacgcctcgccaccggacgggccctcaccctccatgcgcccgtcgctggcggcgtcgctgctcccgccgccgtagcaggaaatccggcgacgtccagaggaggcgccacgattgacgctgctggtcggtcggctgtgtcacagcaagtgcagctagctagctagcgtccgatgattttcctttagagatcaacagaagacacagaggtatgtttgtggttgctctcatcatcgcccgtggcaaacatacgcgcgcgtctgaatacatgagaagctagcatatgcatgccatggcgatcgagctcgcgtcagattgcatcgaggaagaagaggaagccgcggcagcccacactgcctcgtcttctcacccgccactgcgccgcccctccacatgctgaccgccgccgcggccccagcagcgccggcgaggtcgtcgcagcgtcgtcaaaggtttggatatggccatgagcccatgagcttgtcttttttgcccggaatgaccgcaatgtaattaagataggtaatgtaattaagataggaagaaaaatgttataagaaaagttttacatcgataactggctatcgaggaaggatatgcaccagagcacacgccccgaaccatgtgtcaaccgcccaaacacacgctaccgagagggaaaccaatcaccgaatcggccatcgctatgcgagaccgaccgccaccaggccaacaacaccaccacgacacgaagactcaaaaacgacgccctcacgagggttgcgacgccgaaagataccgtcgtcatccgtccaaagaactggactaggttttcacccagagatccttgccaagagaggaggggtatctcaacaatgccctcagtagggttaccacgaccgaaggcgtagtcactgttggcccaaagaaattgggctaagctttcactcggaacccctaccgccgtggtctgttgcccaatccgaatccaccatctaaacatcggtggcacatggcttccgccacacccgaccgacacctctccgccggccaacttctagtcctgccaacaacaagactgccaccacaccacaccgacgccccgccgtcggccaacttcatcgaaccaccatccctgaaagctggcctacgacccctctgttccaccacctgccggcggcctcctcgccaaatatggccaaaggagaacacgggactaggtggcgttgcttcggcagcctgagcttcccccgctgataagctgccgcctcaatccagcctaaaaacttcccacaaagaaggggggaggagctctagggtgagggtgccgatcggcaacgaggaagacgacccaccgccaccagctccctttgcactaccatctaggcctgcaccgacatcggaaacgcggtcgctctggctccggcgccacccgccagcgccccctttgtccgacctccttgccccacctagcgcgccgcgccgcccacctggccgcacctccaggccagccgcacgccttgctcggccaagcctcatgcgcgtgcaagcctctgctgcggctgccaccgcggcctccgcgagcaccggcctccgctgtcaccaccaccgcagccagccgccaccgtgtcctccacgtgcgccggcctccttcgccggctgccgccagctgccagacgccgccacctccacctcccgtcgtcgccacccgagaacggcttactccggcgtggagtcgccagatccacccgcggagaggccggatctggccgcggcggcgccggatccgccacctccatgccacgtcttcaacctccgctccgcgcaccggcctgccttccacgcgcagagacagggcgccgttgaggtttggcctcgccaccgccatcctggctggccgctcggttcttcagcggcgcgctccggtggcagcgaggggagggagaggaggagagagtggcggtggcggcgctatgttttccccagagtcgcccgcgcgtgggcgacgtgggggcaacgcgtgggttcggacttctcagcgatgagcttgtctcagcgccatcgccattttttttcctctatatttttttcaagagctatttggattttcctttgctgcagtttggggagaagataacggaaagtgtgacggcgatgtatggttccaaattgaataataatgatattttttaatttgatatatttgcaatgatatatatatagatcaaattaacccaaagatatatgagggtgattacttctgcaagaagctaccgaggcagaaattagcaatgttggctgtaacaacatgaattttcaaatttaaaaatcggaataaaatttttaaataatcaaaaatcttttttcaaattacctccatgctagaatttcttttcctttttcctgctgtgctagtgccaaaatagaaaaatgggaatccaatttaatttctaaattcaattatggattcagagtaatatttaaaaaagaaccatgattgaaatatataaattaagaaaatatttgcaaataagagcagataataattattttcctaaacaccccttttatgaattaatatccctttaatggtttattttgcaaataaaacaaatattaaatatttgtgaagatcctttttaaagatattaattccataaggaatcactttacatgtaacctcggttaatacttatttatcaaaaccctacttgtaaactaaatctttcagttttctttatctcaaaaggttttacaatagaagtttaaatgag

SEQ ID NO: 69270 - DNA, 6117 bp, Oryza sativa
cgatctttagctgcgtcacgaaccctgtcgcgctaaaaaaccgcccgcttcacgtaccctgctgcgccaaaaaaccgcaccgtcttgatcttgatacacaactctcatcatatttcattcgtcactatgtccctaaaatcggccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttctttaatattcagagatacacggctgaacaaaatattcacagttttaaaattggacaaagagtccaacttacaagtattcagttgacagaagaacacgaaaccttcgaggagaaaagcaagcaagccactctggtacttagaagcagaacctctttttctgcatataatggatgaacacatatgaattggctagctcagtgttatgagatattctttacattttttttcctaatactatatgatgttgttgacttttagatatatggttgaccattcatcttattaagaaaactatgcaagtattatttattttgttatgatttatttttttattaaagatacttcaagcataacttatattttttatatttacactttttttaataaaacgaatggttaacgtatgttaaacattaatggcgtcatatatttaaaaacagagggagtacgatagaacagggatgtgtgcgaaccaaatcatgaagttccctttgactcaatctagtttaacttaaaaaaacacacacttagcaacaaagaataaattcatttttatataaactagcgggtcaataggtacttctgggtgaactcactcacatccataactaaagagtagttggcatcaagaacaagcatttctcaaaaggaaagagtaattcataggaaaaatccacaacttacccgaaattgaatattcttttgctggtcggcgtatgcaagcagttcgtccagcctcatcaatgcatcataaagcatctgctcatgggagaaacaaaggtcaatatggaaaatcgcaattttttgttcagttcttagttcttactatagcgaacaatcaagaaattcggtgaactgccaattcttgggtgtaatagtataacatatagaaacattacctcagaacagtagttatatccttgataccactaagcaataagctatctaacgagagtacatcttccttgtcacacatgcacacccacagagtgcatatgatatgtcaagactcaacagtaccttctttgtagatattagctcggcttccaatgcatcaacacggtgaatggctccattgagcaattcctctctatccggtggcatttgagattgctttgcttcaagctcctgtaatttctcctccaattcaccaagacgtctcaatacagacgaatgtgtactgttttctgtgaatccgggagaagatggaggtcaaaactcttccaaaaactcaatttcttgagggaactcagcactatagttaccacgggaaatggcctggcttgatagacttgcagtcactctgcttgggacagaacgaagcacggcaacaaagctcacgattaagactatcaaccacgcagtaattcgatttcgaagtcctcccagttccatcgttatgtttctcaacgagaacgaatctgtgtaaaacatgcaacaaactcagtcaaaatcactccaataaactcttggtgggcttaccggtcaccactcactacatactataatgtaatggcatgtttggtttgaggaatgagatgaccacttgatcttatacaggtcgcttggtttgaggaatggaatggatttgtccatcatctctaaaaagtacatactaaatgagaaactgagaaatggagtcattccactagatttgagagatggtcccatgatggatcacccattctagatagtttgattcctcaaaccaaacggccaacaaaattcccagtatctcacatttccctagttgcatatgggggtacgaatgtttgaaatcagcaagtagacaacttctcaataagaggtacaagtatgaaggtgtcatataaagacctgaattaaaagccattgagctggttgatggaccggcgcatgtgtccacagccttgtcaacaacagggatgtcctctactctgggaggggcaccagatgtggaagtatttcccggcaatttggactgcagaaatataaaaagatgcatttatgatcatatttaccaacataaagattgattaaggaggaagaaaattaagaatgccacatcattgtttagagcgagtactaatcagtaatctgagctcagccttgtgcagttgaaaagaccaatagaacgagtactaatcattaatatcagcctcgtgcagttgaaaaaaccaaaaggtacaagatcttgcctcgtcaacgggtgtcaaatgagggtttatgatggggttaactgaagctataggagatgaaacatcttccatttcagaactagactcagcagaggcatcgctgcattttttctgcgaggggatagaatcaagcttctaacggatagttgttattttaagatgatgtatgagtaatctccattcaaagcatgcttacagttaagtgtctagggttaatataacatattttcttcccatcaacgcttgatatagcaagaattttccgtccatagtttgcttcaccattaaggaccctctgaaaatcatagacacattattttagtgtacaggatttcttttcaaaaaaaaaaaggtgtacaggatgaataagaagaagggtagggttcaggaagagtggaagacctttattatgtcaggatccttccaaggacctttatctgattttatgcaacctccatgttcttcacacctgcatttgccacccagaaaatctggaagttcactgaaaacatgaattaaacaaaattattaggataggaaccaaactacagtatttgtgacagtagaaaagacctaacctctcatcaatagtttcaagtagcttattttggtatttgcttccaaggacctaggtgaaaaaagacagataaggctattatcacatactagaagtaaatattattctgaataacaattttcaatacttacatgaatcttcgaagcagtttgtggatcaagaaatgattttattgtaccccataacatcttgaagccttggccagcatttataatgtacaatcggtgcaaggtctgcacgagcactagaaaggtattagataagtcctttgttatgaccccagataaaaacaagttctatagaaatgtatatagtgacaaaaaacgaagtgaaagggcaatagtgaaaaataacattaaaacataatggaatcacctacctctggatagttgtcattgttgatcttctgaagtcgcatgattagctctcttgcatcttttgagaagttcttcaaacccttcacataaaaaacaagttaactactaatctacccagaaattttggcgatagcaagattggctataaaataacataccactccttgcacatccaagatagtactgcacgaatctatgtgcctttttgcagcaatggagcaagctggaaacctcatctgcaagcacttctcggactccttgacatgatactttacatatctgtcaatagttgtgacttgtactaatttgttgggatcaacttttccaattagttctatgtagacaggccttccctctttatccacaccatggtaaaattgtggatagcactccagaacatcatctaattcgctatagtcaaattcctaaatgatccagatgtcaaacttccagaagttacatgaagaaagactatcactacctacgtactggagcatatggtccagtctctgctttacctctatgttgtcagccccgaactccttcctccatctaagcatttccgaccacatatgttttgctttatcaatatcaaattttcgcgctttcaggaacctacatgtgtaacatgtcataggcacatgaagaaattttaaatcaaataagcaacgctgaattttctgcaggagtaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttatttccagcactgatagctcggttcttgaaggagactgccttggcctttttgtcaccttctgagttgtcctcatcggatttccactctttcttatcatcatcatgcacaatgccttcaaaacctgcacctgctatatagtttcaacgaaatgcccctcctcctaatcaggttgaaatggtaacaactacattgaaaataatcaatacgagagcagagtacataggagttgcaattaactgaaagcagcgcaattacacgcacgttaaaaaaattagggaggtgtgattataatctctacaggtgctaaactactactattaaaatttcaatcccactcgaacatgaactatttgtctatttccgagtgatttgccatgttctccacttgccccaatgaaccccctcacagaatcaatctctctgcaaccgcaattttccggtgttcgcgaatgacaagcaggtaagcattgcataaacgagaacgggcaacgcatggcggcatggagaaacaacgaatcatcagggaacacgcagtcgaaggaagaagggaaacagttcgcactcacagggccgatcgatggaccccgccatcttcgccttccccacccgcggtccgacctcgattcctcgcagggtaatcgagtccccgagcctcgccgctcgccgatgaaccagggtttccggcggaggaatgcgcggagacaggaggggcacgagaatggagagagatggctcgtttgaaattgattgtttttcttttgatttaggaggaatattttgatgcttttgttttgggggagaggggaagagaagcttctgttttcttttcatcggtggaggaaggggacagggcaagaggggagggggtgttacacgtatcctctcgtggaccgggtccataggctcgcaacaaccgcgacgctgcatcagcctgcacgtaggcgtgccacgtgggcggctcacatcggctctggtccgtcgacctggcgagcgcgtgccacgcgtcgcgcatgggcgcacggtacgcccgtaatatgaggagatcgagccggtgtagagcggctagagcccactatggtgaaccagctccgtttgatctgcagatgccgatgcttatgagccgttgatttctccttggaggttctgattggcctgatcgggacacgctcgcaggctcgcagcagtggacggcgctggtgatttttttttccctttttttgagattcgctggtggggtttcacgtctatggagtatggacaaggttcaccgaaatttattctggacgtgacggttcgaggcttttgggccgggctggaacttgagagtacagttgttggttcgggccgaaacttagttcggagcaaaacaggtattcaccgcaaactaaataggcatacaaattcaaatcagaagcacgaggattcgtgaaagcaatttgcttaacgttttgctaaaatcaatcgtgagtgacaaacatgggcaccttttgagtcaattttactaccaacgccaccacgaatgaaagcacccaaaatcatgttctagtatgtatatgtatctatgtataggttcttctgtaagtatttacaa

SEQ ID NO: 69271 - DNA, 1044 bp, Oryza sativa
cggtggagaccatcacgaagaccctcaatggccccagcgccacgccgtcccggacacggcgaacgcgagcgcggcgaccgcgaggagcacgctggggaggcggcgcgcgcgccgctacggtggcgacggcccggaccacgacgagcagcgtgacgacctggacgagctgcaggcgcgcctcagggcgcccacgacggcctctcgagctggtccatcagctcggccgcctcggcgtcgacgcccgccggcgccaggcgcctggctcgcgcgagcaggggcaccagcatggcgaggcgggcggcgttgtcgcgcatcctggcgtgggcgacgtcgagggcgaactgcacggtgtcgacgtcgcggaggagcgggaggaggttcggagcaccaacgggaccatgggatgcgcgttcgccattggggctgggtgggagggggcgatccggcgatgcagctgtgggttttgcggtttggagctaagaccaaaagggggttttggtcttggggtttttggcattttgcagtggaaagggagaaagaagatgaggcgagtccgcgagtggtgcagggatgtcagattgtcagagtactttgtgtgccaggcttaacttgcgtggaacgttagcttaaatcagcaagtgcttcgtttaagagctgagaatcacaactagctctaccgtcacatggtttcgattccgtttagtcatgccattttagagtggtgttaacataccctaaaatgtgtttagatgccaatttacttatccaataaagggtgtgtgtagttcacgttaaaattaaaagtttggatcaaattgaaacgatgtgacggaaaagttagaagtttgtgtgtgtaggaaagttttgatgtgatgaaaaagttaaaagtttgaagaaaaagtttggaactgaacaaggcctaaacacggcgaaagacaagtaattctttcaaaatttgttctcctttccctcgagtccaccggaggtccggactagtatactaaagagttcattcatccattgcaatggccaatggcaatatgg

SEQ ID NO: 69272 - DNA, 5777 bp, Oryza sativa
  unsure (1)..(5777): unsure at all n locations
tgttttggacacatctaaggtttttgccatcacgcattttaatcacaaatccatcagatacacttctgagctcaactgcaaggacagataaaaccacaagtttaatctcagaaatgtacaatggttgtttggcaatcggcataaatgatatactagtgatatgtaactaatactgcaacagtagcttggcataaacggtatgtagctgatcaaacaacagcaactgtttcaaaggctcacagcgaacttcccaactcccaacaaacagtgggccggacccggacattgctcgaacgactatgcatcaaaacccaatgaagttacaagttacagtgtaacagaagtaagcaattaccagcctccatcacgctggagttgacgaactcctcgccgctggcgtcgtaatccgcggcagcggcgccgtccccgtcggaagacgagccgtaactgcaacaaacaggccagacccagccgcttcgcgcatgccgctcggacgggaaaccgaagaacctgcgcgccgcccggtagtggtctccctgcaacccacaggctcgtctcctcaggtgcacgcgcctaagcagctgcccgctgatcttcgcgtcggaggtcagggcgccggtcgccggagcagcatagcgcgggagaaccggcccgttgatgatctccatccttgaatttttaccataaaccaaaccgtcataaacgaactcaaaggcaacagaaacatcagaactcaacttggagaaaggaatcgatgcgattttcaccgaacgagaggtccaattagcgaaatgagaccacagcgaattggcagaaaccaccaaattgaagagttgacgttctagagattgagggatgaactagcttaccaccgatcctggcggggagaagggcctgaatgcctgatccgagctgaaagacgcaggaatttcggaggattttggtaaagtttttggctcgaaaattttttagccaaatgttaaaacccttatcgctaaacccgacggcttttatggcggatgcggttgnnnnnnnnnnnnnnnnnnnnnnnccttagatatttatggcagcagcggacgctttttaagggtgttttggggaatacggatgaccggatggagtggccatttctgtccgtttgactgtaatggagagatcgctccatcaggatattttttctttggatagaaagcgtaagcgtgatgtggaaaggcggaagatatttcatactatacgaagaatatacttcctccgtttcatgatgtaagagtttctagcattacttatattcatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatgtgggtcttacatgtcattgagataccgataacatatctcaaactttacaaagttataatggcatggtaaagtttatttcggtccttgaatttggctcaaagttcatttttcaccctaggtgctaaaaaataattgattttatatatacgtggtgcaatcgatcgcccacccaccaaaaaaaaaagatggcatgtagatcatcacatgtaattgtgacaagtttgtggtgtttgagttcaacaaacaaaatttacttatattctagtatcaagatattttcagtgaaaagtactctctccatctcaatttgatcatcccctaaggtttctaagatcttcctaaaatgatcatcatttaactagtgtcttttcgtttatttatgaaatgagtaaatgtacatcattgcatgtgttgcatgtaactaaaattgattaatttctattagtgcaatatcataatatttaaaataagagcagttcacgggatacgaagcgatggaacaccttagcattaatttaagaatgatggatatgttggtgtccttggtcttggtacgctttgcttagaggatggtcaaactgggatggatggatggaaggagcattgaggacattaaaacaaatggatatatactatctatatagttactgaaaggtgaagatgtagcttagagggtgtagacccccgattttggaaatcggaaatcttctgtgtttatccgtaccaatctctggatcagtagttggtacacacatacatagttggatcacaacatatcacgaatgaattcaggctaaaagagttaaatacttacattagggccaggtaggccaacaactatcagagaacatcagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaacagcaagggtgagtaccaaccatactcagcaagccaccacagcaacgatgcatatgatagagggtatttcaaggaatggcttcaggttcctttgcgcaaagcaagttttacaaatcttttcacaagcctaaggcctagcatagactgatcaagttttaataccagtgttcacattaaacaacgatgggtctgtccaccatccattgtaatcccaaggatagcttcccgccattgagtcgtcatggttttctgaggacgtccaccttccctcctctcaggaagtggctccatcagcataaaattcatcatgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgacggggggtcgttcatacttaacttcatggctcggtccttaattgaccagggacggcactagccttttccggacaccacccaatccttcagcggcccagtcgaaaacagttgtttcactttattttcgtttcacaaatcatgtcatcaatatcatggaaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatccatgctctatatgttaaattcgggaggtttataatattatagttacagattatctcttaatgaacaatccggagttacaattgaactatgaacatatgaggtcaagatttataattagtacttatctactatgcatgtttgttatatactccccagtttaatatatgaaaaagataaattaattgtataactataatgggatgtccaatatatgtgtgcaacaacgtataatgttttggtcgcctactgtacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattcctccacatttagctctattattattctcctaaacagattcatctatgtgtgtttatattttagttacataatcataaggctacacttgatttaaataacctataagccatggatttaattatatggccatcgaatattaaataagtactagtattttccaatacatccattcatttgagacatcacataaaattagtttgtgtggttgttacagtggcaagacatgttagagacaaatattattacatctactctaccgtacaatactaattttatttattaacatatttttaagttgactattatgcatcatcttgatattaattatttaatatttataaatatattttatcaaatagtgaattatatatcattggaaagcttatgaatttagatgaatttaggttcaagtttcactcaaatcggagctaaaatgaataagttatgctagtgtaaagattcaaatttgaataaatccgagaaattgtaaaaaggcactgttcctaattcatttatttataatacaaccttatccacaagctatagtgactgacagggggggtcttcctattttctttttcttttcttttagtggtcttcctaaaggaatttataggagcaaatgacaggtggggcccactctaccctgtcttctcttttctccctctacctttgtctgtcttctcctctctctctcacggccgagcggcgcgtcgcggctaccggcaacgaagggagggggcggaaggcttaccgacggcggcggcggcgacggtggcggcggcggcggcgacgcacggcgcggcacacggcgcggcgcggcggtactgagggcggcggcgcggtggagaggaaagaggggaggaagaggggaatggggaaatggtgtggggtggaaaggg

SEQ ID NO: 69273 - DNA, 11812 bp, Oryza sativa
  unsure (1)..(11812): unsure at all n locations
tccgccgggccgctgccggtgtctccgtcctcgacctcgcccgcacgaagtcgccctctccttctcccacgtggccgccgccgccgatgccgacgccctcccttctacccgtcaccgcccccgtcgctgccgccgccacggggccgccctcctctctcgcctcgcgcccaacggccggcctagtcagaggcagagaagcgtgagaaagaggaggggagagagagagagaagggggaagagagaggaggctgatgtggattgtttgaaatgtggggcccacgtgggtcccacgctgactcagccgccacgtcggacaaaaccaccgagggacctaatgcgaacggttttgttagttgagggaggccagttatctggttttgcgattgggggacgattttgtatctcgatgacaagttgagggaccttggttgtactttttcctttttaaaatcggtcatgcctacataatccgattggaaagcaacggaagggatggtttatgggccttttttgggcagcaaaaggcgcatgtatatgggctgccagtccacacaatcgaagtgtcttactgggcctaatgcttatggcctcaaaacataagaaaatatcagaataagtccacctttaaaagtgacccgaatctaattcataaccctaaactgcaaaatctaattcataaccctaaactgtaaaaccggatgtcttgaccacccaaactgttgaaaccggtgcaatttgactcctttggtggttttggagggcggtttagctgacgtgacgcttatgtggtggtgttgatctagtcttcggggttgacgtggcgcttaggtggcatttgagttaaaaacgtatacgtgggacccgtttgtcattcacacacataaaaaattgtggggcccacagacatgtgggccccacatgtcatacttcttctccctgccactgacatgcggcgctgatggcattgaaaccaccggggcgtggcacgggacggaacacctgcccgccgcttccgcagctgccatggctgagctcgctacggttcaatcccgttgggctctcgggccgggggctcacgtacttgcacggttggttgatctcgccgccgtcgacgccggcgccgacctccatggtggtggcggtggcgagcttccgcttgagggaggagttctagtgattcttgacggtgttgttggtgcggccggggaggagccacgtgatggtggcccaccagttgccgaggcggtcaccgtccaattcctcgtcgtccaatccctcgccccatgccactccactagccgccacagcgcctcatcctcctcgggacttcatggcccctttatcctatcacactctccttccacccccatatccaaatgatttcctcctcctccttcctcgagctgctctaatggcggcgtgggtgattagcgatgtggatgtctcatactcgccatcaccactttagctcccgccgccgctgccgcttcaactcctgcccgtgctccctggctccccgcagccggccgaaggactgagaaagagaaagaaagagagaagggaggaagaggggatggaaggcccgcgcgacgagctattagctcagtggtagaagcggtggctctcccttgggaattcaaatttntggccngcgttcngngtntggngtnaccnnccantngnggnnnctgtgnanngggcttctcnnagccacatggatagttcaatgtgctcatcagcgcctgacacgaagatgtggatcatccaaggcacattagcatggcgtactcctcctgtttgaatcggagtttgaaaccaaacaaacttctcctcaggaggatagatggggcaattcaggtgagatcccatgtagatctaactttctattcactcgtgggttccgggcggtccgggggcactacggctcctctcttctcaagaatccatacatcccttatcagtgtatggagagctatctctcgagcacagattgagggttcgtccctcgatgggaaaatagagcacccaacaacgcatcttcacagaccaagaactacgagatcatgttggggaagaagaaagagatgatgacatgtggggccacatgtcagtgtgtcccacaattttttaatgtgtgtgaatgacacggatcccacgtatatgtttttaattcaaataccacctaagcgccacgttaactaaacatactaggtcaacaccgccatgtcagcgccacgtcagcgaaaccgccctccaaaaccacgaagggagtcaaactgcaccggtttcaatagttcggcgtcgaaatatctggttttgcggtttagggtcatggattagattcgggtcacttttaagggagtccaagtggacttattccgaaaatatctggtcatttagcccataaaaaacaggtccataagattctctcctaagctaagccacttatacttgagcacgtatcgtaaggaaaatccaccggtcgtcgcaagcccgcatcaacgagcaggagggatataaaaccctccgccccctcctcccccaaacccttccgccgccgccgtcgccgtcgcctgctccagcgcgctcgccgccggccgccctactcccgctccaggcccgtcaccgccgtcgccgatccaacatggggtaatggatcctctatactctgcatctaatcgccgtcgctctatcccttgcgatttctagcgttcgtcagctctgtaggaatagtgttttggggtattcaggtctacaagcgcgaagttaggagtcccatccaatttgtccaaccagaacggatttttccttctgttttatactatttcgttcatctaacgatgcgctgttgtgattttacttgtctgattccattccagagactttgtttgatgtagtttcaaataatttagtggcatattgagagatatacgtgtccatgagctataagatgcctcttgtggctggagctgatttagttgctgttcgaaattatgaattaccctccaggtctccctagtcattagcaatctatacatttttacgttttgctacggcagtgtacactatatgctgaaatatggatcataatctcatgggtgtagtaactctttctgatgaaatgctctcaattcactggcttaagcaatcagcatagcattcacccctaattcaatatttccatggctagactccactggagtgtaaatatagcaggcttgttaacattttctgtctgctggattgtgctctactgatttaagtagtagtcaccacaaccatatctagttgcatacatctgtttgctatgctattgccttgtaggagtattgcatagtggatgcatattagacgcatagtgtttcccttgggaaatgttttccaattggaggcgactataagaggtggtgggacatttgcgtttgcccttagcctgatcgaacttaaattgcactgtcgaatctcttttgctgctttccctttagcaaattggttgttcatgagtgatgcttgcagtaaactggttgttgagtcctcaaaattcgtctcatacttttgggtagttgaatcttcttcaatggagtgatctgtcagacagagttgtacctatgtacttttagaacaaaagcaattacactcatcttaatataccactgtgctaatatttctagttcctttgatgctcatgttgaaactgtttgacgtatagctttagaactttattgatgcacttggtgtttacatatatttcttggatgcaattgcagtaagacacgtggtatgggagctgggcgcaagctcaagacccacaggagaaaccagaggtgggccgacaaagcatacaagaagagccatcttggcaatgaatggaagaaaccctttgctggttcatctcatgcaaagggcattgtccttgaaaagatgtaagtgcaataaacgtagagcaattatttgctctgaagaacattcaataaccaacatgcattactttatctgcagtggcattgaagctaagcagccaaactctgctatccgtaagtgtgctcgtgttcagttggtgaagaatgggaagaagatagctgcctttgtgccgaacgatggttgcttgaacttcatcgaggaaaatgtatgttcaactgctgccatacagagctttcttgttgcttatcatgttcttaccattttccgttcgggatatgcaggacgaggtgctcatcgctgggtttggtcgtaagggacatgctgtgggagacattcccggtgtccgtttcaaggtggtgaaggtctccggcgtctctctcctcgccctcttcaaggagaagaaggagaagccaagatcttaaatcctattcccctccattgcaagcagctggagcggcatggcggctataagaagtacaattagctacattcagctaatgaattctggggccttccttttctgcttctggcagctaatctctctctgaaattcagactcgatgttgtggtgaacatgtcaatcgtatttttaccccccctaatcacctgaattcaaattccatatagaagtagcagcggatttggtttccttcagcgcgattttaaaattcaaacctggaatgtcgtggagtgaagtagtgtcatcatatgcttgtgaatctctgcaagttgcaagcagcctattttgttgttttcttgtggcgcggtttgaatcttgaatgaagtcatcattttgaaatctctccctctatgctgaaacggaacggatctgatctgatccacgtgcgggttcatctgagccgttggcggcgagatcggacggcccaagaaaggcctcgcggccgcaacgaaccggataaacccgggcctccgtccccattggacccggttgaaaaccccacgggccatcccgatctgtgccaggtcagcagcctatccgggcccacacgcataggacatagctccccctacccatcaactcacaccaatacttttacccaaccccacccacttccacgtgggtcccatgactcgcctcaggttgtgggcccaccatgtcagcctcatttcacctgccgggtagagccgcgagtcgggaccaaacaaaaccgggccccttttacatcggcccggtgtaataaagaagcgaaggaagcagccggaatccagttttctgtgtccggctcggctcgtcggcgacgcctcgcaccgtcgccgctcaccggcgctcctccgccgccgctcgccgccggaggagggatagagtgctcgtcggtgcggtttgatggaaatggcccccgcggcgcaggtggcgtcgaacccgcggacggtggaggacatcttcaaggattactcggcgcggcgcggcgcgctcgtccgcgcgctcacctcaggtaaggtctccccgcgtccgcgtccgcgtccgcctccgcctcctccagttcgtgcggcactgactccctgcgcagatctaacgctaggcttcgcgtctgtctgtctctcgtgtgctgccgtgcagatgtggacgagttcttcgggctctgcgacccaggtgagttgagtgagggggtggattcgatttccgctcgcggcgaggtgttcgtccgggtgcgtgtgggcggcggtggatccgggtggtggtggtggtgggggactgagcggatcggatttgccttttgtagataaggagaatttgtgcctgtacggcctcgccaacgggagctgggaggtggcgctgccggcggaggaggtgccgccggagctgcccgagccggcgctcggcatcaacttcgcccgcgacgggatgaaccgccgggactggctctccctcgtcgccgtccactccgactcgtggctcgtctccgtcgccttcttcttcgccgcgcggctcaacggaaacgaacggtactactcgctcgcatccgcaattccgcataccttccccgaattcaatttcttggctggaaaaaaaagaaagtcagtaaaattttcagtgtctctttcctgacagaaagatttgtgcagttcaaagctgcctttcggtacagtagtttgcttgattgttaggtgaaggaggattcgcgtgatcgatttcatggtctaatttttgtttcagttggcgcatgtgtctgcatgtgcacatgtatcccgtgctcttctttttgtttcctttctttgctttgagtgaattggagtcatgcgttctggatgtgctggctgtagtgtactggccgttctatgtgagttttacatccttacccttctttcatgatagaattatcaattcatactctagggttcatattgattcatggtagctgctcgtaagaatttagtgcctatcctatcccattttagtttttgaattgaaaaacttttccagaacttgatttaatgagtcgcagagtctagcaaatgcaggctttaaagattgaagtagcacctacaagactcttatattaaatgaagggccattcatttctgcatttttctggcatgtcaactgcgccacaacttactccatttcattgtggttggagaaggtgtacatttactagtactagttgatataggagtaatgtgtatacggagcaaatatgacaatacgtgtatatgcctacatagtactattcccgtcttaaaataagttcacttttatacataaatctagacacttattttgggacagaggtagcaagccattacttgattccttggtcaagtgctatgcaagtaggtctctattattctccttttagagcttttggcattttagctggcatgatatatcatatatgaccaaattattctaagattttcgtagcatttgttaccagaaattttagattagtagtggagtttagcacacaatgcatgccagaaaaatatgctttccatctacttatgtacttcatgatgtatctgtgctgaagttaaattttctttactaaggtgaataaatcaatgaggtcatgacaaaaggagtacttgatgctcgcatcgatgttaagcatcaaaatgccccttatttcagctttcttgttcatcccatcgttgttcatttgtctagagacagttgtagctaattgcgggtatgggatgttatatctagaacttaggagcacataatgacattttctgctagacataatcctaccacttttattccaatatagtctactgctggtatgtcgacaatgcaatcaaagggattaggcaacatatttaggctttacttattgttcaactctgcgcatatagtttgtggcagaggtgttctgttgataaaagcgataacttgtttcttcttagtttaagaagtctgcgtatgctatgtcctggtatgctattagggtcgtaatccagaatctcgtgttttccacatcaatgtatttctctgtactagtttagttttatgttattcatttttttcttcttatttttcaggattagatgtgtattttaactgaagaaatgatgtatagtatttctgtttatgctactgagctactctattatactacatgttagtcacttagtctcgtctttggcatgctatccatgatggtgtgttactattctcatgtacatgtatctgccccatcaccttaaaattcaatgtttgccaaaaaaaaaaaagttccgcaatgcttacgagtagtttctttgctgctgactgtatgttgactttaggctgttactgaatactctcccgggctaataatattagtcattttgaacaagggtaaagtcaaactttaaaatctttgactatctaaaatatttatcttaaaaatatggaaacatatgtgtagattagtcttaaaaaatacttcaataaaattatatatttgttgatatttctatatatattataatagaaaatagttgctaaagttactttttggagaccatgcgcttggagggagttacaatattgctccttttgtttctcaggaagcggctcttcaacatgatcaatgatctacctactgtatatgaagcattggttgacaggaagcacgtcagggataggtctggtgtcgatagcagcggaaaatccaaacattcaacaaaggttagtatttccctcccccaaaattcagaaacttcaaatgcagttacttcagattttgtaacctaagctacaatacacagagaacaggcgaagggcaggtaaagcgctccagggttgtcgcagaggagtacgaggacgacgacgaagaacacaacgagacattctgcggaacttgcggtggcctctacaacgcgaacgagttctggatcgggtgcgacatctgtgagcggtggttccacggcaaatgcgtcaggataaccccggctaaggcggagcacatcaagcactacaagtgccctgactgcagcagcagctcctccaagaaaaccaggctataggttaaattgtggtgtgtgcaatctcctctgaccaatctgatcaaacgacaatctgtcctgccactaggaaaaaaaagatggtgaagctgttcttcggtccaatgtcgtagcttagctagatgtgaagtcatctagacattgtgctgtgtggtagatgaggcaaaaaagagtgaactgaaaagacgggaaaaacgtattcgatctttagctttgttttataaatgttttcttcattgtcaccgatgtgctttgggttttttcagacttcagagcatgggtatcgttgttgaattgtagctgcatgcattgcatgatatatttgtcaagtgctcaacaactggagcattcccaatcatagcgtctctgcacatttccattattcataaacacagagtgcttgctgaaaatggcataataacacattaacacacgagtaatctactcaggcagaaggattaatgcatagaaggatcaagagatgaagcctctgctcttgaggctttccactgaatccctgatgatcttctccatgggactgaactgcaaacccagcgcgatcagcttcttcgacgcagcctctgctctcaccagcccaggctgcgtttccttgggtaatctgccacacaaaaaccaaaaataatttatcagttagtgatatttgcaattgcagctgcatcattcacagtttgatatagtcatggaagcatttggagatttatgtggtacgtctaaggtttttgccgggaaggccgaaggaggccatccgaatgtattaagaaggtacgtctaaggtttggcgtggcaacctttggctgcgaaccaaacaggccctacagtccactaaactcactttggcactttgtactcggggtagagctcggcgactttggaagcgaaatcgctccagtgagcaatggactgcacgcagaggtgcctcccggatgcagatgggttctcgtacagcagaatatgggcaagagcaacgtcttccacatggactggccccatgtaaaaatccgcatactcctctgtgcaacctgcattgtcacaatggtgagcatgtttaggtgtttccttgcagtagcaatcacagctggaagaggcaaccattcaatcaagaatttctaggcacacaaaattgccattctatccctcacactgaatcaaacaagagaagtttttgagtagcacatgcatggtcatttaggaatcaacggttctcttttatgccaactgaactgaagaagcctatttttcatgtcattacatcaagtgttgagggatagcaaaacatgcggtttcactctctggtgatactaatcactgtgacatattcagtgcagcactatcagcttcctagtattctcagtatttgtggtaattttttttttggaacaagtatttgtggtaatttacctagagcaatcaatcttaacatacttgatactttctgagggttataagttcctagtttgtgcaagcacatgaatcagtttccctcttccacacattaatcacattgattggaaacaatatcacttgtcctagaatagtactattcagacttaactatggttaagatcagctacatgattgatccaaaatgcataccttcgagtaggcgaacaagcatggccatgctagcattgatcgtcggtgggattaccaggcccatgacagttcctgggttaaccacaaccacatccaatccattctcctctgcaaacttccatgctgccttctctgccaatgtttttgaagcagggtaccaaacctatgcacaaccaaccaaagcgtgcctcagataccagcgaaaaggttcatataattgcagcgatgtgtgggctgcatgatgtaaattctgcagtccttttccatgttatcattgactgaattttgttcccattgggtctaggagaatcaaatgcagaaagcaacatgtaaaagaaattattgatatcattttcatctcaccaaacagcactggcatgcatggagagtgcagccttttcttgtcttgctagaaacttatttcccccctctaaactgataataataatagagtaaatttcagaaaactacaactattttgtcaaaagtatcaatttgctacaattttaattttagctaagcatttcagagaactgcaacaatagtgtccgattttatcatagaactataactttatttgctcgacaattttagacccgcatgccatacacacacgaggggataaagttgtagcattatgctaaaaatgtttgctattattgcagttttgtgaaacacgttgctaaagtcccagcaaaatgatagttttaaccaaacagttgcagttttgtgaaatttactcgttataatatcatcatcaatttgcacttcgcacactgtcaaataattccaatgagaatggaagaaaaatggagatgccaagacacaagactgctcaccccgttcttctcgcagtagtcaaggtcagtccagcagcgctcgtcgcgcacctcgccggccggccagccggggctgggcacgatggcggagatggacgaggtcaccaccacccgccgcactccgccggcgtccttggccgcgcgcagcacgttcagcgtcccctccaccgccggcaccatcagctgcgcctgcaaacaacgggaacacggccggaggcggtgagcctggagcccgccgacgccgacgccgacgaggccggtacggacgtcgagaggagaagagtcgccggccggtgtacctgggggtcgaggacgcggtccacgatgcagggggaggcgaggtggaagacgccggagcagccccgcgcggcggcgaggagggcggcgccgtcgaggaggtcgcccgggaacacgcggaggcggcggccctcgccgccgccggcggcggcgagcgcgtggaggtggtccgtctcggccttgtcatctgcacagcacaacaccattgtcttcatcacctcctccgccttgcaagcaaacaagcagcagtaatggcggtttcgcactgaccggggttgaggacggcggcgtggacggagtagccgcgggcgaggaggcggcgaacgagacacgagccgatgaagccgctcgcgccggtgaccagcaccgtctccccctcccctcctccgccgccgccgctcgccattgtcgccgacgagagagactcgagctctcgtgtgagagagctgtggcttgtgagcctggagcttttattgtcgatgtggctggtacctactagtagcactgtagcacagtacagtacaaagcttgactgacagaagcagaagcagatgcagaagcagccaactttttggatctttcacagcctcacaagtgacagtcacacggatgatttgtcatgattcatctcgaattggggatctcccaaatctggattgattgagctg

SEQ ID NO: 69274 - DNA, 1406 bp, Oryza sativa
accccccctcggggaaatcaggaggagggcggacacctcaccctcgggcccgacgtccccgaaggtgccaggccacgtgggcgattgtgtctgcctcaagcctctggtcacgatactcccggtcccatatcaccgacagggctcgtaagtcgtaatgcctacctttgtcagccctgctcagcccctgcacctaattacgatcggcccatatatgttgggtcagaacgggagcgtggtgtatgttaggcttatttatactcggaataggttcactttagatttctcatttgacatggagtttccgtttctaaattgaaatactagatataacctattccttaactaacaaaaccggattactgaaggtcccatgaaagcagtattccttattttgtctaacgtggcgagttgatcgtagtcaacaacgctaagtcgacgtgggacctacatggaactcgcgtgttatggcccttatctccccccctccgctctgttcccatctcaccagggcggtaggcggtgaggaggatggcggcgagcggtgagaaggtcggtggctggcggctggcggtgaggacaacggccggcgggaagaagctagctcagccatttcatcccccaacccgcgccaaagccagtgctgactcgacggccggatccactcggctgcaagctgctgctgcttcgggctctaggaacggctgctggtgcagggttagtcacacaacgtccgtcacgagcaggtacgacacgcgacgatgagatcgctgtggaggaactagctcgacggcgagaccattttactccctcacgacaacggctcgccctttttacccatcatttccttctcattggcatcaggtggggattagggagcagctcggcgtcggcaacgaattcctatgatgccaccaccccctcaagctcggctgcaaccggcaatatccttccagagaaatactctacccctcaccgcctgttcgcatcagcgcctcctcctcgcgccccttgccacccaaacgcctccctccttgctgatgcgctctactcggtgggccgtcggttgagcttggcccagcacttgagtgggaggataatgcgttggggtcgacttcgatatccctcgttggcaccctccacctcctgttgtcgtcccctgaccgcctcttgcatctacgcctctaggtgttgggcaacgctgtgctcgctgggaagcaccatcgcaccgttgtctaggaagcgtagggccacagcggagaggaaggagacacgaggaagcggtcgtcgcgagagcgtgctgctacgggcggagcacgacgcagaggaaggccgtggaaagcggctgcatggcgccacacgagctgaaaattttacattttggtcctttttgaaaacttattttacaa

SEQ ID NO: 69275 - DNA, 719 bp, Oryza sativa
  unsure (1)..(719): unsure at all n locations
atgatgaatttgaacttgcaacngttgattggcacatttcgttcatcacaaaaaaggaaggagaggaggggagtttgagataaggaaagagataagatgtttgagaggaaaaaaagagatagagggaggagtttgttgtgtggacgggaaaagaggatcggtactatggattatatagtgtgttttgatttttattcccggttagtaacaccaacctggcgtaaaaagacgttcacaatatcgcttggtttgacccatgactactagggggcaccaatataccgactgaccctggactgtgtagtttcaagtgttatgtaatcacctctggatgagagcactagttaactatttaaggtaacacctctcttgttatcttgactacatcttaactgaaaataggaagaaatctcttcttttaatcaagggtgtaaaacattatccgaccacatgatgagatatgcttctacatatatatgttagcacttctacacctaagagtgacccttattgattggcatgaacctttacccgattctttaaagaaagacattgccaccctaaataggactactgacatttaattgcctgcttttttgcacccttcctcacttttacatagctcaccatccgaaataaattcagaattttgcctaggcataaagcgatatttcctttttttttttaacaagagtctctctttattttaataaaatgtt

SEQ ID NO: 69276 - DNA, 4890 bp, Oryza sativa
tgccatggccgggggggggcttccctcttccgcgccagtggcccctctgatgcctcgttgtgagctagcctatggggcccaacctcttttgtcgccgcctcgtgccatgccgccgctgccaccctttcccttcccctcctccgcctcccccacctcgccggcgatgacgaccatctcctctttgccggtgccgatgcccatctcctctgcgctgccgccgacgccctcctccacggcgccgtcagttgctgccgcccgcgccctttgctgcgccctgggcctccccgccgcggcgccgctgtccccaccgctccgtccggtgtcatgtgaatactaggatggcatgtgggtcccacatggacccatcatttttttttattttctagtgtaactggtacatgggccccactatttttattttttttcgacttgaattaccacgtaagcgtcacgtcaatacccatggaataaaggcctagtcaaagaagccacgtagacgccacgtcacccaaatccaaagacaataccaccgaaggacctagtttgcactggttttgtaagttgggggataagttgtatccggttttgtagttcaaggatgattttgtaattgggtgacaagatgagtgaccttcgatgtatttttccataattaaatacttaagggtgagtttgaggagaaggagatacgcaaaacgaggtgagcaattagtgcatgattaattgagcattaactattttaaatttcaaaaatagattaatatgattttttaaatcaacttttcctatagaaaatttttgaaaaaaacaccgtttagtagtttgggaagcgtgcgcgcggaaaacgaggtgttttctcaccagccttagtatgtactgtattggaccaataatattttttctaggtcagccactgcatgcgggcttgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaataaagtgtcaaccagcccccaatcgctctgggatcggatctggagaaggccttgtgtccaaaagtccccccctatctaagtgggcaaggtcctccttttatatctcaaggggataccacatgcccctctccctctccaaactggactgttcttctcttcataaatggacggagatcggtacggttgctctccgggtgcccttctgacgggacggcccatatctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcacgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcacatcggtaatggtgacttggctgtccataatgggcggtctcttcgagactgccacattacttgagcggcgtacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccaggcacagcgatggcaagggtataaagacaccgaggaaaggatttgctcccttcctttcgccattattccccttgccttcgctgcttgagccctaactctttctctgctgcgcctttccttcgccacacgcgctcgttctcaatcatcccttcctccggcgccatggcacggggttccgctctgctcgacggaagcgtacttccgccttctcgcatcgtgagcgagaggcatgccgggctgccgcgccgctttatgccggaatctgccaccggccgggagatagtgatgctgggcgagggacgcccggcaccagactacccggggcggtccgtcttcttcctccccttcgcaatggcagggctggttccgccattttcttctttctttatggatgttctggatttctacgatctccagatggcgcacctcacccccaatgcagtgatgacattggccatcttcgcgcacctatgcgagatgttcattggggtgcgcccatctcttcggctgttccggtggttcttcaccgtgcagtcggtgtcgccgccgtcggtggttggtggctgctacttccagccgcgggggccggtgttgaaccgctacatcccctgcgccctccgcaagaagtgggacgactggaagagcgactggttctacacccccctcgccaacgaagcgcgcctccgacttccaagtcagcccccggcgcaggtctccagctggcgggcaccggtagatctgggggatgactatgacgccgtcctcgaccgcctggcgggcctgcgatcccaggggctcacaggggccatggtgtacggcgactacctccgtcgccggattgcgccgctccaacggcgcgcccggggcgcctgggagtacaccgggtccgaagactacatgcggacccaccagggagtcagatgggattgggctcccgaggacttcaagatcgtggtccaacgggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttctgggccccgcgccgggggctcggggagcagccgccctgccgacgcccaggggaagaggaagctgggaggaacacctcccccatctcctccccgagggggcggggcggtgcgtgccagcagtcggcacccggagggggccgcgccgacatcgcagcccgagggggagcgcaagaagaagcggctccgcaagatgggggagacggaaccatcccggggaaacctgatttcccctccaaggtggtcatttaaccgaccccctcgcaggttcgtcccactctcattgcgaccgtctttcttttatcccaaaagcaagttttctcttacccatcttgttcgtcttctggttttttcttttgcttcaacgatgtcccgtcacgttcctcccgccatcccaagtccggccagtccgaggccgaagatccggcggccgcagaggaacggaggcgagaatctgaccggcgagaggccgcagatcgccttcgggaagctgaagaggccgcccgggaggccgctcgggctcgccatgcagaggataccgctcgggaagaggccgcccgggctcgccaagccgaagaggctgctaaggaggaggccgcccgggctcgtcaggctgaggcgatggcgtcttccgaggcagctcacgacaaagctgcgggcgcgtcgcttgggcccactccctcgggcgacgctcaggcgacagcctccagggcggctcgcgacgaggccgcgggcggatcgcctgggatcggatctggagaaggccttgtgtccaaaagtccccccctatctaagtgggcaaggtcctccttttatatctcaagggcataccacatgcccctttctcagaagggcacccggagagcaaccgtaccgatctccgtccatttatgaagagaagaacagtccagtttggagagggaggctggcgatctttccacataccgagagagcttgagatttcaccctaagcccccggccgaaccggcaaaggggggcctgtgcggtctcccggtgaggagccacgagctccgtcatctggcgcgccaggtagggggaaacgcgagacacgggcgatgtatacaggttcgggccgctgggaagcgtaataccctactcctgtgttttggtggatttgtgtatgaacaagtaataagtgtcaaccagcccccaatcgctctgggatcggatttggagaaggccttgtgtccaaaagtccccccctatttaagtgggcaaggtcctccttttatatttcaaggggataccaca

SEQ ID NO: 69277 - DNA, 6851 bp, Oryza sativa
tccctccctccacccctccacctggtttacttttttggcaccgcattacttttctattttagtaaatttatacacctaaagtttatacacctcaagtttacacatctaaagtttagagaccaaaagtttataagtcaaaagtttatatatccgatttaaatttgaattcaaatatttttttatatatagtatttctatacatctaaagtttatacacctaaagtttataagtcaaaagtttatatacccatttcaaatttgaatttgaattatatctgattcaaatttgaattttgaatttgaattcaaatattttctatatatagtatttctatacatctaaagtttatacacctaaagttttaaagtttatagatccaaagtttataagtcaaaagtttacatacccgattcaaatttgaatttgaattatatctgattcaaatttgaatttgaattcaaatattttccatatatagtattcctatacatctaaagtttataagtcaaaagtttacatacccgattcaaatttgaattcaaattttttatatatagtatttctatacataaaattttctaacttttatttttttaaaaaaaattgtgtgtactgtggtagaaagagaagaagggggaagaggaagggggagaagagggaggagtatagggggaggggggcaaaccgattgctggcgatcgcccatgagcctccccaacgtaattggggttatttaggttttatatccgtcgtcttcctgaccccgcggataaaaggggccaggggttcgtactattagccgtgctcctttcatattaccagcaacatctcgtggcagcctatcaggttaattagctgcacacgacgtcaggggtgacgtacgcgtccgttggagaaagtccagtcaatcgcgccgatcgggaagggaacctctcgcgatcgagttgtatatgtacgtgatgtcaacgaggagagttgttaatgtcagcgaggagatttgttaactactgcaaaaagttttcgcggacgatgttttacgcacgttggtggccagccgcttttctggtctacgcgggtctccctagctgctccctcgctaggacacttttcgtgctaaaataaatatattttttaccatctcgctaatatgaaaccggaaaaacaaaaatacctttattttattaataataaatcataatataactattttaatttatttacttccaatataattattctctacttttataaactctaatttaaaagaacactttaaaaataaacttattacagcgcggaggggtgcatagggagtatgacctcagatggtgggacagcgggtcgcgaatagccggtagacaagacaagagaaaacctgtgatgatacacaccacgacgtgtgtggtgtcgtgtcgatggaccgtagttagattcgacccgctaccgtggaggggtaaccggatgagtgctattaacttgaaaagttagctacttcatccgtgttataatatagtaatttagaatttaataggatacattctaattataagactataaatcggatagaacttctgtctaaatttatagtttaggatgtgttatattcgattctaggttgctatatccacatcagattaattagaatacacgattcggttactatagatggtttgatcggtaaccattgtggtatttatattgtctgccttttttgttacagcacatgacgacctaccagtaattaacagagagctatgtacaaacacgctacgcgcgcgaccgagactgctgacactgtatttaattattaatctggacgctcgggagagttatggacatttcgaatcctattttagttgatgcacactaatttctaaaactcagtatgtaagtatactacactatcatacactagtaattattatataaagtattttaaatcacatgcaagtgtgccacatcattacctaatagcaattattatctaaagtattttaaatatcatgcaaatataatatatcatttacaaatttgttgtatttttaaaactcaatatgtaatcaatgtcaaataattatctccatattattttcatgttatttaagtatgtacatatatcattaatataatgtataatatatattcatccacgtatctcgtaggaaagcacgatgtatcatctagtcagtgagaagccaatcgccagctattatcgatcgatgtcaagctgtgaacccgcgtctacagaggcaagcagagatagcggccgcacaccattaattctgtatattcgcacgttcgtaggcccacgatctcaatcagagtaggacggcttacccgtacttacctaattgccgatatggtgatatatatggtccgtccattctacttaatcaaatccacgtcattatatgcattaggctgtgtttagtttcacgctaaaattagatatttaaataaattagaacgatgtaacgaaaaagttaaaagtttgtataggtagaaaagttcgatgtgaaaaaaaaattgaaagtttgaagaaaaaaattggaatctaaatatagccttaaacttttgtgtttccatgcctggccatggcttagcatggatgtagtatatatcaacctaattaataatcaatagttccacattcccacgcacttaatcagtactatagtagaaacgctcgtcaaatttaacagaaaacatgattgcacgtaagcggtattttcaatttttctttaaaaaaacttagcgagtttgtataatctctaccatctaccgtcaatttcttggacacttatccagttgtatatatgcatgtgcaaatcagtcgcacttctgtcaaaaaaaaaaaacctaaaagggatgtgatcttttttagaacaacgaatttaaacaaaaggctatctaaattcattgtactaagagatatcacatcctcggctaggttatgtttttttaacggagggagtatggtcttgtggacagaagcgcctttattatgataatgaaattatgggtgtataacttaatataaatatactactaggatttgaattctattgtacacaattaaactattttacgcttatgagcatatccctatgattaagacaaattgggaagttgcttctattatcttaaaacattaagattacatgatctagaaatataaaatgagggtaagagcgatgcagcttggcgccgcgcactcgtgaacctactaaccgcacatgcttcagtttacaggggtggtcattctcatttggtaaactaacctcttgtcatttagtcatcaggctgtacctgcagaggagtggaaatgaacatatactcgcaatgcatctaataagtgaagctagctagctagcacagctgtacaaggggctggatggctagctctaaaagtcctatgacgaatttagagcacgaaacaggccggattaatcatgccccgaattattgtcgtggattatctctataaattatgaaaaattaaatatttttttaaaaaacttaatactagtagtttataaaagcaagttgtataataccctctttgtttaggcttaggcttattggcctaaacttttaagtcagcttattggcttatatgatttataagccagtggatttaatgtcctaagtttaatggtagagtcatatatctatctcatataagccaaaaaaagcttctccaatctagcttttggcttaatagtgttagagtggcttatggcttaaaaaaaccaaatgaaaaagctgcttgtttattttggcttaaacttttcgacttataagttggcttataaacctaaacaaagagggcctaagtaatacggtagaagaaagtctttggagaaatatattttaaagatgtgaatcaaataatctgcagtaataattaatttgatgacgtagcaaggagctgaaaccaacgggcttaatttgttcaaaataatttgatgctcgtactcccagaacaagtatacgtccctcacaattggatccccgatcgaagtcataaactccatctgtactaaaatatgagattttcagcatagtgtcaagttaggtatttaatttttactttaactactaatagcaaaacaaaaataaaaagggtcaattgtgtaaaattgatatgactagatttatcataaacaaactattataatatgcaactctttttatttacaacattttatttttatatatattgttggtcaaaatagaatctcgaagactatatcaaagtcgaaaaatacttatattttaaggcggagggagtatacaatacccctgtgcagctacagtattagagtagaacactagtatacatacgtgcaattaagaaacttgtgtgtagtacatactctctctgtccctaaatataagagattttggttagatgtgatttatcctagtgcaatgaatctggactatataaggtattttggttagatgtgatttatcctagtacaataaatctggacatattttatatataaattcgttgtactcgcatccaaccaaaatgggagtagattttatacgactggtcaatagtcaaacccagagcttgcaccgcaaggaaaagaaagtgtctttctgatccagatgattacgtgagtacacatgccgcttgacaggtacgtatagctagcaatatagctaattaggtgtcaacagataaatgtgcgctttgaccacccaatccttgcacgtatattttctgaagggcatgcatatgatcgagcattctgcagtacatacgtgatgctcttgtatatattaagatagtggagaagatatactacctccatcctaaaatgttgacgccgttgactttttaaaaaatatttgaccgttcgttttatttaaaaaatttaagtaattgttaattctttttctatcatttgatttattgttaaatatatttttatgtatacatatagttttacacatatcacaaaagtttttgaataaaacgaatggccaaacatgtttaaaaaagtcaacggtgtcaaacatttagggaaggagggagtatatgatagcatgacagtgagaggaactttccgttcaaaaaaaaagacagtgagaggaactatattaccgtacaacagcacaattcttgtccggacaactaacgcagctaaaatagtttcaatgctgcacgcataccttgtctcactgattggttgcctttcactacagggcatgcaacttttcccgacggcgaaatcaccgttggtgatccaaaaaactgtagggaatgctgcagtcgaaagtttacgatcgggaattgttggtcgagaatgagtgtgtcggggatttgtaatcgacagtgatcgattctatgtatcatcgacaatttacatttccaatcgaatattgtggaccataagcccgtcggggttttttggacctccgttatatcctccgtaacggattttaggattcccaacaaattataaactcgtgacaatatttgttaaactaatggaattgataacactattagcagtttatatcacattatcacatcaacccaatattaaccacaaatgattgtaaccttgtcttatgggaagcattttttttggcagttcttggtaacatagtttaacagtaaatatcaacaagattcatgaccaaacaagtaccctaagttttccactacttcatcagtataataaaattgaccaaacatttggcttaatacaaatagttttcttaatgaatctcaagctaattaaccagttcgaatgaacgccaagaatatgacttcaactatgcataggatcatcaccatagttctcctatatcatcatcatgatcagcaccagtctttaacatcatcatgagcagaaccaccatcttcatgatttgattcacatgcttttcttttttaggaactttgatgcaccatacattaagcttgatgacggctgcccattggtagacaaacttgtcaatttcgacatgtgtgaacagcaagaaatatgttttccttacataattcatgattgtttttacataatctctattttataagatatttttttaacttcttttgtggtactcctacctaatactctcattactccctgctccccccccgggcggaggagagtaagtgcaggtttaagagtgtgctgtagacaaagtacaagcacatgtggaggaaagagataataaaaagtggaaaataatattggctcttatgcaagaggtagctatacccatgctgcaagataaatgcattagttatatactctcttaatttgtttcatattataagtcgttttattttttctaagacaaactttaaaatattttgataaaatgtttattttgtgttttattatatttttctataaaattagttaaacttaaaaaaattgagtagaaaaaaaatgaagtgacttataatattaaatggaagaagcgagagaaagagagagaatagaaaaaaaaagaataaatctctgtagctaatctattatacatgttaggtataatttataactagtagtgttaactttattattaaatttactcgagggcagatgctctctgataaacggtgacggtaaagcatcatctttctcatcattacatgctgtctttaattgctgattttaaggttacaacgcagagataagtttttttatcctccttcaactagttagctacagctctgtcttacgataaacttatctacttagtactccctcctggatttttcacattttggtccttttgaaaaacttatttcgtaaatagacccctgaaaaaatttatcctagaaatggtcctttttggggcgccagagtggctg

SEQ ID NO: 69278 - DNA, 600 bp, Oryza sativa
agaatgaatgaaatagtcataatttcttgtaatttgtttaaactacagaagaagtaaaggattcaatgcaaaacatacccgttatcagacttctgtggaatggacacatcccatacaaatcctgctaaactgaacatatccatgatctcctttactgtaatctgcaataatgaaacaaacgcatataacctctgttatctgttttagataacaaagtttggaacaggtgaagttttgcatttcatgaagcaccttgaatggcagattccggactatcactctccattttctgatcttcgagccctgcatagcaataagcaagtttcaaacagctgcaggtaaatggggaaatggccaaacagagaaaatgatagtggttcgacaaagtactgttaaacaccatgcaacccttgtgcagaagacagacactcatcaaccaaaagtaaagattttaagtaatctcattctatctcctacccacctattagcacaacagctcaactagccatgcaagatagtggtgcattataagcagagctaaagctccagtatatctattgttccattcacagaataatattaggatctttcaaacggaaa

SEQ ID NO: 69279 - DNA, 5212 bp, Oryza sativa
aaaagctcgctccactaccccgcgctaacgcacgcggctccaccttaagcttatggtcctccgatttctacctgtccggccgcgatacgccaccacgtattcccacaaaacaaaaggggaaaaaaaaaaggggcacgagacgaatggatgcgccgtgacaccagctgcgtgcagcgtatcgcacccaacccgtccattccatatgcacgtatcgtatcatatgatataataacgatgacaatatcttactagcaaatcatcgtaagttcatagggacatataggcaatgcgagccagctgatatttatctctctctctctcccccgacctagcagccatgttcctcttatgtgtgtgcgtgcgtgcacagttcgtgcaagttgggaggagacgcttgccaatggctggagccacatgatcgagccagcgattctgattccgttggcctgcctataaataccccgaggagcgagcactgcagatgccaaggcagaggccaaggtttcttctctgctagctaactagtgggctgcttgggtggggagcccgggccggcagatatcctgtctgaaacccttaggtatgtattttccctcaaatggctggttaatttcggctccgaaatggcagttcgcatactatcatgcgaatggcattgtcttcttcgccatcacttgtataaagtcactagtgcacatgtagctttcaagaatcaagaggatgatcactgctagctagcttatgcgtctgtttagttaggccaagcagcagcctgtgttgtgttacctactcatttccaattgcacccattgcatcaggaaccttccatctttcacttgtaaaaatcttactgcatctgttttgcctgttcaaacatggattttccatgctctctcaagtgtgaagcagatcgtttgcaacttgcagttgtgtttaggagccatagtagacagggtatcaattaagcacaaaggtcatgttgcatgcatgactcaaagtttttttttccttcatttttttttgggtgggaagaaaaagtttggaccaatggttttacgccagcttttatctcctgtagcatttcacgcactttcacgttgtgttttttctccctcccgggagtcaatctttcgccgtacgtgatatgataatatcgaatccgagcccatatgtccttgaagagactgacagaattgtactttatctgaaacccggttgctcggtcggtcacaccaaactgagccaaaaaggagatccgagttagacaaatcgcgccttgtttgcataaagcggcctaaacttagatgcccatattactatcacattattctgaagaatttttgttcagaaaacaaacattattctgaagaatctcttttgcacatcgcgtgtagcaattgttcgtcagtagcttgctacgttctacagttctctgcacgagtggcctaggtagatactgtatttttttttaatatcttgtgcgaaatgggtgtacaaaagcagagtcctgaacatgtacgcactgcattgcgtgatcacagggacagggacttcgaattcttggaggcaatggcgtcctcgttgctccactgctccgacaagctgccgttcatgaacgtggagaccgtcctccacatgaaggaaggcctcggcgagaccagctacgcgcagaactcgtcgcttcaggcgagcaccttgcttccttgccgctcatggccattgattctttttgatccgtgcatgcatttttttccgagttctggctctgagccatggcgtggccattcttgcagaggaggggcatggacacgctgaagagcctcatcaccaactcggcggcggacgtgtacctgtcgcagatgccggagaggttcgccgtcgccgacctcgggtgctcgtcggggccgaacgcgctgtgcctggcggaggacatcatcgggagcatcggccgcatctgctgccggtcgtcgcggccgccgccggagttctcggtgctcctcaacgacctcccgaccaacgacttcaacaccatcttcttcagcctgccggagttcaccgaccgtctcaaggccgccgccaagtccgacgagtggggccgccccatggtgttcctctccggcgtcccgggctccttctacggcaggctcttcccggccaagagcgttcacttcgtctgctcctgctccagcctgcactggctctcccaggtacttaactcctctgacactgttgcattgtttgatctaacgattaaccggtgtttaagtgggaaattttctaaatacttcaggttccttctgggcttcttgacgagatgaacaggccgatcaacaagggaaagatgtacatatcaagcacgagccccctggccgtgccagtggcctacctgaggcagtttcagagagacttcagcctgttcctcaagtcgcgcgcggcggaggtcttctccggcggccggatggtcctcgccatgctcggcaggcaggccgacggctatatcgacaggcgtaccaccttcctctgggagctcctctcggagtcgttcgcctccctggtcgcacaggtgagcagatagcctgatactcatcagtattcagaactctgaactgataatctgaacctgacggcaatgcaatgggtgggtgcaggggctggtcgaggaggacaaggtggacgcgtacaacgtgccgttctacgcgccgtcgataggggagatcgaggaggaggtgaggcgggagggatcgttcaggatggactacgtgcagacgtacgagatcaacctgagcagcagcggcgacgcgaggagggacggcaggacggtgtcgatggcgatcagggccatccaggagtccatgctcagccaccacttcggcccggagatcgtcgacgcgctcttcgccaagtacaccgagctcgtcaccgcgtccatggagagggaggaggtgaagagcgtccagattggggtcgtcctcaccaggttgtgacacaaaccacaaagctgtgacgactgaccagagcgatttgtaccagtttatagtttgaccccatgtttctgaattctaatgtgtgaccatgtggtgtttagttgttgtattgagtaactgatgatattaacaaattccatgtgtacttaactggtaggatggaaagaaattaatggaaagtggattaacaagtgtgttgaaatgccataaatcgtccgctactcccctttatcatcagtaattcaatatccagcaatactactgattttgtggtttatagctagctacacattcatacgaacgctaataaagttttgcgacttttttttggtttcgtaaaaagaaaaaacatttttttctcgcaaattttttaacgctttttatactttccctcaaaattaatgtcacaaatgtgaaaacaactgaacatgaggccttgtaatgggctggcaagagcaaacaagggcaacaaatttcgaccatcgtgggatgagatgggcttaaggaggcattagggcttgttcagtttgttgctaaaatcaaccatactaaattttggcattgtcaaattttggccaaattttggtaaggcaataaactaaatgacactttaccatcacaaccttgccaatccctaccaacatttgggattctagaaacttctactcatataactatatcaaaaattgttgaggtgtcaaactaaaggcctgttcactttgatgccaaaaaaaaccctatcaaaatttgtcattaccaaaattttggtaactatgccaaaattttggcatgatttcttatatagttaccaaaatttggtagcaaactaaatgtagccacttttttagcaactttatcaaaatttggtaaggttgaaaatgacatcaaagtgaacaggccctaaactccatcttcacagcttgatctttgctaaaattttagcatcaccaaattttgccttttcaacaaatggtaaggtcttttttgcaatgaactgaacaaaccctttgtttttgtatgtgaggcccattaaggaataagtccatttatatccctcactttttgttgagttggaaatcttaacccctaacttacaaaaccgggttaaattaggtcctatagcagtattgagggctggtttcactggcatgacatactagtcagcgaaagaaagtcagtgaaaagaaaataaaaaaacatatagggcccacatgtaagtgagcttgcacttcttccccaactaccctctcttctcatccctcgacctcaacctctctctcccccaagagctcgccggtaaggagaggggcggtgggcggtggctggcgagagaggagcaagatggcggtggctcatatccttaccgacgagccctacgtgggaggttggaggaggagatggcgcagtggagaggggatggagcgagggggcgaccgccgtcaagggtggagctcggggagccgccatcggtgtggagagggtcactgcggctagaatatgtgtaacaaccctccctccagaaccgcgtagccagtccatccgacgggcgggcccacttacacataccactccacttatactttcgtcttcgttttgtgtaaaaaggttaacccgggagtgagatatggttggagggaagatgccttataagttggtttcacccttactaaactagcaaggtggtactaaacatgcacacacagctctcatgggtcatacatgcctcatcctaattgggccaggatgtcacaatatggctgacgctgtccttactcgcaaccgctgccgagggcgatggtggcagtgaacctgtggttgccgaagcaagagctgacgatcacatcatggcagtaggaggagcacaatcagtggactccatggtttcaccatgggcagggtgattgggaggcttcgggtggccttggcctctagctcgatcgtatcagtagtgagtgatgctttggcctcctgtttgggtggctttgctatagcgcctccctcatggccatcgtcgctgagatccatcaaggtatgagaatgggtcaccgcgccttccccatggcttggtgatcgcgttgcatcgtggagcacgaaatgaagcgctacgagagcggtgatccacaatgagtaagtgctctgtgtgttaggatagttgctcgcgcttcactggggaggcatggttgtgatgctgaagcaagcgtgccggtttaagaagctcgtgatcattg

SEQ ID NO: 69280 - DNA, 1853 bp, Oryza sativa
acatgaccatcaacagtacaaacagccaacagacaactgaatccatatagggaaaaaaaagtacagaggccagataagcaaatgaacctagtagtgctgaagaataaatctagagagagacaaaaatgatgtgatgaaacgacttaaaaaaagacatacccggagttaggagaaaacccttgttgagaccatgaaatagatcgagcgcataattcagtttcacgtgctaaggaagtgggcattatacatggttcaaagagatctgcaaaataagcaataaaaactgattcttggtgcgcaccttctatcgatgtccagtgttacttttcagtttgtcacaagagaagttgactgccaaaaatttcatgtaatcaagataattacatattaaaattacaattttatttttgtaggaactcaaatccacactgctgaattgatgtttaagaaagcgtaacttctggatgcatattgttgaattgcatcttcacatgcaattagcctaaggcattgcttaataatttttaaagaaagcaaagtgtacatattgatgatatttatcatcatttggagttgtccaccgtgatctcaagcacaacagccacccataacatttaagttgttgacagaactctaaagtaactgctaaactcaagctgtcccaatcattttttcttactatgcagtgctaacataaagaaacttaacaccgagcatctcttccactccacttcggcaatcatattatccgtctaaactgataacacgtgaaaagcaaaaggaatgcagcacaaattcatgtgtttcactggaaaccgtaccttctctgttaaccactcctatgggaaatgggtcgctaggacgaagaacaaccagttcccgaggcccctccagtgcagatgggttctagaatcaaaaacacaagatgaacagtcataactcctgaggaggacaacatggttcgaatacactaatgcaatgaaaccacacataccaggatagtgataaggtgaccagaggcaacagccaccaggttctcagtcgaccaagcgattgcatttgggtacgacggcgacgcgatcaaggtggcagcctggtaatgcgaagccatggcactcacaacaaaaccaggcggaaattaacgcgggacaagggggttcagttgagccactgactgcacctgcacctcgtctaagttctatcatcctatatgtaagtccacagcatgcttgtttgacacatgggggaaaatcctcactgcagatggatcgggtttaatcccccaccacccaattcctcttcgctacggagaaatttcagctaagccctaggaaaggaaaggaatgaatagtggcggagagctaaaactgcaggagtataagagggggatgctcaagagtcgacctgtaggcatgcggtggagcagccgttgcagtcgccggagtcgggaagagcgcggcagcgcttccccgaggccggccggactcgccgcgccggctcccaccccggtgctgcgacgcggagtggagcggacgagcggaggggcgcggcagcaaccggcagccgagcgaagggccgcggcgtgcggggggcgtggggcggcgggcgagcggagcgcgtgctgtcctcctccgccctatgtcgcctcagccctcaagccgccttccgcccattgttgtatgttcggaggcccaattggttttccgtgatttaggccggcccagttgccagctttcgaatgggagtctgggccaatcgttccatcgtttccttttccaatcgttccatagtttccatttcttcttaactcctaacaatccttccatcaagttcaaaaaaaaaaaaaaacaatc

SEQ ID NO: 69281 - DNA, 518 bp, Oryza sativa
cgagccttcttgatcgcccgttgaccccgtcaggtaagtatggagcaatagtgcacggggctctctacttatagccatctctcccacccgcacctcctcgactccgcgaggtggtactaatccccgacgcttccacccgttttcggtaggaattttttttatttataattttttttattaaaagttttacaaaaataattttccattttgaaaattgacgggagtagtcgcctaccgccctctgggagggcgaggcgaaaatgacgtggcagccggccgttcgctctcgggcgacggccgtcaacgaaatttgcaggcggcccccttgccgccctccgctagggcgattttatactgtgcggggggccgcctgcaaatgagcggcgagggggggcatggaattttgcaggcggcccccttgccgccctccgctagggcgattttgcactgtgcagggggcctcctgcaaatgggcggcaaggggcatggaatttttcagcggtccctttgccgccctg

SEQ ID NO: 69282 - DNA, 9245 bp, Oryza sativa
tccgtaaaataatgaagcatggtgctatttatgcgtgcgtgaactgcttgtgtcattaattttagtttttggcttttgctagcttcatttttaccaatttcatacttatctgattcgaaggctcaaatagcagggcgcatttcaaagtaagccctgtttgagcatgcgaattttaagtaagggcagatctagaaagagatattatcgtatgaaaagaagcttcctgtcacataaggtgtagtgtcttttgaatctttcgtctcgaatggttctatacatgaattgaccggcaaaactttgtgcagcaggtttggagcctgtgactcttgcacctctaatcgtttgccctacaacttataacctgttgctatacttaatttagagatgatttgttttctttccatagtttatttgttagtattgactttttaaatcgctagacatatactccataaattatttatttatttatttatttttacccataaattacccttttgttgcagataagtcatacaacttataattaacattagcctaattcatggcacccgagagatcatgtatacgtactccctccgtacttgtaaaggaagtcgtttaggataatgtttaagtcaaaccttgggaatataaatcatgaataaaaattatatgaatagatttgtcttgaaaaatactttcataaaattatacatatatcagttttcaataaatatttttatagaaacaagaagtcaaaattgtattttggagaccgtgtcgctgtccaaaacgacttccttaacctttttaaatagatacatgcacgcaacactagaatagtaaatcgatggtctcattaaattcctattgagatttgagagtgtattcacacatatatgtgtaatatttttggacaccaaaatttgaaccatcgtacgtagagttatgtaaccacaaatttaatattgcaccaccggtgttctcttggtatgtttttagataatgagaagaatttcattgaaatgaaactacacttgacctccatcaattagggatgcacacatcctaaaaaggcaaacatgaacatattgccttgcagcaactcgccctacacataattaacacaaacacaaagtattatgcacctattccaaaacaacatcttcaactcttttgtacaattttctctccttattaatgaaaattaactgtggggtcttcaagaaggtcaagacctatatgtgttgcggtcataaaaaaaacatgggtggatttttatttgaaatgtaagacaacaccttcaacaacgagacaacaaataagaactgatgttgccgaatctagatgaactagatcatagtttctgccatgccatcatcattgcttatactccatgtcactgtctagctaaagcgaatatagtaggggtaacaattgcccatggtgactattgttcgtcaaaaacatccgaagggtccgctcatgactagtcatggttgctagaccaatttcaatagtcgtcaaccaatcttcccaatcaagacggagatcactacccacgtagcaaccccatttgatcgccaacggcaaagaccaggcatcaatatcaacgtacaaccacaaggacaaagctttggtctcctctatttgcctccatcgagcgaatgaaagaaacattttccatttggaacattgaagaaggaaatgtaaaaaatcgcatggcttcaaacgaagccaacccacctccatcgaccatggcaagcacaatcaaattgaatcgattttgctccactgacatgtagtcataaactgactcaaaaacaccacaaacatatccaagtcacaaaacaatatcatgagaatcacatgtggataatctgttcagcattatgctatttttcaacttgaataatctttctagcctaagtaccttaaaattatagcatgttggatagggtgtgaatgtgtgtatctttcatgtaatcgaaaatttccaatatttttaccttatgtactttggctgacgtttttgtcttggtttcggtttctccataatgatcctcatgatgttaagttccaattattccaataaatggatgtagccttttcattgccacttaggctaagttcttatcccaatttttccaactcacatctctcgttttccgcatggacgtttttcaaactgctaaacggtgtgttttttgcaaaaaaaaactatacgaaagttgttttaaaaatcaaattaatctattttttaaaaaaatagttaatacttaattaatcatccaataatacgtattttgttgtgcgtgccggggaggagctcccgaagacagccttagacttcatcatctccaacatgcccatgtcaagctgagatttgggctcattgtacccattggcaataccaaaattttgtaggacataattagaaaggatatgttcatttggtgacaaaataaggtgcatacaagatcaatagatgtgttttatcaaaattttgataggacagtgttttgatggagatggtttgcttggtgggatagcaaatcagacaaattgttggataaaaataagttatgtatattgtttcattgctggtacaaagaaaataaaccccacaaaattcaaaagaagccacagaaacctactccctccgtcctaaaaaaagacaaaccttggtttccgtgcccaacgtttgaccgtctatcttatttgaaaaaattatgaagaaaattaaaaagacaagtcacgcataaaatattaatcatgttttatcatctaacaacaataaaaatacgaattataaaaaaatttcatataagacggacagtcaaagttggacacggaaacccagggtttgccttttttgggacgaagggagtaacgatttttcatccaaacttttgtacttgcccaatccaatttgtttgatcgctgcaattcaggtggtgtttggatgcagggacttaactttagtctctatatttagacactaatttagagtattaaatatagactacttacaaaactaattacataaatgatagcgaaagggcctgtagcctagtggttacaagagcctcagtagcacctgaggtcctgggttcgactccccgtgggagcgaattttccaggatttaacggcgttgtgctttcagtggtaggcgacgtacccatcgacagcgaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagagaatgtttactgtagcatcacataggtttttttaagcctaattaatctataattagagaatgtttactgtagcatcacataggttaatcatggattaattaggcttaatagagacacatgattaattacgctcaatagagacaatttttttaagcctaattaatctataattagataatgtttactgtagcatcacataggctaatcatggattaattaggctcaatagattcgtctcgtgaattagtccaagattatggatgagttttattaatagtatacgtttaatatttataattagtgtccaaagatctgatgtgatagggaaatttagtcccatctaaatatgttctcaatattatgagtttctgacaatcgggtccgagaacccagagagacatacctgggacccaccgtacagtgggacaggagagaaaacctccccggatcctgcccctcctcaccgtctccactcccgatctccccgctccccgcgtcccgtctccgatccacccaaacacccgcaccgccgcgctacgcgagcacggcaccgcggcgcggcgcgactccgcaggcgacaagccgaggagaatcccgcgcccgcccgcccgcatcaccgccggatggccgccggccgtcgccggtagggcgataggcgggtagatccagatccggcggggcgggatcatatacaccccgcgccgatggcgggcgcggtgtcggcgctgttccttctggacatcaagggccgcgtcctcgtctggcgcgactaccgcggcgacgtctccgccctccaggctgagcgcttcttcaccaagctcctcgacaaggaggtaagcgctcgcgcatcccggcctctctctatctcctcgtcctcgtaggatctatgtggctcgccggtggcgttgcgcgctaagctgatgtgaaccaacagggcgactcggaggcgcactcgccggtggtctacgacgatgccggggtcacctacatgttcatccagcacaacaacgtgttcctactaaccgcctcccgccagaactgcaacgccgccagcatcctcctcttcctccaccgcgtcgttgatgtacgtatacccaccctggatcctgggacgcagatgacatgttcagcgttcagtttgttcacgaagttggtttgtgcatgagtgcaggtgttcaagcactatttcgaagagttggaggaagagtcgctgagggataactttgtcgttgtggtaagtaatggtgcaagcagctaagcatcactctggtttgctgcacaatctactggatttgacacaagatggtgtttgatttgtgcctgcagtatgagttgcttgatgaaatgatggattttgggtacccacaatacacggaggcgaaaatcttaagtgaattcattaagacggatgcgtacaggatggaggtatcacagaggccacctatggcagtgacaaatgccgtgtcatggcggagtgagggtattcggtacaagaagaatgaagtaagatacaggctcactctgttattttgggtagttttgtgatggtgctttccaaattatctaaccgatgtgtttccaggtgttcttggatgttgtggagagtgttaacattcttgttaacagcaatgggcagattgtgagatcagatgttgttggggcactgaagatgcggacatatttgaggtgagcctacaatgttattgtggaactagtagtatgatatctggatctgtaattcaatagggatcacatttatatgagtgaacattcagggtaccttcaatcggatctcaccaatagatgaagtgtccaacctaattgcccatttagaagaccatttatcagaaaattgaactgtttaagtgatggcctaagcaaacttttttactttctttatttgtgaagtaaacgcgtcatcttacttgctggttcatatgctcatttttcctgtaatcatgcatttaatatgtatttgtattccaattgttccattcttatgtgtgtcaaactaagtattatactaccgcttcacttctgaaatttcatgattttatcatgtagccatagtgtttcattgaccttttgcctttgaaagttttcaggaagtcttattctagaaacctcttcgtctctaacagattactgcttgtagattcttctgttatgcaactagatctatcataaatcttggacaaagaaatgaaagcatgctgaatgtcttttgagctagatcaatttccatgcaatactatctgacgactttagaattggttcaaagttcaaacgtcaactattgttatatgaatttgatttgccaaggctatcacgtatttgtataaagaactgctattgccacacattaaatcatcaaggaatttgatcaaggtagaaattcactctgtaagcactacctgggagatgtgccgcaccgtttttttctaatttttaaaatgtctatgcatcttttatatcccatattcagaaagaatggtggtctctcatatgatcataaagtgacttgcagttgaaagatggacatacaatttatgacctgggaacatcgatactgcatttcaagtgtttgatgttggccatacccatcacaaaatgttagcaaatacctctaaatgtcaattatagcttcggagcctacaaattaagattattaggatataagcaatgagagtgctttgcagattaccagaatttgggagtattccgtttaatttgtttcagatgtctaccttttagcagacattctgaactgatcatctgatgatgctcatgcgccatgctccccatcgaattatgttttccatctatgtttcaaagttcaaattatttgtgttatgctgtcaccccaaccatttatgttttcctgcacatctctgacccccactaatactgaacaatattgtgaatcagtggaatgcctgagtgcaaacttggattgaacgatagggttcttttggaggctcaaggccgagctactaaaggaaaagcaatagatcttgatgatattaaatttcaccagtaagtaaacagtttagcatttttttcaagtcactttgacaatttgagcagggccatatatgacctctctcttctgttattactaggtgcgtgaggttggctagatttgagaatgatagaactatatccttcatacctcctgacggatctttcgatctaatgacatacagacttagcacccaggttttctctactgcttgtgatttacagctattggatgctttagatacctgaaatgcactgccttgctccgctattctcatgcctgtctttttttatatatccttaaggtaaaaccacttatctgggtggaagcacaaattgagaaacattcaagaagccgaatagaacttatggtgaaagcaagaagtcagtttaaggaaaggaggtgagcattttacaagagcaatgtttgctgttacactaatgcctcttggaaggtgacatatttcctattttcacctgcagcacagcaacaaatgttgaaattgaagtgcctgttccttcagatgctacgaaccctaatataagaacttcaatgggctctgctgcatatgcacctgagagagatgcaatggtctggaaagtaaaatcatttcctggtggcaaggtaagtttcaagccaagtcatctttgccttctacttcatgctacctagaagtgtgctaatatatgtgagtttttctgttaggattacatgtgcagagctgaatttagtcttccaagtataactgcagaagaagcagctcctgaaaagaaggcaccaatacgagtgaaatttgagataccatatttcactgtgtcgggtattcaggtaatcaaattactattgcaaatatgtacttgattgctcttatggtacttctttgctatcttcactcaaaatgtatgccatcttgtattttctgcaggttcgctatctgaagatcattgaaaagagtgggtaccaggcgcttccttgggttagatacattacaatggctggtgaatacgaactgagacttatatgagttatctctgatatggctgctcaaagattttgatgctaaatttcaactcccaagatacatgtttgatgctcgatatacaacatatagttggcattgggacgttgccatggaagtctttgaaaagctcaaccatgcaaggtttttctgtctcgttgttcatcttgttagtgttactttaccatggttactgtaagttacccatcaagtatagctttgaaaaaaactttttttttgttcacttgtatcattattgatttatttttgtgggtgtcgaactttcccccttttgtactacacaaaaatcttgagctgaattggtataaatgaaatacctgggcggtgcttttgaagtccagattaaaactgctgaacctgtagaactatttttaaggcatgctttctgttgtgtacctgcacagtgacggtttcctatagcagtgagaatcagctattcagagtttcagaccttacagggtgttgatcatcttgtcaatgctgtttccgttcgtgatccattgttgccacatgccaacattcttctttatataattatattccatggcttagaacaaatttcgtgtcgttaaggtttgcttttttggttttttgagatgtttatgacgttcaattttggtgattccaagtctttctgtactagctagactagctgggccttgtaaagaacccactttatccaatgacactatattcccaccttcgcagtagattgtttcgactcgttcaggtgtgtttacaacccaaacccgtttacctttccatcacgacctttttatagagggatgatttttgtgggattgattttggatcgtttcctagtactgcatgtaatccgttgaggtagttctggcctctgggtagttgacacctctgcggctctgccacatcgatctttgtctaacgttttctcaacatctcagtttactccgctgtggtttgcgtcgtctcgccggcctggccaagcgaatcgagggatcgtcgcatgcgactccctcgtggcatcgtcgcgaccctatcaatcgataattaaaggaaaaagtacataaaaggtccctctcaacttgttatcatcgagttattataaaatcatctccgactataaaactggatatatgatatccctcaatttataaaaccgttcactttagtttctttggtggttttgactataattttatgtaacatggcgactgagtcagcgtgagcccccatatcagtatgccatgtcatcaccctctctctcccttccccctctctctctctctctcacttttctcctctctgctggccggccgacgggtgggaggaggtcgctggggcgaggcgggagaggaggaggtccgacggccggcgacgcggcggtgggtgacgaggtggcggctgcgacgcgggagcaggccgctgcgcctgggtcggatgttcgaggagaagacgggcggcagctggaggagactggaggcgcacggcgcggccggtggccaacggacgcccgccgccatcgccgcgaccactggacgctcacactgacatggaagcggtccccgaggtcaccggcgtggaccccggcgacgacgaggtgagcgaggatgcgcggggtggtgggggcggacccgtgtgtggagaggcgacggaggcggcgggcgacagtcgacgtcgaccatatggaggcggaggcgcgctgtgccgctcctggatctcggccaccacgccgagcacctcgttgcggccatct

SEQ ID NO: 69283 - DNA, 34792 bp, Oryza sativa
tcccctcccctcccctccccgagggcccacggggtggacctccaaccccggggccccacaccgggtcctcttcgagatccgcatccgcccccgccgccgcatcttgtcctcttccccggccgccgctgttcctcgatcctgatttgctggtggccggccgccggcggagcagcccggaaggtctacggcgcgccggcgatgtcgcccagcaccctcgctgcgtcgaccagtatgaaatggagcaggtcagtttcgaacccaaaaaattgtaatccatttcatgagccggcatggacagattagggatccatttggaattcgattgatgtttctcctgtcgaattaattcatccagtttcgtcccgatttgatttactaatagcaattcgtttccattttatttacttatttgtggttcagctgaatccccaagcctcactttaggtctgccgctgttacaatgagtccatcaaggagcaggagcaacagcaggagcagaagcagaagcagaagcgggagcaagagcaagagcaagagcaagagcaggagtcgcagcaggagcaggagccgaagccgaagccctcggcgagaaaggctgcgtagtgagcgtgtatcacgtcgcagccgcagccgcagccgtagccgtagcccaattcgtagaagagaacatcgcggccacaggtgtgtctccaaatcttgcttgcaagtgatgctacattgagttgtatatttgcgtagttctaggagcagatgccggagtagggtagctaaaggcttcatctctattgcgaagctcaaataccatgtagattaccctgctaagttctaaaaaattaggaactaaaaacccacttgtgtaaaattatactagcccagccctaggtgagagctaaatctggctccgcccctgcacggggtgtttatattacctgaatggtacatccaataataacattgagttcacacaatttttgtttgcctccattattgtgttcattgtctgctcttcactacattttggtcatggacatacgttagctccattgagggaaatggattgttaaccaaaatttggcttgtggtcaactggtcacggaggtgttaggataattgcatggcaaatgtatggtagggttggcgaaaagcccagaggaagaaagagaaacatgttaatttatttagttgttctgccaatcccccagacttgacccacctcaacccccaaggtattataaagcttgtttcagggttcagtcctattaagctataactatgaagtaagtttaaacttattaaagcataatatctttgaactgctggttcaatgatccaaccattattcagacctattagacgttgaattggtcatgtaaccagtttttagaatctgtggtatggattctggaggggcctttactgtttccatcaacaaatatagcatgaaaaaaaatctaaatggtagggcttaactagtgggataaatgttgagaaattttaagaaaaaaaactattattcatcagggcctgacgttgtcatctgtagttctctggtacaaatttgagaaacaaggctaactcagtatcaggaagtatggaatgtaataaccgcaactctgttacaatgccttaacagcgccctcactgaactgtgttatatttgtgataactagcacattattgaaagtatttcaaatcagacaatgctattctgaagcaaatgcaatgatgttttcccccatcagtatgagcccttggcagttgtcccactacatgtattatgtataatggtgtgcacttgtaatccatgatccacttttcaaattccaatcacattaaagacctgagcacaaatttacttagtgcagatacaccatgtatatccactagaaagtgtcaattactcgtgtcatttataaatctatgctctcaattaagaagacacatgccctttgaatctagttatgccaaatgtgtttttttttctgtatattggagtacaatctgtcgaaccctcaagggaataaccatgttaatatgaataattttccagggatcttatatgcaagaattgcaggaggcctggtcactttgctagggattgccaatctactgctacatgcaacagatgcaatcttccagggtaaaatgagatgaaacactcacttaatgtagctgcatctgcttcattttggggggaatctagatgttgttatcattaagtgtttcgggcctagtactgttaacttgctcttgtgttccattttctgctgccatcttttagtcttggaaatatattgaagaaagtgcgctaacttctttttgggcgttattttaaacagacacttcgcagcagaatgcacttctgaaactgtttgttggaactgcaagcagtctggccacattgctaccgaatgcaagaatgacgccctgtgtcacacctgcagcaagacaggtcatctggcacgtgattgcccaagttcaggatctagtaagctatgcaacaaatgttttaagccaggccacattgctgttgactgcaccaacgagcgggcttgcaacaactgtcgtcagcctgggcacatagctcgggagtgcacgaacgagcctgtttgcaacctgtgcaatgtctctgggcatcttgctcggaactgtcaaaaaacgaccatttcttcagagatacagggcggccctttccgtgacattacctgccgcttgtgtggcaagccagggcacatcagccgcaactgcatgacaaccatgatctgtggcacctgcggtgggaggggtcatatgtcatatgagtgcccatctgcaaggatgtttgatcgtgggctccgcaggttctgatgacagccatccatacgcactgctggttctgatgctcggaatttcgcattgttccattgattctgcttagatagcttgcttgactataccgaaacggttcttttataccttttgctctctgggagttgaggaatgattctgtaggatgtatttgggtgaaacttttgcttgtgttaatcagggtgttgtagcctttcgtgggggaacaaaatgatgtatcttcccaagagagacatccagaaaaactgctttggtagaccaggccatatcaagtattgtgcatgactgtttgagctatttgactcctccaagcttgctcctccccactgactgttgcgtcgagttgtcctcattgttctgtattctcatattatcttcctggaagaaaagttgacgagtgagatcaggataatcagattatgacagttctctgatggtctttgcctttaggctgatttggttaaggaaaaaaagctcacatcttcctaaaaacattgcgtttgcccaaagaaaatttatagttcatatttgcatattttgattatgtgttttgtattttttttaaaccttttccagttcatattttgattatgttttatttgtttgtcttttcccaatttttatgcatttgcccaaagataatttacacttcatatttagataattattattttctgcattttgccaaagagaattagcactttcatattttgattatgtttttattttgtcccacaagcgcattttcccaaaatcacacatcatattttcccacaagtgaatttgcccaagaggttatcttttaatttagtcccacaagtgcatttggccaaagccaaagtcacgttgtatccaacaaaaagaggggaactatctttatcttttaattttgtcccacaagtgcatttgcccaaaccgcactttcatattttatccaacaaagaagcaaacgaaccgaaacgctacatcactcaaccttgatgaataacatagaaccacacaaatcatccaaaacatttgatatttatcaaaataaagagcaaacgaactgaaatgctgtattgcttaacctcgatgagctaacataaaccacacaatcctcccgaagcattttatactttatcaaataaagagcaaacgaacggaaacgctgcattactcaacctccatgagtagtcagaaccatacaatcctcccaaggtgtccatgagaactgagaacatatcagcaatttattctgtaacttgaacattgacacatctcaattaaacttggaacagtgcatcacaggcccatacattctgagcgcaacaacgaaatacaggatagagccatatctccatggttccatgaacaaacccacaaaccatcaagcagtctcacactaccaaatttagtgacacacaaatccataatagacaagtccatattgcaagatcatgaaaggcatggcaatgcttatttcacacgatctttgagcgcatcgagactgatttcgccggcgtcagtagcctgcacttccaactgaatgccattcagctccttcttgaatctttcgttggagctagcataaagcatcttgctcctcacttttgcattgtctggggaccttcaattcaatcacaacatatctcataagcggtaagggtaggcctacagtaaagtaactatggaatagacggggcacagaagcaataccataagatatagaatatcctgctctttggcacatcctctgcagtaaggaagtcaaagtcatagattgcaaaccggcagtccccttcaggcaggctgctagtgaaatcctcatagcttgttgtgcgatccccaatcttgtccacaatgatctctttccccttgttatccatcatgaaagttatgaagcggtgcatccttttggactgtagctcattgaacttcagcttgcaatcatcatgaattgcaactccagatgatgaatttgcctgtgtgtaatgtaacatcatgtaaggaaatctatgtcagttcatagttactcgagtaattcaaccttgaccttttccttcaaacaatataaactcgtgtgaacttagcattcaacatatgcatgcagttgcttcacctcttatagcgttgccaattataatttacatcctaaaatcagactgttcttcagtttattcaggtagagctttatcgtttttaattagttaatccgctgtagttatttgttctctcaaacctgatggggagtctcaatataaaactagactggtggtgctaccgtgctactgctacctcaacagatgtgcccccaaattaaacaatttagggattaataggaatgttcattaaacactatgcaattcaattggcatggtcgaaaagaccaatgagaaaatatccagccagtaataggcaaagaggtgtgtgccatatgagaccaaatgataatatctaaaccatcaacacacactccagtatccatatctgcaggcgaaggtcacaacaaaaaaaaaagatgagtgatacagtgtgcatgaagatgttcgattcaaaggtgaatcctgttctatgcaatccttttcatgcacattcactgttatttttgcaacagttattacaccaagtgccacatacaaagttgcaaattggcagcaaaaggacataaaaaggattgtatgaaataatttttacaagctatgactatcatgcaaggatatggactacaaaaatatggatgctgacgtactgtatcatatagtctacgttttgtgcacggtcacttgttgctggtggtttcatcagtgccaattggaaggtgtagtcattgcactaaccattcccttgttaatggcacacgtccatagggatcgcattaaaccacatttagctgtcttataccagagatatccccataagatcaatagaatcagtgggatctgaataaactgaagaatcctgatgagaaacaacatgcagcaacacactcttttcgctgctaattccagaaaggctagctggcagctatctcatcatatctggacatattgcagtggtctaacctcagtcagcatgtgatccagatacagatcaacttaaattccacgactactcgacgtctgacgatctgaatctaacaatctggagctcatcagctagaagctgccagattcccaggcttaaatctacatccacgcgaatctcatcacaccgcccccgcatgtgtgctttgacttggttccgctaatctcaagaccggacagtgtcactccaacaacccaagcgaagacctcaccgatcgacgagaagacaacatccaaaattcctcacgatccagtcggcggcgatgagaaaaacatcaaaccttaccccgccgcaacataaaggaacagccgatccacaaccggaagggccccaaatccccctcgatccacctcgattcacgaccaccacacctactatcccgcttctacgccccccaaactccaccaaaaatcaaccaaaggaacacagccacgaaccccggaaccgatctgaaacacatctaccgaaaccgacgcaaaacatcgcagacacacgggggagggggaggaggaggaagaggagaaggaaggcgtacgtaccattgctgagctcggaggggaagggaggggagcggaatcggcggcggcggcggcggaggcggcggcgcagcagcagcagcagcagcaaaggggaaagcgagacgcttctgctactgcagcgagctcgggcttttgttctcgtgtctttgtgttgtgtttgatggagtcgccgcggcgtccactgctcccaagttcccaacccaagtggttggcctacctctacacgcctccgcggtcgtcggattcccggatggacggctgagatgaggcgtgacggcctatcattgctgccgagaaaagttgtccaggcgaaatgtccttgctaaaagcgagattttttcccccgtattttatttatttatttttatattttattttacccttttatagaggacacgtcgttatatgcttgtgctgatctgttccatggacgaaattaaggtgcaagcgcgatcgaccgatcaccggtttaatcgtctctttattattcgcgtaatgtaaattaaccacacacgtacacaatccaaacaccaagcaagccgtacaaaccacacatacacatgggctgcaatgccaacgtaattacttggaaaatcgaggtaattaacggcgtgattaattaggaggtgtggtccttgagcacgtcgagggtgagctcgctggggtcggtggcctgcaggtcgatctggacgccgtcgagctccttcttgaacccttcgttggagctcgcgtacaccatcttgctcctcacgtccgccgccgccggcgaccacgacacgaagaagatcttgctgcgcggcgcctcgccgccctcgccggcggccgccgtggccgtggcgtcgctgacggtgaagtcgtggtcgtacacggcgtagcggcagccgtcggcggggaggctggcggtgagctcgtcgaagccggcgtcgcgtgggcccaccctgtcgaccaccacctgccgcatcgcgtcgtcgatcttgaacaccacgaacctgtgggcccgccccgccctcagctcctggaacctcgccttgcactcctcgctcaccgccacacccgacgtcgcgttcgcctgcacaaacacacgcataaagttctgaattctgaaacttcgaacaaactgatcactgaattatgaccaaatcagtgaagaactgatcactgaattcttggcaaattcagttggcaagacaacaacctgaattctgaagcagtgagcagctttatcatgcttaccatgtttcgttcgaagtgtcctggagaatgctctgaagaagtctgaagaaacaattagttggattctgcaatggtcgatcagaagttcgcagaaagtagttgcaattgaagatttgcactcagtagcttgtgagtgttttatcagaatattggatcctttaataggatgtccgagtccttttcgaagaaataatttagagggagatgtgtacacgtgtgagcatactgtggctttgttagttttgctctgggatagatggttccagtcttccagatggtgtcttgacgtggcagcaggaagcctaactcaagccacaaacactctcccagccaaaactgaaactacaaaactccaaattccgcttgtgcgtcgtttctctcacaagcttctcttgattaattcaaatcagctacgtcttgctgactgaactagtcatgacgttgaagctttccatatgcgatcagaaatgataataattagctctaataccgttacagcgaattcatgatgagtccacgttgtcatgcatatgttgaggatcgatgcgagaaatatgacaccatgacagtaaacaactgaaaaagcttcagaattcgcagctgttgcgtactaatcgtctgacctgtgcaaggtagctgccccgtcacactttgctgtgcaaatggaccaaatccaccgaaacaaatcggccggccggtgactttccaggacggcaccggcgcaccagttgctcgtcgccaccgtgttttctttttatcaagggaagaaactcaactgaaatgcgcccagcttggcatgtctgtactatgcactgccttgacagtgccacgtacacagactcgaacgactagccgcgtttccttctgatagcttgcgtatatgagcttttctgatctgtgacgcctggtaaagtggtaatatcatgtacggtcaattcaccgctgttaggcgttactagctgtgagcctgtgatgtctgacagaccatagaatggaatgggaaccatcggattagctaataacggacggtcatttttgttcagcacctcaaacgtacacaagaactgtaattcccagggcgaaaaaaattaaaaacggcacttattaaccatttcccacctccactgaggaaaaaaaaaagactacatttttaagcacatagaggtaccaattttagataaaagtctatgcctataatattaatatattttttaaaatataatacttataatatatcatagatgtcatcactacaagctgagcgtgccacgtggggaaaaaacgacgtgtggcatgggagccaaatatatatggttctccttatgcccttatcctcagcttctcccgctccagctctcttctcttcctctccatccgcgcctctccccagcgaccagtggtcggcctcgcaccctccccccctctagtgcttggcagctagaggccccgtttatccccagccctcttgtgtcggattctttagtgacggcaagggtggtggctccaatgccagatctaacatgtccgagctcgaagacctccagatttggccccgcgcggtgccctccaccagatctgctctcgatgacctcaatagcaatctttcctcaacaaccgccttgcctcagtcgatgctcagtggccaacggccttccctagacgtcgtgaagtgaatggtcgacgggtttaatttgctgatttgcgaaaaaaaatttgttgtctttgattatgtgtatgcccacgttatgtgattttcaatcgatcttggtgacgatctaatttggatttgagatttgaattggagttggggtaacgaggagtaactcgatgtatcagctcgatttctcaattgagccttaaatgtgctggttatggaactggcaccaatgactcggagtcatctacgccacccgtaatgccggttggaaaattcggcacctatagggatttcgcaatagacaccgatggtctttctgtaacagtggtatggtgtagattatgtgtatgtacacagaacaaactacgcttccatcatgtgagtaagatctctgttatctaaattattctggcatgtacatgtgtggtacatatataaatcaatatttgaaaacagggaacaatggacgtagaacacagccgattcgatcgaacagtctgacacagataaaattcgattggagaattgactaatgaatgaatgaatgaattagtatatccagcgtaaagcaattcctacaatggtaaaatctctatctgaaaaaagaaaaataatgaatgcaatagccacaatcgtgcaccaatatgtacaggcagcaatcgcacgaatctaaacgaagagctcgagcagaacgggcggcgcgtgcaccgccgcggcggcggcggcggcctcctcgcggtggcggcgcatgtggccgccgagcgcctggcccatctcgaagccttggccgcagatgtggcactcgtgggtcgccgccgccgccggcttctcctgcaccttcttggtggtctccttggccgtggcggcggcgaggccgagcgcgagcccgtggcggccgcgcaggtggctggtccggtggccgcccagcgcctggaacgacgggaacgcgcggctgcacgtcttgcagacgaagtccccactcccggacgccgccggcgacgacccgcgccgcggcttcttccgctcgccgctatccgcggcagcgccgagcgtgagcgacagcgagaggctgatcacctcgccgtccctcggatgcttggtcatggtcaagaaagaaaccgaacgaactggagatcgatcgaacacaagatgatcgacgagacgagttttagctagctagcttctgactcgatcgagagaatggttaatattgctgtgctggtgttgggactgggtgttatgcatggggtggctcttatatacggtacgaaaggagatgagattgtcacgtgcacgccacggcgcaggcgcggtggaggacgccatggcgagcgcgtcggtcgcagtcggcgaatcgtctgaaacgtcggaaccttctgtacgtacgctttgggtgggacgcgtttactaccttgggccggctggcttggcttggctcagatgtgcgtgtgcgctggcctcacaccgaccgcgcggcccgcggacaagacaggaagggtccacgaaatagtcaagtgggcgttaacataaacggtgggggttacgttagaactccgtataaaaaagagtgtagttttacagtgctcacatccaaagtttaaccgtttatcttatttaaattttttataattagtatttttttatttttagatgataaaatataaataatactttatatatcactatttttttaaataaaattataaattttttaaataaaacggatggtaaaatatttgacacggaaacttgtatctgtactcaaattgggacgaaggctgtgtttagttcagcgtaaagtttagattttagttaaaattggagataatatgactgaaaagttgtgtgtgtataacagattgatgttatgaaaaaggactgaagtttaaatacaaactttggatctaaacacagccgaaggcagtagctgcgagtagaaagggtgtgtggggcccactggtgctgcaccgttggatggttcggggtggtggggtccaaccgacgtttggttttgaccggtcagagtgctagtcttgcacccgaagaagaaagtgagtaaacttccgttatttggtgccttcgcgttggattgatatcgtcatgcgtactcacgtgaggtcagtactagtagtagaagtacttggcaggaaatatcaggtactagcaacctaccacttccagatttggatccgcgcgtgttctccaaacaagattgtggataaaacaaacggaacatgtaaggtgtttgtgctgtcaattgtatgatactacgtactttcccgtgaagtatacgtagcacatacaagcaactaacgcgctcaagattattcacccgtacgtactcggtactcctatgtgagaccattcaattcatacctgaagagaagtgctgaatattggcttgctgtttcttacgaacaaagactcgtttcagtttcaggttcggtcctagcttcctgtcactttccttgttccatccttacgaaacaattatactagtatatagtaatactaatactgcgaagtatccgaaggggattgattagctctagcttgattagtttaatttacagctcctttcgatggacatgcatatgtatgcatgtgtgtgtgcttgctcctgctgtgactacgtctacaagcgtgtgctcaaaaactgtgtaaattaatatctactatgtgatcgtttagtcggtgatctgtttgctagggaatcaattaattagtgaactgacgggcgcgtcttcggtcgtaaatccctgaaatccttctccttgatcagcttgaagaggtccaaatgtgttaatttcccccaactagcgtcaataattgaagaaaaatgataattcaaagagagtgttgttttctgccaagtgttgccctatgctaatattgctgaagcagtttctctctttgacaaatgtccctcgtggatgagatcaattgcattatagtttctatccagctagctagggacaattttctgttgttttctctcaaatgtttgggtaggcacttaattaatggatgagagtatggaagaatcacacatgatcgtacctatacagtggtggttaatcttgatttctttttttttcttaagaacaagggcgagatttgtctagcctgtattatgtaatttcggagtacttgaggtaaattaacagagagtggatatatgtacatacttcctccgtcccagtaaaattgacgtttcaacgccccaagcttgtcccaaaaaatgtgtcgctacacagagaagatgcactcctggacgccaaagcaagtttaattgttgattcaaatttttgaatatgttaatgatggctttgcccctttatcaaacatgtggccaaggcgccaatttgtgtactccccgtaacacgtggtagtgagttgtggttacttcattactgctggaaacatcctctagaatattcggaatgcatgtataaatgctggaaatgacagctgaatcaaatcatggggataatttggtaattttgcacaacagctaatcttggatgctaaccttaaaacatcaattttactgggacggaggaagtatcagatatgtccccccagtaaggatctagtcagatcacatttagaggttgaaagggatatgacgtggctacacgtataaggaacaaattcacagatatatgtgtgtctccgtcagattctgcacgcaacagtgcaacactgttattacgcatatcgaagctcagttgaacttggactgcaaatttgcaatcagggactgggaaatttaaatatcttttttgcttgaagaataatctggggataaaatttcggaaataatgatcaggaggaacagcgcgctgaatttatttctggcacaaacataaatgttgcatatatttacaagaggtatagctatgaatgaaagaattatattacatctgtgtgtgtatatacatctgaactcaacaaatctccaccaaacggttcaaaaactgaccgattcaaaaccgaacaacccaaacgctaatgaaaaaaaaaattaaacccctatcatagttacaagatcgatgaacctgactttttttttctagacatgtacatgaactaattaatggtgacacacactgcgtcagttcaaaacttggacgaaactaatggagaccagcggtaactaggcgaacaactccagcaacaccggtggctcggcggcgatcccctccggccgcgcgtcgcagcgccagacccagtcgtcggcggaggatccaccgccggcggcggccatctcctcgcggtggcgccgcatgtgtccgccgagcgcctggcccatctcgaagccgaggccgcagatgtggcactcgtgcttgtccctgtgctccttgtcggccgccctgtgcagcctgatcgccttgtcgccgatggcgccgaggtcgagcccgttgctccggccgcggaggtggctggtccggtggcccccgagcgcctggaaggtcgggaacgcgcggctgcaagtcttgcacacgaactccccttcccccgacgtcgccaccacgctcctccgccgcgccctcttcctcctcgccgcgccgcccgccgccgccgccgacgagtccgacgccgtgacgagcagtccgtgctcagcgccagcgccagcgacacctcctcctcctgcctcgggtgcttcatctccgattcgataagcttgtgaattaatggatcgatggattgagagagagatttttggttggggggagatcgatggatgggttggtggcgcgcgccgcgcttatatataggttttggagacgaggcggtgggggcttacgtgtttgccaagaaggtgagggggaagcgaccgacatagtggcgaggtggcgtggctgcgccaatcgcgtgcggccaacgcgacgagcggcgaggtggacggcttggatttggatggggtcggggggagtgggatgcgggcgagacggacgtgtgggtgggcagtgacctcatcagctggcacggcatggcaaaccatggcgcgtggcggctgttggttgcttagccgcgggggcaacgtcgtcgcccgcgccgccaccgcccgcggcggataatccactcaattattttattccgatcgattatattagcactagttgggccctgcttggggttgctggaagggcctagaacgttctcgagctcgatttgctgagcgatggattgtgtctatgatcgcgggattaagggctggtttggtttgaggtctaaattagccttatcaatatttatcaatttcaatagtgtttactgtttatatggtttgaaaccaaatttaggtatacctaagaaaataggtcatttcaatagttaacttaggctattttagctctaatccagacataaatttgccttgccaaaattaaccatacaaaaacttgctaaaatttagtatcgacgaaaattggtaagaccaatttaggtcacaaaccaaaccagccctaattaattaaagcacctatagtggtcaatcgaccgtgaccatccagaacatttgaacccggtctactgcagtacttttatggagtactagtattggttttactatttgttacggtgaaccgtgaatccagaccatagacacagttgtaaacctgtctccgttttgtgcggccggggatagtcaaacgtatatacatcgcgatgcatgtacagtctcgatttcctctcagacctgtagagctgtgtagaaactgtacgtatgacctgtgaccgtgatgtgaattccgtcccaccacacacgtacgggaagtcggaacgggagggcgcgtgcgattaaccgagccgcgcctttcgcggaggccggccgccgcgcgatccactccacgcacgcacgtaattacgtacgcccccggtcggtgacagctagcggcttacgcccatcaacggcaggcgggcatcaggccggcttaaccccagcgcggcgcgctgcgacgcggcgatgagattggcagcacggccgaatcgtgaggaaaaatggcagaatctaccgcgatattctcacgttctccattttccccacaagcgtactagtccaagccgcacgggcgcgcggcttccgtttgcctcgcgcgcaaggagcggtggttcctgtcgttgcgtcgcgtgcgcgttgcgcgatgatgtgtaaccggtgttgccgcttgctagtggaaactgctcgtactagtcagcggagtttggtcctactggctactagtactactcggttgcatcatgttggttcgtatctgatgccacgactttttatcttttttttccctgcattgaatttctagagagttgggggttgggtacggagaacctggccttttttttctttttttttctgggaatacagaacatcgatctctggttttgtttatgctggttccgggaggccgcctgccttggtcaacagtacttcgaagaacgaaccggcaacaacctctagagggagcattagatttgcagtgatgtcatggcaacggttgttagtgctctttcttttgctcaaatttacgtgtgccccaagtgggcaggagtctgaacgcgtactaaaaattcttaggcgccggacatgagcttcatgatcataactacagaaactagataaatggataaggacatcacatggatcagcatcggcgtctctatcctgatttaaaatataaatcaggagagagaatagcagcgggctacagatttatatccagctgtagcacggactccaagacgcagtgtatctatgacatgtgagactagatattaatagtgtattatataactattgtataaatgagctattagattggctatagatgaattggagctagtagttggctatactattgaactttctcttacatcgtcaagtgtctacgcggttaagcaggtcggtctgttcttgcgcaaaaggctaataatatctactccctccatactccgttttatattataagttgcttgttattctttgcagtagaactttatcaagtttgactaaatttataataacaactagaatatctaattagttttattaaatatattttaataatatatttattttatgttgaatattatttttttataaatttaattaaatttaaaaatattttattagaaaaaaaagttaaatgatttataatataaaacggagggagtatatatacatgtcatcgacgacatgatacctggtcgtcgaatcagagacgagtagtgcagtacggagtagtcctgaacgagtcctgaccccatacttggacggtagttcttggatggatttcgcgtgagtttcgttgattgagctccatatggtacggtgcaaattaggcggcgtgttttccttatatctgaagttccttaccgggcgccgcttgctgcgtgacagcttgagctgatcacctgctataggtttctacatgcgcctctgttcttcgtgtgaacagtgagctagcttactgctgtgagcctgtgagctgtatatatggtggatcaatcatgtatacttctacttgggttgccgacatcaacagcttccctgcctactgaggcctgtttctttcatcttaaaattattataatccagattattagaagtaaactaaaaaaacagacaacttattaaagtagcttattaaaatctggagcccagcttattataatctgataagctcatttaggtaagctttttctagattattaggtgaaaaattacccaccatgccaccccactccctctttagacttgcaaacctaataatctaggaaagaaacaactaaccgcttattctactacagattataacaatctagcttacagtaatctgactcaataatctagattataataatcttaagtcgaaagaaacagagcctgagttaaggccttgtatagattaaaaaattttagccaaaaacgtcacatcaaatatttggtcacaggcatggagctttaaatatagggaaaaaaccaattgaacagtttgtatgtaaattacgagacgaatctttttaaacctaattacgccatgatttgacaatgtgatactacagtaaacatttgctaatgatagattaattaggcttaataaattcgtctcacagtttataggtgaaatatgtaatttattttattattagtctacgtttaatacttcacatgtatgtctatatacctcaaagtttttacatctgaagaactaaacacaccctaaaaaccaaaacttgaaaacgcgttgcacctaatatccctgcagtacataggctgacaattgatatggaatcaggacatgattgtaacatgaaacttgtagtgataagaacgacgtgtatacgtgtgtaccgtgtacgtatatgcggtgtgagcgtgttacttgcatctaaatattatctagaaaaataataatatcacaaacatggctatttgtgtcgttaggttaataggaaccagaagctatacttgtattttactccgttttgttagttcagcagggtcgatcgacgaactcaaggagtgggtaatcgtatacacttatttactccataactggttgcgcgtcaacccatttatctttaatctagcttatcaaccatggttaaatttaaattttaacacttaattttgtagtagtggattttttatgtttgttttatccgagatttttttttacgttaactcttaagtagctaggaacaaatatatataagtttttactcataaattatttttaagctgctaataaacattacaatttatagcaacgaagaaactgattgttagaaagaaaaatctgacgataataagtgagccacaaatagaaaggacaccgaccaactgctgtccactgttgttagtccggtgattttggtatgctaagagcaagttcaatagtatagcctactactaactccaatttatttatagccgatctaatagccaattcatacaatagttacttactatactattactatactattaacatatggtcccacctgttatacacatattgtgtcttaaaatccatgctgcagctggctacagatctgtagcccgctgcttttcttttttattttttatcttattaaaatatgtttatagctggctaatagtattgtacctgctctaacgcagactctagactgcttagcatacttccattgcggccatctggcttttagtcggttagcatacacggttgagctcacagcgtactgacgttttgtcccatgaaaacgacgtcggtgatgacgtgttctcctgtacacgaagagatagagctcagccgacatgcttcacgttacgtgtcgtacttttattagaggcaaacaacctgaagcagtacacgttttcgtcagcctgatgacaggttaatccactgtaaacaatcaaaattcataatccgcgtgccttgcagggtttgactacgttatttactggtattcgtccgaacagaataacacatgactacgtttcagatgcaagctcctaccgccatacgctatgcgcgaaattgccaccttgaagatgcgtcatgcccttgggatacttttcctcatttcactcactcttgaaagccacaaactgcctagcctggtttaaggctcccctgatcaaaacatttctctaggcagacggtcaatttttgattgtttaataagttcctggcaaaattaaaaacagcatcgaacaagaaatttcttctctattaggacctaaatctacctacagaaacacagcacgctatattggtagagaagaacacggagatctcacaaaattcatactgtttcaaggggtattttgaccttttcccatgtaaatacgatgataattccaaatctgacaatgatcatttatatggacaagtgattttcattgcaccggaaggccataatacaaaatctggggcaactctaatgtaattaattgggtgaggttccgaaaagctctataccagattgatgttataacgccaaaacttgagatttgtgatcaatcccgttgaatataaatgttcccagcaaaggcacaaactgtttggtgaccagctggaaaagggaatgagtagttagtgcgatgaaagaacaattaatggttgtccacaaattaccgtcacgagatcaaaacacaccttaattacttcttgggatgctactccgccaatgaaggcagccacgggatgaatctctgcacccccaaaccggcacatttcagtaatcaggtcttcagacaaaggtgccccgttcatacccatctcactcattactgaaacagcagctgtcttcagcctaggcacatcctcatcaatctcactaccgaatccagtgtattattagtattataaatacatgtacgatgttataatgttcaccgaaagtgaatgaacattttactcatgcttacctttcaaagattccagggcatctgttatagttggctgcaagtcgatcaacagcacgtagcagaacatagaagttcattgcaaagctgcagccaaatttgcttgtcatttgaataacaaataaatcaataagaacaagataacaatggctagtcattctaacaacagttccggcaacatacaaagcaaaggaagaaacaatagctgacttctccacctactccaaagttgcactgcatgctacagtgtgaccaactattggtttgaaagaaaacttgtgtttgcaacaagacgatgaaaccacaattcgaagcagaaaaagtcttcaataggttcaatcaaggcatcttgtaatcctggtattgcattacaattcagtttaacaggtattttcaatttctatgatttaggataggctgatattctaggatgcagcaacagcagtactacctttgtaacagctgcatggagcttgaaaactaaagtaaagatgccaaagtatatgaacagagaaagttccataacattaaaaaaatgacaagcacaaaggagtaaaaggtactgaccagtagtcttcatcggtgaagtatatttgaacttcagaaagaacaggagagctaaactcttcctccatactgcggtacctacagacctagacagcagatatcacttactcaataactatcaggtatagttctacaatatttatcaatcatgatatttaaagtgagagataagaattagcatgttatgtcaaatagaaaattgaacacatgcattccagtggaggaaaataaatcaggagtggcatagtttaaaagggacaattgcacctcttgtacaatttaattcttttgaaacaagtgcaaaagcaatgatcagtactagctagtagctagtataccatacacatacaatcagctttgtctttatcaaatatatggaatatggatagggtacaaaatactacaaggttcttctcaattaaaactagttagatcaaatgattatcaagcacatcattgtagccatcccaaacaggtgttacaatgtatatttaaagaaagcagcttactctgagttttctagcatttttgcaaaatgtttttatgtatgcccgtgaaatagaatcagggtctctatcaattcgcttcaagatatcctttacatgatgctccaaggcaaggcagtcagattcagccttagcttggtaaatcttttgcaggctaacatagtacctgtaaggttataaaagagaaacagctgcattcatgtgatagaagaaaatagttcggcagaagttgactgaatctgagatcattgcaaagctagatgactgcagggcactaactcagtaagtgaagtcatatcaggtatcgtcccctcaagaggtagctcaccgttgccctcatttgcaataaattcctgtaagtagcaagcgagagaaagaaatccaaattgagacatgaatgctaataaaaaacaataatttcaaccaaaaaaagaaagcataaagtatgagtaagtccatgttacacccctgaactctcaaagaaatttaataccctccaaaataatatcatatattcagaagctatatacgctttcttccggtggcactcaagagtcagactcactaccattggaaatgtcaatgctgtatttctttttcttgtttggatggtttagacaactaagcaagctaaccttttgaattatacccatgatgttactgtcgatatagcaaaagaacagagttttttttaatcagaaagaacaccttgagttggattcatgccagcaactgcggctcctccaaaaacactttgggttgaaaatttaccaggtttactaaatttttggtgctcgataatcaattttgtacttgtcagtgttcgatatatttcctgagaagttgaggtgcgtttagtagacttcttgctaagctgagggatgtaaaatggaaacattcctaaagggatatatggtgcaactttacagatggtaagtgtgaagatagttcataaacaacacattatttcaggctttttaatatacattcattatgaaagcagcttcagacacacaaagcttctagagcttttttgttctaaatgagcattctccagggagagaactcatatgcagctttagcataagtatcaaaattccaaagctacctgacatttgcttcaggttatatgaggcatctggctagagagaagattaaccttttggatctgacttgttattttagcccaaaaaataaaactagaactgggtgtctagatcatgcaggttcattgaatatcgcagagacacctcaactaacatatgattcacttttttaaaacaaagaatcattgaatagcgccgagagacctcaacaacatatgatacacttttttaaaaaagaaaagtatcattgaatattgctgacacctcaacaacgtatgatactttccaatttggtttcaacaacaaactttatcaagagtgcctggaacctcagataacagctcagtggtatggcatatcagacaatagaagttggcattccataattgtaaatcacaattataactaccttcaaagcagccactaaaacccagaaatctgaagaagatgaattcacttcagcggagctatcatcaattatctgacggatctcatcacctagaagaaattaaccactaattagaacttgcagttctgcacagaagctatgttatattgtgtacacgtgcatggctgcaggaacatacaacaagaatacaacagatatttataaataagttaaaatatttatgggttcaaaaagagactacggctgtgttcggtatccttagttcccaacacctcttcctcgtgttccgcgcgcacgcttttcaaactgctaaaccatgcgtttttttaaaaaaagcttctatacgaaagttgcttaaaaaatcatattaatccatttttgaaaaaaaaattacgtaatacttaattaatcatgtgttaatggaccgttctgttttccatgcgcaggataagtgttcccaaccctgatgtccgaacacagcctacatgtaagtacaagacccaggaggtgtttgttaacacataggccacattcattcattatgtaaactagagtgacaacttcaagttaattcaagtagtttttactagtggtatttaagaaaggaaatagtcaagcacacaaaattatgtctgcaagtaaaattatgctgatagaagaacatttaaaaataaacttactgatccctggagtaacagagactttatacgaggactccactgcttctttgtagttttcttcatctaaattaagcatatattctcgaatcagtgcctgaagaagatattagattagtcaataacctgacagtccccaaaacacattagcaaccactttttactgattggggcaacaacccaaaacacgtaccttgaattcatttttctcttgcctagtcgaaggtaagcgcccatcatgtgcatctgcccatttttctgcaagcctcacaaggataacaatgtagggagtgtgcttgtgcacaacaggatctttatcatttatatcaattgactttgcaaatctgaaaaacataagcattaagatcaacagtgatttcatctagaatgagaaaaggatcatgcaacttgctatgccaacatgtaggtacaaataactcttactgcttgagttcaacccatggattgtgaaggcgtaaatcatccaggaagtggtccggttttgattctataacattgtgctcctgctcaatagttagggaaacagttttcagtctggtgaaaatgctttggctcatgactactgtggaaatgaaaaccgccaagcaacattaataagtcctaaataatgaggtcaggaaacaagatgcagtccaccgctaaaagtcaaataaagaacaactcagaaactcttgcacagatcaataaaggtaccttaacgctgatcctgactagaccagttagaccatatgaacgtgcagcaaccaacacaatatttgctttcctgcagatatcatctagtttcagtaaagatctctctggaagctgcagtagaaaaaactgggtatcagcaaaatttggccgcgagaggaaaaactacgtgcacattgttcctaacaatccatgtgtagtaaatagctaaaataataaaagtttgactgtccacactaaaaaagcatctcttactagagggagtatatctatgaatatctaatgcgcctgtgcgattataaaaacttgccaattctcatttccttgacttttaaatcttcttgttaaatgttctggctacgcagagaagtcaagaaaatcaatcactgattttgcatcttaccataagagtaaacacacacctgagtagcaatgactacggtaaattgggaaaagaatgaagggtttgtgtctatgagagccagaggagactcctcgacaaacttggcatttacagcatcattcagctcttgcaggaacgaacatacagattttgctcttgattgccccaagcattctgcatccactgaacataaacagagtactcggaacatgagttccattgctttactggaaatttatcgaaatggaacaggaataaacgcggagcacagaaattacacaggaaattgtttcccatgtcagattgttcaactttggaaccatcaacaacagtaacactccctactcctccaagcacaaggttcttcatcgcttcagttcctgtagggccacaggtaagcaagcatatgctagccttctccagtgcagcctgtccttgatcaccccatatcctgtactttgcattaacagaatcataacaggtagtttttagtatgtgggttgcttcttcctactcggatgcaaaataagcagagaataagaagaatacacaagtcgcaggctggaaaaatgaaggtcaaattttataaagtaaaactgaactgtgctatttatatatgcaactgaactacccatgtgaagcacaactacagctcagataatcagatgcacataagaaaacacccaattaagccacagactagaccaccaacaccaattatggacccctaacataatccactagggtcttagtaatcagcaaagtgctatcagtcggtatccccaactacatgtgaacaacgtaaacaatatttcaaccaaccaagctccaatgcatgaccggcagcgttcgaaacaatttctgtcagagaaaatccctccagctcttgaccacccgtcacccgaacagaaggagctccaaaaccctagatcagagaccgcgcccactcgaaccgcacccgaacagcggtgccggaattccaccaccgcgaagagccctaaaccctaggatcgaacggcaagcgcccggaatctacccgtcggagatgagagagcgcagatgcgcgccggttgcgttacctgagctggcgatcgtacttggtcttgggctccgcgaaggcggcggcggtggcggcggccatggcttccggcggcggcgtggtctcctctccgcgtgtggagtgggctctgccgctcttccgaggttttgctttgcttcgccttcgccttctcctcctcctccctgagcgaggaataaagcggtctcaagctaagtggaggcggagcaaggagaaggggatcgtgggctttggaggccaatgacatgggcctaatcgtacgccccaatattgtagctacttgggcctattgggccgatccagtttagttagcatctaccatctctacaccaactaaacaactgcacttgccataaacaagtgggattagcgacatgatcttacttgtttgacttaaagtgttattagtggaagataattaaggattaggaaggttcgttagtcgttgggggagacgaccagacatggctagattcattgtaccaattgggccattaccagacagcagtacagcacgatactactgaataagcgttgctggatattgaagatatacgcaattggagctcttgctctgattggttccacgcaaggagaaaactacacataatagctccgcttttgaattttaatttgagctaattagtcatggcttacgatcgattgagtcgaacatttacgtgctgtcctttctttctcagcactcttttctttttaataaacagtgcataaacttaacctggttttcaatttgaactaactgctcgattatggcttacagttaaggttgatcggttcagccattaaggtgatctttttttcgccatttcttgtttattaaactggatcaatgaggtggttgcagatgcttatagttgaaaaacggatttcagcgcttgttaaatgttaattatgcgagtccaaactcaaaagtcagaattgttagacagtaccaattcggaaattagtgagtcaaatgatataaaataatccacctcgaccaaacatgagaagttcagcttgcaaaattaacaattcattgctctatgatgaagtttatccgactaataactactcctaactagataagataaacaccaatattttactaaacagcaacatagctagtaattaaaaacaaatttgatttccttgctgaaagaaaaatacatcaacccccggaatgccgcggttacacgccaatgctctatttgatttttaaccatgcaacaaactgagattgaaacagtacttaattagcactagcgtaatcaactaatcgttgtcaatgtacacgtgagctcgacttagattacatggctagcaaaccaacttttctctagtttaaaagtccatctttctgaaattttaatggaacaaccagtaacagaagtctacttgtacctagtttattattagtacaactagatgaagcagcaagtcaactagtagcgcacagccaaagtcgaacaccactcttcgttctcttcgcacccaagaaatccatttttgcgagcttggtcatcaccgaaatctcattggccatggaagaatcttatataaatagatggaacacctacctctcccacgatcgcaacgaattgaagcatttcgtctcgaggcgcggcacgatgaagaggctgacattcggcgcggaaccggagatggtggacagcgcaagcatagctcaggaggtcatgctgctcctcgcgcggagcggcggcggcggcgccggctatgtcgtcggccacggcggcgaggctccgcgcgtcttcgagtgcaagacgtgcaggcgccggttcccgtcgttccaggcgctcggcggccaccgcgcgagccacaagcggccgcggggtggtggcggtggtggcgcggccgccgccgtagccgccgcggcgggcgagggggaggcgggtgtcgcgctctcgctcgcggcggggacgccggccgtgaaggcctcacgcgcgcacgggtgcgcggtgtgcggcgtggagttcgcgctcgggcaggcgctcggcggccacatgcggcggcaccgcatcgccggcgccgaggccgacgaggcggtgagcgcccgcggcggcgagccggcgcccgagcggaatccacgcgaggcgaggggtgtggttggcttggacctgaacgctgctcccgccgacgacacaggcctcctgctggtagactgcctgtaatggcattctgccctacctaaccatgtgatcgtttcttctttttatcgttttttttggttttgtaaatttgaaaaattggcagctgttctccaaaaaaacagtaggatcaatagttcaaaatacaacatgaatacgatttgattacagacttgtaattacagaattgtagtttgcctttcttgcatgaatcgtgcaagatcattctttctttgtaataaaataaaataaaataaatactatgggtgatactgggcttgcagcgggcatcggccaatagacaaattctggagttgattatgttatagttcgtggtcttcgatttcttctacgttctacgtgatcagtaacccagtgtcgcaagtaactgtagttgaacactgcagaaacgcaattaactacataaaaaaatttgcatacttctatgttatctactggctgtagcctcaacatcagcacagccaacccaattctatatgcgctcatcattatcaagagcaagagttactttccaccaatattcaaagtaattgttctcacttaacacccatttgtccaaatcaagacaattgcaataagttaaataacgcacaaagagagtagctgacaaagaatgaaatgataaaaattacaagcaccatttcaccaccattttatccatgtagtgagaacccttctaagatccacagcaagctgatttctgagccgccgctgcctcggcttccccttccgatttgatcttgatggttcggtcctgcaatcaaaagaacacaataaggaaaggcgttattgaaaaaaagtatgtcaaaccagttaattcatacctcaggcttggaatcagtctctgagagtctttgtttgatatctcttgctatagaaaagaaaacctgctcaacattcaggtttgtctttgcactctgcagtagtcataatgaaacgaaattatgcatgggattggctacagaggttcgggcatcaatgcttaggagaaagcaacatttattgtcaccaacaagttacgatgaaggaataccagaacagaagttgtgacttcgcactaaccgtttcaaagaacttgattccgtattcatcagcaagagcctgtccctttgaagtgggtacagcctgcacgaatgaaattcagccgatatgaataagagagctaagaaatattccaaacatacaatttgagaaggtcattgggaactgtaatggtaggtgcataatgtcgaacacgttttctattatgtttacgctttgacacaacataaatatatctagtgatgaccatgctagatggatcagagtaacaccacaggatgcaaatcttattcacgaaatgtttttcatactgcatatgaaactaaccattccagagcatgaaataaaaatgagatgacagaataaacatgtggaaacagctaagccaagtagattatacccttttgctttcatccatatcagctttgttccccaccaaaattttgttcacattatcagaggcatgttgttcgatgtttctgatccaatttcttatgtctgaaatccagcaacaatggaaatattcagaaatttttgagcttaagtactatatcaaacaaagcatctgaagtaaagtggtcaatactgttgaatgaagattcatcggtgacatcataaacgagtaaaatgcccattgctcccctgtagtaagctgaaacaatgaagcccatttcagaagcttgatcaatgcaattgccagaagcaaacttagctttgttgaaagtaaacaaacataccagtggtaatagttcgaaagcgttcttggccagcagtatcccagatttgcaatttaatccgtttaccatccaactcaacggtccttatcttgaagtcaatactgtttcagagaattcagtgaggacaatatataaggtgatgctatcattcagatgtttcctttggggactttttacaggacatacccaattgtggtaatgaaactagtcgtgaaagagccatctgagaaccgtaggaggagacaactttttcctacacctgtataatgtatataaaccttttaaatagaatgtacgtgccactaaacactgaaacatagtatgaatatcaagtaaggccacaaaaggaaatacaaatacaagaaaaaacattgatgtggaaacaaaatcaacatgagttaaagggctcccctaggtacacagaaccagacagatgctatttactcactccgcttcatattataagtcgctttgactttttttctagccaaacttccttaagtttgaccaagtctatagaaaaatttaacaatatctactgcaccaaattagtttcatcagaactaaaattaaatatattttgatagcatgtttgttttgtattgaaaatgttgttatatttttctataaacttggccaaacttaattaagtttgactaggaaaagaaaatcaaagtgacttatattatgaaacggaggtaccagtttcattttattgtcaaactagaagaccaccataccgtaaatatggaccaggccacataagcacaaggaagatagtttagttgaactctgcttgcaaagctgctagtgagtgggaaggaaatgttattgtatgatttttacacatatcctcaaatatttactctttcaaggatgaaaatgaacaatgctttcacatagtagaaaacaaacagcatgattacagaaaccctttagtaaacttttatgtggtacaaatattattcgagcctcaaaatactgtggtgggagggctgggctgggtgaaaatatcatagaatatacttggagcctaagcctgcgcaaaattctaaaacatatgaatctcagcagctcccaggcctgagacgaaccacagccttgaacttggcttgcctcaacggctaaaaaaaacacagagcgaggttccaacagtgcacgtcaggtcatcaggtgaaagtgttgaaaccattgtcagttctcttataatgacttaatgagaacccttacaacaaacaaaagtaaccacaacagctacttacaggcgttagtttcaccaataaactattcatgacttcatatggcgatcaatctaacaataccagcattttaatgtgtgtctcagtttgagaatatatcaggtcataatcacatgattgtcgcaagcaggaacagaatcgctattacaaaacacttatgcgtagaaaactgaaacaattgttgccaacggtttcgcatgcttcgattcattcacccattcaaatttcacacacacacacaaaaaaaaatccccacaaactgatccagataacagatcccgctcgaatcctcggatcaaacgaaacaacacacttcacgccggaggaaccagatctcgcgcgcgtagatcgagggagtgagagagagaggaggggcccgcggttactcaccgctgtcgccaatgaggagcagcttgatgagataatcgtagtcggcccgagccctagccggcggcgccgccatcgctaccaatcaatcccccaagccctaacacacaatcaacatcgatcagatcggatcaagcaacgaaacagcaagccgaaaacgagcaatggcgagccgcaataccgtggtacacgcgcggcgggggggcgcggccgtccgaggcggcggcggcggcggcggcgatctcctccggcgtcgtctccccctcacgagcagcggcagcgcaggcggcgagttgcgtgggggaggggaggagattcgcgaggcggagagggggatcgaagcaccgcgccagcctgggttgggtggtcgtctacttgggttgggttggctcggtcggaagcgtcgtggtggaaccggtccactcgtctgacttttcacaggtgtcgcgcgcgtgcgcccgactgggtcctaggcccggcccattcaggcccattaggataagggcccagtgcgaagaacgaggcctgaatgctgtgtgggctgtctggcccgatgaaacatgatggattttagtttttttatttcaaaaatgaattcggattttttgttcaactaaatgccaaaccatgtgtggatttgagcaaataaacattttagacatagaaaatctccacttgtcaggggggccgaaactatttaaatttcgcggcgcgcgagtaggtctgcggtcgcggtcgatagtcgacttaatttgcttatcagcaaacgttgcgcgctttgcgtaagcactgtctttatcctagtgaaccacaacacgaaatttcaagtcttctcgattacgccatttgcaattcgaatttcgaaatatttagacttacagttttgatgtctgtcccgcgcatttttcggtgcaaatgcagctaaccaacaaatatctagcatattcggtgtgttgtctttcatgcttgcttgctgtcacgccccgaactagtaccgaccggaactagcccgtgacgctccaatttaacctgttaatcgataccagtcccaggacacagtgctgatatcacaggaagacagattatcacagcaacagaggtctctttattatagagtagatgtacagtcatgttgggctgcggacagatcccgatctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactgggggggattatttatatagagcaagggtgagtacggggagtactcagcaagccaagggaaataagtgtttaatgcaggcttcaaggaaaggccgttgtttttgcaattgattttagttgaactcttttctgaaaacaactaagtgagtgcttctcaaacgacacggttgtgacagtgcgtctcgtccggtcggagtatgtgcaatgtatcagtctttagaattgaaacaaggttggcacccggccaacagcttttcaaacggccacccgggccaacaactttttaaacggccacccgggccaacaaccttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccacaccggcgaatccacatgtctctcgacatcaaggctcccctgataagctagttactcaaccaggggtgtcccattccacccatgtggtcttacttgtcttatgtttggatgaaattccaaggaatcggtccttaagtgcgagagcgggaaaaccgtacacccggtacgttccccggtccgcggttttggaaattcatttagttcacaagcaccgacccaggtgtcgggttttccaagtcttttgtaaaactcaagttttacccaagaagttgctcagattttaaatttgaaggcgcccttcggtactcgcacagattgcacgatttccgaggcgcaactgggtggttacaagggaacatggtataacaattaacaaaggaaggatcaaatgcaacaaactaggtagatccgccaatctgccttgcagacgggacaacagattaagtgcgatcctatcaatgcataatattttgcaagcaacataattaaatttcaagtataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccatttgatagatctcgagatttgaggaattttggaagttgaacggagtcaaacggatctacggttggaagatattgaatttctaagattattggatttttggtctaaaggaaaaggatttaattaaatcctttttggaaaagaaaaagaaaataaaagggaaagagggagggattatagacttctcctcgggcggctagggcgtggcccaagggaaaaggagcggaccggccgagctaaatgggccggccggcccaaggcggcccaagtgcgcgcgcgcgggaggggaggagagagagggccggtggaccgggctcaccgtgcgcggtcccgggtgggacccgcttgtcagcggttcggctcaccgtgcggagggagcacgcggcgcatgcgcgcgggcgggggagggacgcggtgcacgcgcgcggtctgcggaggaacggatgcggtgggcccacgcgcagcctcacggctcgcggtggaacgcgcgcacgggaggggctgaccggggtcggcccgtcccgacctcggctgagctggcgcctacgtggctgccacgcgggccggtgggaggtagacgacgacgccggccggaacggacggcggacaacagcggcgagcggcggagcgaaccacggcaataccggcgaaagcgagcacaccgggtggttgcacgagacgaggggagacgagccaacggctcggattcgccggaggaaacttgacggcggcgaatcgcggcggcggcaaccggcggggagggaagagggaaacggcgacgaggtcacgaggggccgattcccggcggtgagagcatctacgcggccacgggaatccgatgctagcgtcggattgggcggagctacgccgagcgaggctggcgacgagcgggtgctacggagctcgtgcggcgacggcggcgagcacacggcgggcgacggcaacggtcggggcggcgccggctagctacggggaggctactcgtgctaccaccgaaaactaaggggggagatggagcgaggaggaagaacggagggaggcatcaccgaggtgaggaggggcgctatgacgagaggccgacggcgcgggagggatctctccggcctcgggccggggaagaggaggaagacgagcgcccggagtccccttccgcgtcctagtgcgcaccggctcctccggcacacacgcgacggctgcggtcggcgagagggacggcaatggcgcgggcgagaaacagggaagagtgggagaaaagggaagggagggcgtctgggtttatagggggcggcaat

SEQ ID NO: 69284 - DNA, 22857 bp, Oryza sativa
cgacggtcggcgcgaaggaaggaaacggcggcgacgaccggcgatgctgaggtgcggacgggcggcggcggcacgctaggagaaaacagagaggggttaggggtagggagagcgaccacggcggctagagcggccggccggagttgggtggaaatggagagctcaccggcgtgcgagagaaacggcgcttcggcgacgattggcggcaaccgaatggtggccgaggtgcaggcgggctcggtgagcgtgacggtggcgactacgcggcgcggcggtgactctagcggcggcggcgcgcggccggagatgggcggtgggcggcggagctcgggtgcgcggcgcgagggcggtagacggcacgggagagtgcggtgaaaagaggaaaaagcgatagaaggacgcggggaacgatttataggcggagggggaggcggacgtggccgggaacccaccctattgcgccggcgacgtgggaaggtggggggagagagagaggggtgggattcaaattcgaatcccgcccatttgcggggcgcgcgagggcgggagacgcgggggagaggcggcgacgtgggcgcagcgcgcggggtggggtggagtgggcgcgggaaacgcggacggcgacgtgggagcggcggttgccggccgagcgcggtcggctggaggaaggggacgacctgacaggtgggccccacctgtcagcgtcccggagagaggggaaggggaacgggccggcccaaagaaaggaggccgagcgcgggagggagtgggccgacggcccaatagagaaaaaagaaggaaaagaaaaagaaaaggaagaaaggatttttcctgggattaaaaattgcactttggtgatttttaattggttaaaattattcccaaggctctgaaaattccactaaaaatcttgttaatgcattggagcatggggaactcaagaaaaattccaccacgccgaattcaattattaatcgcatttattaactagggaattagctctaggttaattaagataatttcttcggacgatttatttaaccaatttttaaagcaagcaaaagggggaaaacttcagggcgtgacagccggtgcggtaaacggaggtgggagcgacgaactctgggggagagctggagttttctggcgttgtcgtcacgagacgaggaggcggcggcacgagacgaggagggtgtgcgtggcggatgggtgctcaccgggactgcggtggaagtagcaagacagacgacggcggcgcccccctgcttagttcacgggatggagatcggcgcagcctactcaacccgccgtcggtctcggctcctcgcccgccgcccgcagcttccttcgcatctgcctgccgccggcctcggctcctcgcccgccgcccgcagcctcctccgtgcccaccggccgtctcctctattcacctggagagagagagagagagagatgggcagagaaggagagaaaaaaggcgctgacaggtgggccccaccagtttttatttgtttttgctgattgtatcgccacgtatgtgtctacgtaggctgaaaaccgcttccaatcgagttagggtggtaatttatccggttttaagagtttggggtgtcaaatgttcgtacttttttctttgagaaactatgcatcaacccgtgtatcgacgtgtgctacatactcatttcgtcttaaaatacttgtttttatttaaatttgttccaaaataaatatcacacaatcaccttctgtttaaaattttcacattctacccgcaaccaccactgcgacatgccatattcccttgtatggtttataagagttgtgtgctcatatttagtaccacatagctagtttagtatgggtgggatctaggggtgaaaacgtgtcgcgaccgagaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctctatcttcacaggcgctcaactggggtataagccaggactccacctaagacatcttctccgaagcttctcttactgaagggggggaaagattgagcaagaatgagtacaaccacagtactcagcaagtcacaccggcagatgcatgattaatgcaagggggtacaaggggttaataataggggttaagttttgcagtaaacagcatttaaaagtcacttagttgcccaaagccattttaaaaagacgatcctagagctacacagtattattaatcaaggtcgtgaacccgcacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtatccacgtgccacataccaccacggtatacggacggaagacgtgacatagttcccaacccatcctagccataaacaagagtaccgacccaaccacacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagctacaaactaagccttacccactagacatgtggaagtatggtagtgctttgcaacagaggcccgagcttaatccttatagtacccgaggtacgactaacaaaacccaaccacgcacctcgagcccagcctaaaaccattttgggagttttgaatagagggggaggtgtgtgtccaattccacaataagccaaccattccatactgtccaaatgatatgagaattcccaaagtctaaagttataaaaccacctaatgttgcctaattaatcagcgaagcatctacctaaattcataatagtagaaccatgaacagagtacccactagttggggttttgtttatcctagggtgaacaaggtaataataacaataacaacaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgagaacctccggaacgacagaagctacgcgaagcacacaagcaaagccacaagcctataaagaagcaataacaatacataaaaagaaaccacacggttctttaggttataacaaacattaggagacttgaacgggtcgattcagagttcgtatgaccaagatatgatcatccgaagtttaatgctgttatatggagatttgcggattattataattaggctttgcgactataaaacatgtggaagcgctagccgggaaaagacaggaaggctgcgctgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacatgggttgcacacgtggaaacaacgcggctaccaagcgggcacactaacacggacactacacggacaagcgaacgactaccgataccgatacacggataccggggccgacaaccgcacaacgggcacgggcgacaccgaaaggacgaggacggggcagcgaaggagggatccttaccaccacgcgacgaggcgagggaacgacaacgacgaacgggcgcggcggagacagcccggaacgacggagacgaacggcgaggggacgacttcggtggcgatccttggacgaaggcgagacgcggccggcacgaggcttgacgacgcggagccgaggacgaagacgacgacgggggctgcagcgaccttgacgaaacaccgaggacggacgaggagggctcgacggagggacgaacgccacgacgaccgggaacgacgagaggacgacgacgacgacgaccggggccggcgaggaggcgacgagggcagccggcagtggttgcacggagacgaggatggcgtggaacacgccactgcgaatccgatgacggaggcggcgccgcgagacgacgagccggcgaggaggaacgatcacgacgacgacgaacaccggcggggttcggtcgaaggggaggcgaggccgagggcgaccttgccgctgcgatgccggaggagatggcgacgtcggccggcgcactggcacagcgaaaggggctgccggagtgggtgccgacgagaccgagggagaggcggcgcgcacgacggcgttccgacgaaatacgggcgacgccgtggcttggccggggaagaggatggcgttccggtgcagggagaggtggtggcgacgtcggccggcgcacaggggacgcggcagaggcggccggaggcggaacagcggcggcaacgccactgttgccggcggggatgcacttccggaggtcttcgcgggaaatagagggcaggccggggtggagggcgacgcggtgacgtcgagggaggatggcgacgacgacggctgccgcaccgacgagggacgaggaacagtagccggctggagggagtacagtggcaccaatgccactggttgccggcgggggcaccgttccggcgagtttccggcgaggagacggtgaggccggtgaaggggacggtgttgcagagccgagggaggcgacggcacagccggacggcgcgcgggcgaggcgggagaggcggctggaggcgggcggcggtcggagagagagaaggggaaggcggggagaggtggtgcggccacgggatgacgcgggaggaggctaaaacgatagaacgcaaagaggtggttccattttataggcgcgggatgggagccggccacgggagagggcggaacggcggcggaaaagacggccggcggccatggaaggcggccgggaatggcgcggccgttccgggcgttagagggcacgaatcaagggggaaaatgggggaaatcaaagaggatggaaaggggattaaaagcccccacttaatttggaaataagggaattgatttgcgcggatttgaggaaggaagaaactagggttcacgggagagagagagaagctgggcgggaggaggacgacgaccgggcggtaggacccacgcgcggcgcgcggtcagcgcgcggcaacggcgcgcacgcgcgcgcacgtgcacggcacgggcgggagggcgccgctcgagttgggcccggaggcggcccaggtgggagggggcggggaggcttgggccgagaggcggcccaggaggagaggagggcgaggaggcccgggagagagaggggaggggagggagctgggccgggagggggagggaaggcccaagaggagggagagaaggagagggagagaaagagagggaggaagagaggactttggccgcgggccgagagagagagagaggactttgggccagacttggcccaaagggaaagagagggttatttctaggttttctttttaataaactttgataattgtttttgttgcttaataaatatttccggtgctctgaaaattcaagtaaaatttgagagctccttttagaccaaggagaatttaacaaaaattctccgggccacattcgaatttttcttgtacgtattttagtgcttgccaatttcttttcgaattttaattaattctattattccttttagggaatgatttttatttcgggatgaatttatcaggacgtgacaaaacggatcggatattatccaatccgatccgctccaaatccgttcgaagtgaggatatggtatgggtttttagttatccgacggatatggtaagggtttttagctatccgacgaatatggatgcggatgtggatagtgacgtgcggatgaggatatggtatcgataatatccggtggatacggattatccgctattttaagcggattatccgatgaacgttttggcggataatccgaatttcgtagcccatataaccactcaatttggcccatttggcatgagcattttagtcgtgtaaaaatctagcccatccagatccaacctatccatcgatcaatctagctaggtcataaaaccttcagtccgtcatagtagagtacgctgccatcacccattgcaattttttcttcgactcttcttcctgtcctaccacaccgccgcctcctccaccccggctctgcggcctaccatctccaccccgctgtcaccacctgccatctccattccaccacagggccgccgcctgtggctggttgtctccgtctcggtgccggcgacgcctccaatgttctatcacctatgtatgtgatacctatgtcatgtgatactttgatgttggtactgtatttttaatttgtggaacttctatatctgttatctgaatgagatatatcttgatgttggtactacatgcgtcaattgaatgcatttggacagatgacaagttaatcgttaacaacttaacattatattgtgatgtgatgtgtgctttcatgaaccatgtgaattgtgatattggtaccgtattgttgctcattgtatagatgaataaatattgtatcgattgtatatatatgccacatccgattattttcatccatttccgaaccgagtccgcactagctccacaccattttcgacatctgaaacaatccgctccgcatccgcacattatccaaatcacctccgaatccatttaaaaaaatatgatataggatatgatataactactatccatcagaataagatccgttttcacccctagtggaatcaacttataaggtattgtccttcaaaccataccactcatgggttcacccttttacatgaaacgggaacggaattgtaagtggggtggaatatttaagtgggcccattcatctaatgagctgagctgccagttttggagaatgggctgttacaaatggtattagaaccgaccctcgcagttgtgcgcgtgtatgggacagtgcgcgggagaatggcacacgtgggctctatgtgagacatgtagcatcggcactggacgtatggacgcacactaaaaggagacgtgttcctagatatttgcctatttgcctatgtggctacatggataagttagaccgacgagaacgtcggatcctttgaggggaaaggggtgaatgtgacatccggactaatttcgatggtccatgtgtgacccatgatagctacgtgctcatttttagtaccacatagctagtttagcaagagtgtaaaaaacttataaggtcttctcgctcttaccgtaaaactcccgtgttgatcctttcacatgaagttaaaccgatgagaacgtcggatcgtttgaggggaaatgggtgaatgtgacatccgaactaatttggatggcccatgtgtgacccatgatagctacatgctcatttttaataccacatagctagtttagcaagagagcaaaagcttataaggttttctcgctctaaccgtaacactccgtgttgatcctttcacatgaagttagaccaacgagaacgttggatccttttaggggaaaggggtgaatgtgacatccggattaatttggatggcccatgtgtgacccatgatagctatgtgctcatttttaataccacatagctagtttagcaagagtgcaaaaaacttataaggtcttcttactctaactgtaacactcccgtgttgaccctttcacatgaagttagagcgaaaatgtaagtgggtggtatgtataaatgggcccatccatcggatgggctaaactgcacggttctagagggaggggtattacaaccactcacagtcccaaccatacaacatttaataggagtcctatattttttttctaaaccttaatatatgctaaataacccagaaacaattattttagaacggagtattgtaaccctagataccactacacgatgtgcatgcacctgttagtactcccttcattcacttttgatcaccatataagagaagtgcatcaagaccaaggaaacaaaaatcattctaaagacctatattccatttactgtgcatcggtgaaggtgcgttgtcgcttcaatggaagagtaaatgaaatagatggatggagtatatataagcctagagaatctgaagcagctcacatggcatgcaaatggttgcatgcatgcatgcacacacatatgcccccatttacttctaaaaggaccttatgtcacctagagagggtgaataggcgtttaaaacttttaagtaagttcgaaagctaggcttttcggatatttctaaatatttttggatatttccaaatattttccgattttttttttgaaaatctcatatttacaagcaaactagcaaggcaagcaaaaggggatagtggcacaattaggaaagggattgcacaaacaacaactaaactactagaggcaccaaataacaaagctagatgagcgagagagagatatcaccggggttcttataagatgttgtgttcccgaagttcaaatccctgaggggggttctactctccgttgaggagcccacaatgagccaggtcttttccagttctatcctcatgaggttgcacaaatgcacttcgccttccactaagggtatctctttcctttcggaggtgcgatccgaccttcacaaactccctcggcacactacaaacaaatcggtgtctcgaggttgactctagccgtctataggtgtcctccaccaccaagagtaacaaatgcaaaaaagatttcttggggataaatctcaacaaatatttacaaagttaacaacaagcactcaaacaaactaaaatcaaccactcacacacacatgtacactcacgaaatctaagcttgtagattggtggagaggaagaagtgagaaaggcaaggctcaaaagtggatctcaaggctcaaaagggcaaaagatttggaatggaaccagccaccttaacttggggggtggagggggctatttgtagccacggcctcagatttgtccgatgggagcaaatattccattttttagaaatttctgaagtgatttttgaaatattcgaaaatcaccagagagcaaaaacaactttcaaaacttgctacaataactttggaattttccgaacagtacaaaattccagcacgagcacagcagaaaactgggcaaaaaagcatttcggaaaaaaatctgaaaacacccgtactgattttgcgccaacactgcatttcgagaatttctgaagcaattttcaaaaattccgaaaaacaccagtaccgtttttgtaaactcgaagtagttcgggaatttccaaaatgacttttgagaacttctaacaaagaccattaccatttttcgaaggcaaaaaccaattcgggaacttcctaaatcaaatttagaaaactccagtacacaaacccaagagtgagaaccacttcaacaaagattttgagctccaaactcatcactagacatcaaggccacgttcctcttaatagtatggctttcctaccaaatcaagaacaaattgaaaagctataccaatacgaatacatttatgtcttcttgtttctttgccttgaacaatgctaatacaaaatttgacttgatcatcaacgaatcatatcctcttgatctttcgacatttcatcttgcacttcttcttcaacaaggattgatcgtcagcaacttgtgacatcctatggcctcgatcggttcaacggtattcggccaagcacttgctccttcaccactacgtcaggtcctttggcgccaagtctccgcttgcccttctcctatgcatggtccatcagtccactacgtagccaagtcttaccaacccttcaccacatctagccatcttccgtcacttgtggccttggattgcaatgaaaactcattgtattgcatattctttatcatctttatcagttcttcaccagactaatcctttgcttatacactcaataagcacactattcccctaatcgtttgtcatcaattaaccaaaacccactaggggcatagatgctctttcaatctcccccattttggtgattgatgacaacatgattaaagcttacaaagattgataataaatgattttgaatccaaagagctcccctcaatttgtgcatacaaatatatgaagtgaactcatatgcatatatattttagaatgtgagagctccctctaactcttggcgttagtggggtgtgttgtgtgtgacaagagataccaaaagtaaaaaaacttacaattcaaattcttggtatcgattcaaaatgtatcaaatgaaattcttgatgttgattgcaggcaaaagtttgaaaacatattgttcatttttttctcagaaatatccagaaagtattttttttgatagaattataatgttgatacgctgaaccattgcacgagaataacgtgcacggggaagacgcgagaccgagcagtctcgcgcggatacacagcgacaatgcggccaacatagcgacaacgaccgcggccaaaacattgattaattaatagtaattaatgattaattatcttattagaaaaaattaattaatcgctaattagataattaatcactaattaatcaatttgaattgacctgctgttgtggtctcgcttgttggttatgcgagaccaagcggtctcgcaacttcactgcacggtctcgcgccgttgtcgcgcgagacttcccgcgtcgtcatgtccacgtcattctcgcgcaatgattcaatgattcggtggtatatttctactaaaaatattgcatatggaatatttctaagaaaaaattgaatgaacactatattttcaaatttcattcgctgattgcaaaaacttgattctatgccaattgattccggtaccaatttataaagcacgaataaccaaatttcataatcaatttcaagtataaatatataatttcatttgcatgtggcatggtgatcaaataatacgcattgaatccatcacaccatgcgcacgctaattgataaacattttcaaatattctctctccctttctcatttaccctttggcatctttcaaagcatgcattttgataatttctcacaattatctcaccctttataataattctttataccctttaatatacttctccccctttgacatctaaaaactaaggcataagtaaggaaaggaaagcaaagggataattgatgaggaatcatcgagtattttcctctcaattttatatttcatcacttgtgattaggtaatgaacatcaaattgacacaaagatcacaagtaaatcaataagcattgagatacaaattttgcacataaaaagctcacatccaaagggtttaaatcatagaacaaaaagtctcccctttgcatgtcaaggacattcttattttcttcatttaatgtatccctcccccttagttctcctctcccactttggcatttaagcatggcaagaagagcatatgatatataatgatgggggatcatcgagatttgaacatgccaaaccacttcttcacaaacttgagtgagattcaagagttttaaaaagaacaactcacacaaattttcacaaagcatatcgcaaacggatttagtatacatgaatcccaaagattttgctaagtgttgatggctgttaagtaccaaattttcgccatcaatagctgcattaaaccataaatataaaacatccaacatagtggtaggatttatttctaataatttccacgagtgttggtgtatattcatatgtaggtgacaaactatctaagttgagaagaaatatacatgaaggaggatgagaatcaaactcgcatccgaacttatggagttttggacccaaaaacccaattaaacacctccaaatgggccaaacatccataccaatagaatgaggggcccaaaatgagtgtccaagccgaaaattggggccaacggagccggctagggatcgaccgaactctgagttctgccgaaccttgacagaggccactggcccaagcccaggttgcgttcagtagaaaaccgcttcccaatgctctttggaaaatggccgttttcactagtagaaactgtcataagcatggacacttggcaacacaagagagaagatgctctttggatgcttggaggatctccactctctcaagttacctccacactataaatacctctctcctccctcattcacaacacacttgaagcttgagcttaattacaagaggctttattctactttattgtatactagattagggagaggtggagtagaggaagtcggaggaattccagagttgtcgataatcctcttcttatttattttactctggcaattactctactttaatcaaatatcattctgaggaattaagatttattctatgagagttacctcttagttagttcctaatcaacgtatgggatcattgttcattatagtccattaaaatatagtgattgctttagtgagttataaacattaaagtagttattaacggtgtagacatggtgtttgggtagttaatttccttcgtatcccatagtaggtttgaggtaggtgaagaggtggtggcaacctgttaacaaccaaatttgacctgcactggagttaagcagatctctcaggcctcgtgtttttacatcaacacaaccctaagtacactaaagtcctccctacccggttacgctgtagagccatatctgggagcagcgggctggccagcgcctgaagtaccatgttaggattaaattaagctttctgtagacactgtctctcgctagtaaatcctctcttagcctatcttagctttgtgtccttggataaacctggagaagagctgacatacatgttcatcggtatcttccgtgctgacatacacattccctgtgaaaatcgatgccttggaatactctagagtgaagtgctgtattgatatcttccgtgcgcttgtggattctatttgtgacgttaagaaatatataccaacactaagacaaaattcacatagctagaataaggtctccgagtactttgattcccatagacaccattttgtgactaatactcgcttattgattgaacaagcatttcggtacaacattttgtaaactaggctaattagaaagaaatgaaacttagtctagatgcacaaagataaggcaagttattcaatcataccgatttaattaacaagttttagattatccgattaccttccttgacgattttcaagatgtcctctcaatgaaattgataccttatttcaattgaatttgacacccattgtcacacacaagacttgcatatttatatctcttcctatctccattttttaagtgccagttctttacatatttttcatattcgtaactaagtaggaactaacaaattctgctatttttggatttttttttacttttttgcgcgagaatttatgagtgccaacaaatacacgggacctatttcatcatgcatcgacgaactcatgcaagcacggagggtggattttaaactgttatttgcatgttactcaaatagttatgaaaaaaattgagaaagatgtattaatatgttatatgtcacttcacaatcatgtaagtttaaatttaacttatacatatcgcaacgaaaaaaataaattaaactacggctagttaacgtatattcacagtcaaatttggttttttagttgtgacacgtagaagttgaattttaacttttatgtttgtggagtgatatatatcacatgttgataaattttttaaattacttcagattttcttatattaatgacatataaacaatgagatggcatcccctcgagcgtttagaatagttacgtgtaagtacgcgacaatgggttctctcgtgcatacacgtcaggactccggacatgaacccaccaccattagcatctgacagataccccactgaagaaaacaaagatcaatttgtcacgatgtactcattggctgcacgcgattaattatggttgttttagaacatcattaaggagaaactaatacagccaaaaccatacgcctctcaaagatgcctctgaacgatacctcaatgcttatctccatctacactgttggacggttcacaagcctatttaaccagcaacgcttggcacactacgatcaactgcgagagtgaggcaaagaggaagtcagggaacggaagggttgagatggagatcagcacagtgctgggcgcaatattggcagagtacgcggtcaccttggtggccatggctgtgggtttcctggtggtaggctacttgtacgagccatactggaaagtgcggcacgtgccaggtcccgtgcccctgccgctcatcggccacctccacctgctcgccatgcacgggccggacgtgttctcagtgctcacgaggaagtacggccccatcttcaggtaactggcttctctgcttgctgcttcttctgtttctttaatgcagagctcagagatgacgaggataccagggtctattgctaactggatctagtttactttgcttgtaggtttcacatgggaaggcaaccgttggtcatggtggcggatgctgagttgtgcaaggaagtgggcgtgaagaaattcaagaacttccctaaccgaagtatgccctcacccattaccaattctcctgttcatcagaagggcctattcttcacaaggtagtagcaactagcagttgattgctttactttctttatttcgcgcaattttacctgaagctaaatttaaatagatttgatatacatccctcacttctacatccaaaagaaaaatatatatgtatacatgtttttattgcatgaaagatacacatatactatgaatgcgcatccttaagtacgtatagtacatatttatttcactaaatttctactaaaatcttacccacatgtttatagacactggtatttaaatcctagtgtacggacccatacacacatgatccaccacaatacctctcgggcctccccatttgcgagtatattttgtataaaactatatttaccaatttacacagttattataatttgacccaactcgattaagtgatatttgtagttctctttttctaaggataacatgatacctttttatatgtctggagcgaacttgttggattttcttcatatatactctcttataataaagaccagagaactttatccataacttttcttggagctaaattaaaagtagaattaaattttactagttgtatgttgcacatgctagtattcttaatgttataaatattaaaataaatatattggttatatttttgaattctgtctgtttagttagatttataaaagtcagctccagttataaaatgctattttaaatttgaatttcggaattgaattgacaaaataaatttattaactgtaaattcgaaattattaaaatttagaaaaataaatttaaagagcctgtagtatttttgtttgattcctttgagcgtgatcggccataacccattagttatatggaggggcaattttctatttgactctgttctaaagcccaattaataatttgaccccactttttcaagtttgtacatttaaccctttttcaaaatcgaagattaagacttaccctattccgtgaaaacaagataaaagtgttagctaagagataaattgttctttttgcccttgctcatttgaccataactgcataaaagctttttttattcaaacctttgacaaacttgtaataaattagcattgctttgacagatttggcttcaaactgacaaatttgacgtcaatttggcaaaaataaaattaacaaaatctcacataactatgaatgaaattttacaagattttcacatcatattgttttttccatcccaaattgaaaaaaaaacacagataaagcaaaatacagataaccatgccactatcgcccctcttccgtgcaccaccatcgtaacccctgctccccgcgtgtcgccacgatcgccaccgccatcgctctctccgcaagccgtcgtgacctccactccggcgcttccactgcgtgtcgtcgctcctgctctctctgcgcgatgctatagcttctccctccgcgcgccgccaccgctacctccacacaccaccgctcctaccacgtgccgccacctccacctcctcatgctgtcattgtcgccgccgccacctcacgatgttgttgccactgctccctcctcgtgccaccaccacccatgctcccatctcacgcgtgccgccaccccttctctctctgcgcgccgccgtcactgccatccctgctccctcctcacaatgccagccttgctctctccgcactgataccgtcatccatgctagtctccgaagatgaatggatgagaagaaattggggataggattattgtgttcttagggatatttgtaagtccagcacataaatgcattttttttttgttttttctaacatggtcaaacggtaatcccaatttttaaaaacagggccaaataaataagagtcactgatagttagacttcgaaatagagtcaaattagtaattgtcccttatttgaaatgcataatgttccattgaacttttacaaattattaggcctataatttttttacaagaaaagagagaatatgtcttagaatacattcaagaacatatgtcttagaaaccattctattttttcatagcaatatgcaatggaggtacatatgccatatagtagagccataaaaaggttttattaccctcgcaaaaatgtaaaatggttttattacactattgtttgtgtcaggtaggcactgaagagttctgatgtaaagatctagcaagggtaaaaggtccatcaatgtttaaatatttaaatagtactctctctctctccgttttatattataagttttcctatgtcatatttttaagtttaattattttttaaaaaatataatatttttaacattttatgttaaaaataaatatactataaaaatatattgaatgatggatgttactgtatatttttataggggcattttataatatggtcgaacttaatgatatttggcataagataaaactcaaatgatcactcgaagaagtaaaagtgttcgtgcatgcacaccgtaccgggccagcttccatccttggttagtagttaattactgttggaacatagatggattctaatagctcgaatggacgtctacccgtttattgtatgtcaactagatggttacgaaaaattttcaaaaaaaatgataaaatagatcaatatgtaatatatcactccacaagcatgcacgttcaaatttaacttctacaaattgtaacaaaataacaaatttaattgtaaatatacatatagtaatttgagttttgtttgttatttttgttacaatttattgaagttgaattttaatttgcatatttgtggattaatatattacatattgatctatcttgttcatattttttaaatttttttcataaccatttagatgacatgcaataaatgggtggacgtccactggagccgttaaaacagtttcccccgttggaactttataaattcacgaacattcaaataaaacatcagtactctttgtcgacagtggttcgaggtggacgactatgcgaaacatgatcctctccatctaccagccgtcgcacctggccaccctgatccccagcatggagtcgtgtattgaacgcgcggccgagaatctcgagggccaagaggagatcaacttctccaagctctctctcagcttcaccactgacgtcctcgggcaggcagcgttcggaacggactttggcctgtcgaaaaagttggcctcgtcggacgacgacgaggacacccgcaagatcgcggccgatacctgcgcggaggccaaggcatcatcggagttcatcaagatgcacgtgcacgcgaccacgtctctaaaaatggacatgtccggctcgctctccatcatcgtcggccagctcctgccgttcctccatgaaccgttccggcaggttctcaagaggcttcgctggacggcggaccacgagatcgaccgcgtgaacctcacgctcgggagacagcttgacaggatcgtcgccgagcggacggctgcaatgaagcgagacccggcggcgctgcagcagcgcaaggacttcctgtccgtcatgctcacggcgagagagtcgaacaaatcctcgagggagctgctcacgccggactacatcagcgcgctcacttacgagcacctcctcgccgggtcggccacgacggcgttcactctcaccacggcgctctacctcgtcgccaagcacccggaggtggaggagaagctgctcagagagatcgacgggttcggaccccgcgaccgcgtgccgacggccgaggatctgcagaccaaattcccctaccttgatcaggcacgccaaacccttcctcgacgtgtttatatcgtcagacatgaatttctgaccgcgcatcgtgcacgcatgcaggtcctgaaggaagcgatgagatattacccctcatcgccattgatagcaagggaactaaaccaacagctcgaaattggaggatatccccttccaaaggtacatccgacgatctttatatacaagtccatataggacatgacagggagaaatttctaggggacttccgtctagcttcacaaggtggtgggctagacgatctgggttcgaagcctcacccttctaattatttgatattaggtctttccttaatattcacatttttataggacatgacaggcttgctttcatgtttcctcttatgtactacttcagtatacatttcattcgttttttcagggaacatgggtgtggatggcacctggtgtcctaggaaaggatcccaaaaatttcccagagccagaggtgttccggccggagcgcttcgacccaaacggcgaggaagagaagaggaggcacccgtacgcgctcttcccgttcgggatagggccgagggcgtgcatcggccagaagttcgccatacaggagatgaaattgtcagcgatccacttctaccgtcattacgtatttcggccctcgcccagcatggagtctcctcctgagtttgtgtactcgatcgtctccaatttcaagaacggcgccaagcttcaggtcatcaagaggcatatataatgcttaatcacatcatcaggagaactattcgtttggattttgggtattgcgcatattattaagtactcgttttcagtttatgttgtactgtacttgttttcgccgggcagtccgtgttgtactcgtaatatatatgaaccacagctagcaaatctccgaggcataaagtttcttatgagtaaatatccgaatataagatttttcttctcataaagacctctataggtagaggagcaggccgtgggacatatcatgttgtacgatgaaaatagatctaataaagacagttattatgttcgctgtttagtttctgtgatattttgaggtgaaatggccacgggtgtttagtatcttctcacgcttctaaaaaaacatagaagggaaagataacaaacccagtggtcgccactattttacaatacattgtcagcagttttccattcacagggtttattgatccaatctactgttgttattattagatggttaagcctattttaacctttaactttgctcaaagcgtatatttcatcgtgaactacaaagtctatttttcattctcactttcaaattcaaaactgaaaaggtaaacactttcggatataatctctctgtcttggaagaaaaaaaatcaacttctgaatttgaatttggacacaagcctttctagattcgtagacagaagttttttttttaatatggatggagtatttagtagttgttttgcttcaaatggagatggtttccgtagtttatactcttattatgcatactttgttgatgaaaattaaataacacataattaggtctataagcatgaagtttgcctgactaaaattcatgctagcgaaaattaaaccactatatcatgtcgtctataaaaagaaccatcataaaattatatgcatgattttaaaagttattgttgaaaaaataaccagttttgtaattcaggtgagaaatgaactccaagcaaagtctaagggccaaaaaatagaccatacgtgtaaataagtttgctctgctctaaaattctcacattaatcagagaaaagaaaaaatagagttgaagtagtgtcaaggttatgaataacacatatctaaaagtaatcgactaagctcggcagggcctaccatatactaagttttatacggaatcatacctcgtatatagatggagttctggataaggaatgacaagaagaagagttctacatgaaaactatgaggactgatcagattatatccatatttgtctccctaattatacttggacaaagggacatctatggatataaatacaagaccccaaggaggagagagggacaaaccaagacaagccagcacagaccagcacgctcaatcagaatagacaccaatgcatgccgccagatatcgatatcagagataaacctagacagacccaatctggtaccatcagaggctaacaagagggatctagcgctatctctgatctcaccaagtctatattcgaggaggaagactgccctgtcgtcgactacatgatggtgttccatgccaccaagtcgacaatggctagataggttatcccaaatattgtacctgtgtgattctgatgaataagagcagcaccggtttcggccaacaggagtagggctattacctgatttcgatgaataaggggcctgaacctgtataaaaatccttatctctgcctcttttacctcaatttcgcatataccctggtaccaacgatccccataccatgcaaataccgtaatcgtgatctaaaacatcgacaagtatacaatttacgtggatccgctatacctcatatacttggatagaacaattgtggctacttctaaaagctataaaaagaaaaacccaacaacaatcaggttcgactttaaaaatcccaaagatagtaaataggaggggcaacatgctgaccataaaggagtagggtggtggtgattgacgggacatctatagctacaaagtagaacccctagtccagatctggccactccggtgtgagccgcagtggcttggtggtagtctgggcggtggtttgcaatggtgcgacgacgacggctctgctggcgatgggtgtgcctgtactgacctggtgtgggaggccatggccggtggcaggcaaagcttccgcagcacgggcacaaggcaagactaccgctgacagtgctccagcgggtccaatggcggcgggagctgaggcaacggggcgaggcgaccgcgatgcgaaagagcggcctgaggtggcggtgatgcgggctgtttggtcgatgtgttgacgatggtggtgttgtgaggttgcgttacaagcttgaggggggctccaatctaaatgatagtcctcttgtggtggcgccttgctgtcacaaaatggccacgttaggcgggctagtgcaagggagaggggatccattcttctctttccctctccctctccaacccaaatgcgtggatcgatttggagcgcgtccgatgttgagctcctactcaaaggtcgaccaatggcaaggtgttggcgcggtggccatccgtcgaaggtgtgcaggtggtgctggtaccctttttgcaggcaacctcgacacgggagggtagaaagcttacgggcagaagcctagcccttcagacaagcaatagcgacatctacggacgctgcttttcccttggggcattatttgcatgaatttttaggtttaaatcatgtcctagcgcctcagggcgggcggcggagttactcctggtgccgcatcctttctagaggtgtcatttagaatatcgttttctttagagatgatgtgctctgctttgatcttgagtagcgggttttggttttagatgctttatgcggcagacgcatagctagctaggtggcactgtgggccatggaccacctaaaaatttgatcaagattaaaactattgtatactagcaaaagtgcccgtgcgttgctacgggaagaaaaaaaggagaaaattgaattaaagcatattacatactaattaattgaaatacaacgtctgatctaatcagttctactcgaccaaatttatagtgtcgatgaacgagtaatactatatgttcatgaaacctatggatgaacatgaataattaatttgcgttgtctcaattatttacatagttaaacagaaataattcctaaattacatcattgttgacgtaaataattaagaaacatgaacataaatgaaatttatacgaatttataatcaacgttagtcagggagataaatccatatcgtgag

SEQ ID NO: 69285 - DNA, 17616 bp, Oryza sativa
ccggcggccgacgtcgacgaggacgacttggacgacttggtgcgcttgttgcggcggcacccgccgccgacggggacgttgcggagcgctccgccgcgcgtccagtagcggcggcacgtcttgcagaagtggcgcggctgcgagagcgagtagttgttgaagtagcagaacttggtgttggtggactcgcagcgcgggcacttgagccccggctccggctgcgggatcttcgccagccgagcccgttccgtcatcgagcccggccgcaccgccgtgccgccggtcgggccgccgccgccaccgccgccgccgctcgccgcgacggccgctgctaccatgtcaggccgaggcgccatgaggccgccgtgatgcggcggcatcggcggcagctggtggtggtggtggtggtggtggtggtgcgcgtccactccacctccgccgccgccgccgccgccgccgttgccgccacttggaagctgaccgtggtgagcttgctgttgctgaaagcaccaccattaattccaaatcaaacacgtacacacatgcaccaaagaaagagaattaaaggcgacgagaaatcaagatcacaaactaaaagacgagacggtatattcaacaagagatcgatttaattctcaaaagagcgtaggaatatttcctcagcgcattttatttggttttgcttttttcatgaagaagccatacatacatacatatatggccatcatcctacataaaaaagaaagaaaggagagagcaaaaaaagatcttggccaagcaagaaaaaatttcacctgctggttccaattgggtggatcaagatagacggccggaaccgaagaaaagaccatggtatagaattgatttcttttgatcttttcctacttggggccttcttttttgggttttgtttgttcctctcctctcttctttgtgagataagggtatatagctgctttaggcccaggatcatgcaaggatggggaggcggatcgataaaaggcggcgaataacacacccactagcaagctggaaattgtgtgtgagctctatctaatctagctgagctgagctgcttgtgagaagagagaaactatatcactactactactactctggcctgcgtggtgatgagttagctggtacaaagagaggaggaggaggaggaggagaatgaagagaggagggaagctagagaaagggaaagagattggggtgagagggaatgaaagggagagggaataaaagggagaaggggggcttgccacccctttattttcctttatttttttgtgtcttagtggtgtgcttgcattatatatattgggttgtgaaacatatgcatgggaggagttgaatggtgaagagtgatgtttccttagctcataagcatgtgtgtgtgtgtgtgtgatgcatggatatataatggatgtggcatggctagccagctagctagggatcagtatgagagatcatcagagaatggggttttatgcagggagaaagctgatgaaaaccctagatttctaggagaaggagaggtggccttggctgctagctgcatgcactgtttattggaagtctctgctggatttgtttgtttgctgttctagcttggctggttattagttaattatcaaccactgatctatatatctatcttggtgtttaacagtactggatcaggcagagctagctagaggttatcaaaatgatgtgagctagcagctacaggtgtctaggggtggcattctagtgtgtattttgcagggtgttcaactttatgtccattttgatgaaagagataaatcagtaaagctggtcttgctagttttagtcctcttggactctttggccagtggtgcagcaggttgtggtgtagaattctccttctccttctttctctaaacaaagtttatactgctaagtactactaattaacaagtatatagtatatggctagctatagctagctgacgtacagtagtctcatgtggtaatatatatgagtaggtaattagctttatgtgcatatagatatatgcatgttaattgaattctttggtctgtattcacaatatatatataatactacatggttattaatttcatccaagtctttctagctcctgtagcttgacatgtctgtgtgcagaatatgtgatactggtagttcagtgtgcaagtactgggaaacttcaggacatgcatcaattcatggcctcatggatgataggctacatagatgaatagatctatgcaagctttgttgccttttgttcttttttttcctccctcctccacattgtacaaactaagcaaacatggcatttgaatacactaacgatcgtaaagctttacacatttgaattgtgcaagatctgaaaagatcacagtccatattcttattctgttctggtcgtccgataactaaaatttaactgactttcatgcatggcattcccttaatataatacatgggcagaatctttcctgtcaaatattctgcttttgccaccacaatatcacatatactgattatttttctgcaaatgatgagagaacaaatgcaagctagctaggatcagtgctcattagcgcttataattaggttattattattctccctagtttagataggtagctagctaccggttaacttaatcgagcagaatagaccccacttttccttgtccatgactgattagagagattggacagaagataacaattttgattaacaataggatctaactagtgtgcccagctcatgtaccgatgagctctcattcagacattcagtcatatggggatcgatgagaaatcagatacagagacaaattaactagctagatagagtagtacgtagttgtacaagtgattgatcgatcagacatggaggactccaaaagattcaggtaatgcgttccagagtgcagctgattggagcatgatgtataagcggctaccatctagtgctgccccatttacagtatacacactgctagctagatatctgtgtgtccttgctcgctacctgataaactagggtgtcaaattattttatattaaatttgttgatctatggagtcaaatttctcaatcatgtctgcaaacccttcattgttcatgcatgtatattcaatccggattaactagtatagtaaactgcatatattttgaaggtgccacacctgcagctgtatatttatgctataaggttcttatgctgtttatgttcaaaatgtcgacaggaaagttcagatgggcgatgttgcttggctatactcaagtaatctttcatcattcgactttgtggcgaattgctttagcagttaagattctgctccgcttttgcttcctctgataatttgtatcattgtgtgcgcactactgcaactgctcatttctgctttggagattgtacgtggcgcagtgaagcctcaacactgacaaaataattaacccattagataaggtctggattcctcttggaccgagagaacagcatcaccttttgttaaaaacatgacccttgaggtattaatttagaaggaattctagatagtatcatggaatcatcagtggcaggtaattaactaacttaattagctcacgaacatgtaagctcgctagaatcaccgaaactctatgtaaagaaaaggaattgtaatttcatcttacttgactgtgtatacacagcatatgtcgaagatgtaaatcatttttattataaaaaatatatatctcaatctcaaagtcgatcttgccggtttgcatgggcagctagccatcctgccatccatgtcgaacatgtggaactctagaacacacatacaagtgattgaggcacaggctgatgggctgatcagcaagtgctcaaaatggaggaattttacgtcaatcaggcatacgtcaggactggatttccaactgccggtgaaaagcgcaaccccagaatgccgataaagtgataaacgctcgccctgcttttgtttcctttattttctcctttttaatactgacagtccatcacactgttctctgctgcagtctgcagaacaagtgcagtattgctactggtgctgaattgcagatgaaatcaatattgagcagttagattgtgtagcgaattggtaatattctttaggataatagaagttctcgctcatcaatgaaggcatctaagcctctacaccggctgatatcagggcagatacaagcctaacgcagctagggctttagacgcaggcttcctctataaccatgtttatatcctctgaattcaccactgaaaaatagaaaaaaacctacaatttattagcagagctccaggtgagcattaggctttggtaatttctggctttgtacctggctgatatgatggtcatcatgaatgtacagtgatgtttagtattaactttctaacttgctcctggtagtacaagccagagatcacctgagcaaatcatgtgttgggaacacaggattaaagaggtgaggtgatgcacgtaatgatgattaaggcagagataccgggtgtgggttctttgggcgggtaggaccagggagtggtcgctttggcctgcattattattgcttatgactcattgggcctgctgattaaagcgaaagacgcagcagtatagtccctcgtagtgtgtatgtccccagcgagatcacattgtgtgactttccttttcttctcccgacatcgcaggatgtgagcgagattccgggacatgcaacacatgtactagtaatccgagctttatcgtcggactaatccgagaacctttaggtttatcgtcggtcgagctaagctgagtacacagcttaaccaacctgcgtgagtgcgtgacgactgacgatgataattgcatcgcaacagcaacgggggcagcatgtttggagccaggggttaattaatcacagcggcacggcactaagtaacaagacatataggactatcaaggatagcattagctagcagcattatgaaaagcacaggcctggtctagctattacatgtgtttccaccccggttcaagataaactggacagtggaacactctcatcaacagatcagcaaataacgctgtttcactaacaaaacatttaaaacatttaaagcatattaaacatttaaaacatatttaagtaaccgggggccaaacccacctagcataatcaattgcaattgtaatacagcagtaaaacaaaaggggtaattctgccgcggccacctggtaaaaactgaaacatcatcacattactgaatgtctgttcgaatctgagactagaagtccaaactcaagcatcaggtgataataagtctttagttaacagaaagtacgagtagcccaagtggtatgattgccaactgggatttgaaaacaaaaggtgtatgatcaatatttttctcatcacatatacgaaggtgtattgatttagtcgacctcctcaatcttagggccagcaccactcccaccagcagccggagcatcatcgtccattccaccacccatgtcggcaccagcaccctggtacatcttggcaataattgggttgcacaggccctccagctccttcatcttgtcttcgaactcttcaacctcagcgagctggttgttgtccagccactggatcgcctgctcgaccgcgtcctcaatctttttcttgtcgtcagctggcagcttggaagcaatcttctcgtcttggatagtgttcctcatgttgtaagcatagttctccagggaattcttggcgtcaactttcttttgtgctcttcatcctcggacttgtacttctcggcgtcctgaaccatcttctctatctcctctttgctcagccttcccttgtcatttgtgatggttatcttgttcttctggccagttgtcttgtcttcggcagacacattcaggataccgttggcatcaatgtcaaagcagacagtgatctgagggactcccctaggggcaggagggattccagacagctcaaatttgccaaggagattgttgtccctggtccgtgtcctctcaccctcatagacctgaatcaacacaccaggctggttatcggagtaggtggagaagacctgctccttcttggtaggaatggtggtgttccttgggatgagcactgtcatcacacctcccgctgtctcgagaccaagagacagtggagtcacatcaaggagaagaagatcctgcaccttctcgttcccctctccactaaggatagcagcctggacggcagcaccgtatgccacagcttcatcagggttaatgctcttgcagagttccttcccattgaagaaatcctgcagaagctgctgaaccctagggattctagttgaaccaccaacaaggacaacatcatggacagtgctcttgtccatctttgcatccctcaggcacttctccacaggctccatacatttcctgaagaggtccatgttaagctcctcaaacctggctctggtgatggtggaatagaaatcaacaccctcaaagagggaatcaatttcaatagtagtttgggcagtggaggagagggtcctctttgccctttcacatgatgttctgagcctcctcaaagccctggggttcccgctgatatccttcttatgctttctcttgaactcttggacaaagtggttcaccaggcggttgtcaaagtcctccccaccaaggtgagtgtcaccagctgttgctttcacctcaaaaataccctcctcaatggtaaggagggagacatcaaaagtaccaccaccaaggtcaaaaatgagcacgttcttctcaccaacactagtcgccttcttgtcaagaccataagcaattgcagcagctgttggctcattgatgatacgcataacattaagacccgcaataacacctgcatctttagttgcctgcctctgggaatcattgaagtatgcaggaacagtgacaacagcattcttcacagttgaccctaggtaagcttcagcgatctcacgcatcttgataagaaccatggatgaaatttcttcggcagagaattgcttctcctcacccttgtactgcactacaatcataggcttatcccctgggccaggaataaccttgtaaggccacatcttgatatcgctctggacagaggcatcagaaaaccgtctgccgataagacgcttggcatctgcaaagtgaaagatgtattcagaaatctcaattggatatattggcattaatcaagaaaaggtaattgttaacatgaatagaagataaagaagttaagataataaagatgattgcaaaatattattcatgtccttgctttgagttggacgagaaaagatagtgaaccattatagtagcggacgaaagagactgctaatcttattgttcatcacaaaggttttgcctgttttgcatttatcagctagatttttttcaaaacaggaaagaagcacaagttcaagaacatcacagctgctgaatgaagctgcaatgatcataacaattacagctcgcaaacaagaaatcgtcaagtaaaaagtgttggtggaatagttttaaatctaacaacatgcaagataacattatctgaattcaataaaaagtctagtttaaaactttatagataaattaaaaataagccaattgtgactatcctggttttcatggtaatagtagcctactttaatcagcaggtaccttaaaatagagaattaaaacaacaaataaaaaattaaataataccaacaaaagcaaataaccaaacaatacaaacaaaagcagatatcctaaattatttctcaagaacagtatttactttcaatacaccagcctgctttcataacaattctaatttatgagcaataaaacgttgaaaattgagggtataagcataaatgcgaaaatatacaacgtttattggcgcttttacaaacacataatatagcttaaggtgtatgggtgaaacttaattatatttaatgcccggacatttgcaagtaatgtactaactaaattcctgtggatcaaaacaggttgtgcaatggcgtcagttacttttgggaaataaacctgttgaataacaatcttcagcatatgcagaaactaaaatgtatatatagcctacttacatgagaaaagaaagtataatcaagagcaatgagaaacagagcagcaaaaaataatctaatataatttatagctgtgcaataatcaatttaaacaaagaaaaaacagatacattccaagcggctggatccattccaagtggctggctgttggtagtgagcaactgagcatagcaaaccattcaataaagcatgaagagaactattgaatatgacgagttgcacacctaatacagaatggattactaagataattgacatgcagcttttcagtcacaaaaggacagtttgactctcatttatcaggaataacagccaactttagttccatttttttgacatcctaagcatgattcagaaagcactttcatgtaaaggcctctctgtttcattaattctaattcacactaggccctaacagcaccatagcaatgcaatgtaaaaataagtgcaagttgccacacgccgactgattcaatctttcccttccataacatcaacatatgcaaatagcagttcagtccaaaagtgacagcacaattttatagggagacaaagaaagaacgtacatgaaagaactgtacatgattacaaacaactgattcttctatccaacagttctgattgaaactagagtgattattttctaccggcaagttcctacgtggccaacaaatcaacaacacagagccatagaaattaatcgactatgctcctgctatatagatctaccttgtactgaatatattcagacgtcactatgaaattatataataatgatggtgataaaatcagtggtgtaatcttaaaaaatttcagcgcgtgctcttccccagcccaacgaaaaaactgtgataccaaatcaccagtcgttttctgttaaaaacatcgcctattttcacctacaatatcataatgcagatcttattccgcctaccggctagtacatcaagcattgcgtctctcgcattggagcagtgctaaacatgtactagacttgacggatctagcaaatcgggcatcacattacgcgaaacacagatcacacatctagtcgcaacagtacacagatcgaatcagaaacagggcaaaagcgtcgtggcgttactcaccgaagacggtgttgatggggttcatggcgacctggttcttggcggcatccccgatgaggcgctcggtgtccgtgaacccgacgtaggagggggtggtgcggttcccctggtcgttggcgatgatctcgacgcggtcgtgctgccacacccccacgcacgagtaggtcgtcccgaggtcgatgccgatcgctggcccctcccccttggtcggcgccatggctcctcctcccgctcgcgggtcgcggcggcggcgcgaggaacgagtgaacgaggagagagagagaggaggctagggtttccgcggatgcgggaggaggagtggaggagaggaggcgagtgcggctgcggcctccgtgtgcggcggcgaggcggtgcttttatagtggcgggcacggtcggcctcttcccctcccggaatcgcgggggcgtggcccatccaggcccagttcgtacattaaactattgttactgcaagttgggcccccacaggtcaaatgtccatgtagtaggagtaggagtactccatttttcacgcgtatcgagcatggtttctctctctgcaggtggggtcccagttgggctcccacaggtcaagtgtcgatgtagtaggtgtatttttcacgcgtatcgagcatggtttctctctgcaggtggggtcccgaacattcgtgtacaccagtgggtcccacgtacagcctctgagaggtgatctttcgttatgtgtggcggacttgtgggaacgagtcgtttggtcagggagtgggtgccaatatttggggaagaagtttctacggacagaggcttttttgtggacaggatcagtaatatgcgcataaagcactctttgatgtcgctacaaccatttgatcgcgttcgaagggtttggattaaccggacgactcacgcagcttgagttatcacacaacaactgaacaatgctggtatggatcatccaataagctatgttggggttacagtcaaagttccaaaggtcttcggacccatcagctgccctaaaaagaataagccaaagttaaattttaaatttaaattttaagatctttttaacatagtttctttttcaacatactccctctgtttcaagttatttacgttttgatttagtcaaagtcaaactgctttaaatttgactaaatttgtagaaaaaagtagtaacatttttaatccaagacaaatttactatgaaaatatatttaattattgatttgatgaaactaagttagtattataaatattactatatttgtctacaaacttagtcaaacttaaaacagtttgtctttgactgaagtcaaaatgtcttaaaacctgaaaaggatggagtatcttttaaatcgctaagaatgcatataaaaaagttttacatgcagttttttttaatagacgttgtggcttatagtcaccttctgcgtaatcaatgaaaccctttggctagtgtcgtgtcacgtgactggttattagaggctaccaatgatacggacgatactagcaagagttggaagtagggaagtttaatgcatcgatgtcttgggattcgtaacgccaatattttcaacggtatggtgtgctcattttcttcatgtataaattagggtggtttgaagtgcgaaaggtaaaatattggttaaatgattatcaaaacaagacaatgataataaagtaactaaaatgaaatgtactcgctttccttttatttgttaagatggtggtttgacgatcgttcgtgcaggtacaactacatatcacatatctaggctatattatttgggttggaccaagttagtgtttggtacattggcattttttctttggaattgtgagatttttttcgaaaaatttccaaccgatttctaatagatagtagtttatgtttatgagaaaaaaattcaaattcatttatgttttaaaaaatttcaaaaaaatatatctccctattcctaaaaataggacaaaagcaaatacttttcaccggtttcacgctaagcatctaatgtctcggagcctcatcggttacccatattcactaataaatcaaaactaataaatcaaaacagcttatcaagaataaaaatcattttagaagtaaaacttttatatatctatccatcaatactaataaaaataggttaaaaatatctaaaaatcaactacgaaatcaaatttaaaaaatttaatttacttattgggtgctctcgattattttccccgtcagttgacaggcagagacagagacaaggaggaggtcgtgcgagaccgcgagaggcgtgtgcgccgtgcgcgtgtcctctgccccttcccttctccccatctcgcctcgctcccttcccttctcttgcccaccgccaccgccccgcacccacccacctctgcctagatccgtctccaccatcgatctccctcccatccccggatgcgcaaggtggaaggcaagatcgaaccctaaccggcgacggaggaggagcggctccaccaccaccacctcgaaggagttgacaggcgggggatggattctgcagcgtgatttcatttgtggttggtacggaagccctaatgcagcatgcttggattgctcgtagggtaatttgttgtttgagcaaccaatctaatttgtcctgtccaatccatcctgctatttgtgggttttgttggattgctctcataccagcttgtttcccaaaattttgggggaaagtacataacctgctttgggtcgggtttccgacgattagtgggagatactctgattgtgtttgattagtagctaggtgccatattgtttggacttggtggtagtatagatggagatttttcgtcataaattgggagaactggataattagagtccccctatgttgcttggatcatttttagtattattattgtttttgctgggagatttatatgtatgatagtgctggaccgtatgcttccattgtagctagataaagatcagttatagaaccaagagaagtgacattcatatcagacaatatatccatatctcatttcaccatatagttaggaatagtcaatgaagactgttctgtttgctggtttgattcttaaaaagttagtatcagtattttttttgtttacttttctaacacctcatgctgatgggattcacttcttgtttgttttttcagctccatttcctgctggttcgatgcaactgctttgtaactgttgattgatgtggtgatacatttcaaaaccagggattagattctgtttatgcctatgcttcataaatcataacgatggccagttcaagcaaaaacttccagtcatcaagcaaaccaggcagtgacaggaagtaccagggtgcattggttgcttctccagcaaaagccatttcacccaagacagtcaagcagatcgtgccaggaaaacatttaatcttgagcggggagtctacaagtcatctggcatcttttttggtaaaggttattgccttggaagtagtaagaagattttcaaaagcaagatgcccttttatatggaattctattcaagcattgcaagttcttgggtaccctccatttaggtggattcaacagtgggcgccactcaaatttattgtgcaaggcattcaggttgttttacctctcggtccttcaaggccttaactctctttttttagataatggaagtaaagaccttgattctcttgatttcctagatacacacaattatttttcttctatcagcttgtgcttttgaaaattgcttgcttaaatgagatatatttctcttgttgcctctcaactaagtagcaattaccaataagaactgtcacttatgttgattgtagcattttatattccacttttgacacttctggttgcaaccataacatgcaccaggttcagatgcaagccacacactctgtccacttaatcatgctcaacctggacttaaattttcacggagaaatgaatataggtccagcactattattcttcacataggcttttaggctgctataattttcttttcaccattactatattctttgctgacagcaacactagaccattgtattacaggtttttacatatgaacgattccatttggcttggagtttgttttggcataggttatctatttatcatgcatgttgggctttttgaagcatgttctgggcttccacttagttaaagattaagaaactagaaatgaccatgtcttacaatttcttgcgacgtatgttagctacttactgagttaacatagtgaatcccagatcaattcatgtgaataatatgatggatatgtccatctatgctagactaaacctgcttcaatcctcgttttgaacatggttgtgggtttttactagtttgatgaattggtgcactgtgacacttctgctatgctgtttcacttgtttctttaataatttctttctgaatatttttctcctatacagaaattatcgacaccactgttgtttctttctgtcacaacaacattatgtgaccggtcctctaagcgcaatgatgaattgggtagcaatacagaagctcctgatgtaccttctgaatcagatgaaacagcatcaacttctggtataaggttggttaagactaaagaaagaaatactagaagtatctcttagctgaggaatgtgttgctagcttcttttcattgaatcatagcgttctagttctgaccatatcacatcacaataatgaaataaacttacggaaagagggctaaattttcatctagtgttttatttcttgttttagggatgttgctgatggcacaaaggataccgagccagataactggctcatatcactgttcaaggaacttgagaaacaaggcatcactttgcctgaaaggtaaatctaaaagtttgtttgtttttatgaacgatacatttctatatgtatcaattattcccatccagggtgcaggattaaaaaaatacaacatcttgaaatggattttctaatgcagctcttgttattgtgatgtatccagtactaaaagtgccaacttacatataagagtgggaagtgcacagatgtgtacagaagtgtgatataggtcaaataaagctttatatattttgaatttcatgagttgtatcttgtgggtatagctgagggtttcaggctatgtaagcctagtttggtgtatgagctggtgttgagcttatttgcattgagcttagtgttcaaacatgtctttctgtgcgattctgaagtcttgttatagttgtatatacacaccagtgccctgagctgcaaaaatgacatatagctgagagaatttaccttatggacatttcaggttcaatgaggatgaactacgcagattttacattgcagccaatggtgacttttcaagtttgctctcttcagttaagaagacaattcgttggagggaaaccttccatatacttacattgcacgaactcgagaagtggtcccatttagttttttggcatggattcgatactatgcttcggccctgtttaatagtccgtcttggtcttgcatgctctagtctagccccttctgatagacctcggtttgggcaagcagtaggtaacttctcagcctgctctatacacccattcatttatgtcctagattgtcttcatgtgatagtttttatcatctttgaactgggaaggaacatatagtgtgggaaattgctttgttgcttgcagtaagatattttctttttcaataaatatggttcatctagcaagatactgtccatcagcagttagtttgacagaaagaaggccatctttctttaacaacattgtctatccaagttttgagcagataataggattctgtccggctgatttaccaagaggatcactaatagtaatctctaacattttcttttcagtttctcaaatcgacaatggtattgtatacttgaccaacaaagaagatccgagaataactgttttgctggattgtcatgggatttctccattcagatttccaatgcaaatgatgaggtcgtttatcactatagttcaagaaaactatccaaatcgtcttggggtactatttattgtgcgtcttcctcctgttgtcagagtaattgcgcagactcttattcaggtaactttctccacctacatgtcatctcaataactatttaactgtccccactgaccacaaatgaacaagagcatgtcccacagacatttgttagggggggcatagttcattcatgagcacaattgcttgagttttgactacttggactatctgcctaaacaaggatggctacaaatcagaactagcattagttatgactgtgagatgacaaacaattgtgtcctgcttcctcaccacatctaatgttacttatatgttctttctaatctacctaggttctgaaaccatccacaaagcagaagttgcgttttgagggagaatcatataagaagacattagccgagttcttgcagattgtgccaacttttcttggtggcaaatgcagctgcccgcaatgtgagaagccgcgtaatatttcagtaatacaggcaggggaaggcagcaagagccaacctcgccagataaccattgatgatggatcacctgtcgcaagcatgaactttgatgaggcggagcttccatctccttatagctgcgagaatgccataagggctgccatcattggtgttctaatgctgtgggtcttcattgcatttctcgctgggatgaacgacccagagtccatctcgtcccatgccccctaaagggccttgcatttttttgccatgtcaaccaggatccacagaaccacctgagctgtcagttgtcttccatttgcatctgtggttgctagaggcgtttttcatagcagattttcgtggtctgtactatgtgcgccacatgctaaagcatcaaaagagtatcttcgagtcgctcactgggaggtcatatgaggtgtgcgattcagcattaccttgaaatagtcagttagaacaagacaattccttgttttgttttggtgccatcttagtatatatagtagtattagtttgtctgtaagtttgccgacttgtcagtttatcgtgggtggctatatagtatctagaagatggttcttacacttaatacttcctggaaaattctacgaacgctacttgaaaactggaatttctcatctgagaagccaggtccctgtgctatgtatgggtgaacggagaatccagtctggtgctgaactactaatgaatgaatgcacgtgcttgtcgaactcctaaataatatcttttttaaataaaatctttctacatatgattttcttgtaatctgttctaaatctatttttaacattataatagttatttgtttatttgtaccttaaataattatcacgtatccttgggctattcagatattcagctcaagaacacggccgtcagatcatgtgtggacggtcacgattaccaagaagcttaaggttccgttggtttattttgggacggaggaagtagtcgtatagactcttgtataactcgccagtgtccttgttctaaaatgtcaaatatttaggatccttatcatcaaagtttttgatcgaattttgttctaaaatgtcaaatatttaggatccggaaaaatattttgggaaggagagtataaaaatataaacactttactttatcatatatccaaactttttaagaacctgtttgataacttacataaataaaatgagatgcatatcatttctcgcaatatagctgggcagttgtaaaaattgatacagtcgaagtcaaacagccggtgatgaaactaggtatatggataacaacataggaatgttcgctgtcgatggattgtgtgagcaagccaatggtaaggtatagtttcccgcggtagcatttccttttaattggtattatttgctcaatccaacacactccaattgaacagctaggttgtccggtgtagaaaatgttacaagaaagcaccgccgaacctcccaatgcttaaaagtcaacatagtcatatatttaaaaacgaaataagtaattattttttatttgaaatgatattatagcccacttactctgtaataaaagtagagggattttactctactactcccatacagtatatgtagtgaaaggttttttcaccaattgtaccacagacaaatccaaaccaactttaaagttgggttgagtgaaagtggcaaagaagcaatttcctcgaaccctaccctaacgccattccccaccccagcagcagcagcagcagacgccagtcacctcgcaatctcacgcggtcacccgccgcatgaccgcggctcgatagcgccgccgcctcgccgccgggcgtctcctccccggcgccaccg

SEQ ID NO: 69286 - DNA, 864 bp, Oryza sativa
ccagggttcggcctggttcggccgaaccagtagctagcccaattagcccaattcttcatcagctggtagttatccttgtcccaaggcggttatgaccggttaaactgaagaaaccgtcactggacacatgtcacaaagagatgaagctaaggagaatatgctccttggatgcttggagcatatccactctcccaaggcaactcatgtcacactgttaacgaccaaatttggtaaatcaagtatcggaattggagataaaaccgaagcagaatcaaagggaattaacagtttcggaaatagagtacacatcggctggggtccgaatcggctacaatctacattggtagagtttaagtcggacagggtagccgatgaagtcgattccgacaatatggcgatagaaacattgtcggattgggttgatatgcttcatatcaattgccacgcacggattgagtcctaagaaggtaatttgtatctattaattaggatattttatataattttcttgtactttgagtcggtaagagtccaccttaaggacttgtttgtttcctaagttgtaatagagttaggagtcgtgtccgacaagggcatatcatgtattttgggtataaaagtagcccaaaaccagtgtaacaaagtaacaatcagttcaataacactttcgacgcatcgccaacctttcactttcgtttactttcgatgagttcttgctttcgagttgggctgcatcagtttgatctccgacgacaaggtaaaacttgttatggcggtttgtgttctcgggattagtggttctatcttcatgatactctaatcttgtaatagccctagctcataaccaggtatttagaagtgcat

SEQ ID NO: 69287 - DNA, 649 bp, Oryza sativa
ttctttgggttaagtatagtttagtaagcaggtagacttaccagctggctgttgtatgcgtctggcttagcatcatttgtagagactaaatagttaatagtggcaaagacgacaaatgtaaactatgccttttgtttaggccctggtctttttccttataattttggaacctttcctcattaactaaatcaaatggcaaccctgccatttcttaacaaaaaaagggaggagaactggttgtagtggagcctaatgttccatatttatatttttgctacaggttggaacaaaagtggctgcagtgtcccgcaagacaaatactacaactcatgaaattttgggcgtgctgacaaaagggataactcaaatagtatgttctgttaccaatatctgcttgtgctagtatgaagtgaattcatattttcaatttttgatggtaccgttatggatttctaaaaatcctgtctaacgatgcttgtctgtatttcatttgcaaatactgaattctggacaatgatgaatatattacatatcataaaacagagtacattgtgatttatttctaccattactgattacattaagagagatgttcaaatcagtcagtgcaagcacattgtgccccatggcctgattgtatctatctcat

SEQ ID NO: 69288 - DNA, 740 bp, Oryza sativa
ggaggtggaccgcgccgcggaaagcgtgaggcacggctcggctcaccgggtcgactgggccaccctcctctagtatgtcgcggagaaggtgacgacagaaatggccaataggcgttccggccatgctgcctgctttttcggtgcttactggcagaggctcatctaggtgcagaggccggacctcttcagtttgttaggaaacgataagctaacaaacgataaagaaaacaatagatcaatcacagaagacacgagatttaacgtggaaaaccctcctaaagtaggagagaaaaaaccacgggcgccagccagcaaaatatcttcactatatctggggtgaggttaccacgccgcatgtaacaccctaaaaattcgacgacgaaatctaaactctaaaaatacggaccttcaaaaactttttaaataaagttgcatcatgccgattttgttcgattattttaatgaattttgatctcggagtttataaatcgcgaataatggaaaattagttaggagtaaaccctaaaaagtaaattgactaagtaaataattaaagagcaatttaaaataatatttagagaggatagaaatgagtaaaatattattaggactataattgtatcaattaaatcgaaaagtgtaggaataagaattaactctaattaaattcaagaaaattatataaaaataaaatatgagtaatattaatctagggggatcctctagagtcgacctgcagg

SEQ ID NO: 69289 - DNA, 1003 bp, Oryza sativa
tctcgttttacatatcttcccaatttacttcttttctcttctctcgaactcccagctagctcaaaagcaaaccccagaaaaatccaccggctgccacaagcagccaccgtcagaccatcacatatacacatcgccattagcagtcgagctgtcgaggtcagggagccggctaatttagcccatgcatgatagctccaattcctccatcctataaaataatttcgtatcttttacctctaccattcttttcaaaatgacatcacttctttcactttatttatatctaatccataaattaattagttttattttgttgatatttcttatccacttagaacaagttttatagtaaagatgatgatcacctctaatttatcttcatattacttgccttagatatacacccgtgctaatataccataataatatattttactatattactatattagtttctttctctcctccccgtagaagtttgtgtagagattgcttctttcatgacatgagaggtggtttctcctctctctcctttgttttacttttccatctcatcatgtgatcctattatcctacaaatacgagcgtttggatgtccgtagtacttgctctcataaatatataatattattttttcttttaaggagagacactttggtagtatatttttacttcatatcaatttgtgttatgatgataaaagatgaagttatttttggaacgcatgtagtactatagctggtgcataaggctgcggtgcagtgccaccagcagctagagatgaattgatcggctgcacaagaggagggcggctaaggcctctcagagcgcaagcaccggttgccggatcctagcccaaaaattgtcccaaagacactcctccccacagtacaagaatcctattctgtgtagcttaattgaatgaaggtactatggaaggacactgagcccacagtgggcggaaccccaagcgcatgacacgggtagtgcggaacaaatttat

SEQ ID NO: 69290 - DNA, 737 bp, Oryza sativa
ttcaaccaaaataacatttcccccaaaccgaaccaacccattttatatttttggctgaaaccatttccaaaaaccaatccaactatcggaggcgctgccgtcggcgctcgctcatcctattgatgttgatcatcagacaaagaaaggaatgaaaattgatgaattgagttacatgtatgagttgtttccggacggcctgaaactcgtcgttccttgatgagcagagcatggttgagcaactcctttgctcgcatatcatccatcatattatctttgtcttgctctagcttcttctccacattgtcttggtcgagctgcttcgacgtcgcgccaagctccggcatcttctaagtggcagcgatggccgagctccggcatcttctcggcggcggtgatggcagccttggcagggatgcggctcctgctcattgggtagtaccagcggcaacgacggcaaactgtgttgagttgtaatccaaattcatttgcacttaataaagaccagcttctgccgtagtggagcggaggcccgtcgccgggaggcttgggccggagcaaaacggatcgtcatcccttttagggttccaccatatatatacctcttgtaagccgccgtgcggcgtggtaacctcaccccagatatagtgaagatattttgctggctggcgtccgtggttttttctctcctactttgggagggttttccacgttaaatctcgtgtcttctgtgattgatc

SEQ ID NO: 69291 - DNA, 5985 bp, Oryza sativa
ccaacgggacggcgccagcctctctggcgccgtcctcctgccaccgtggcgcacgcgaaccgacgtggcaggaggagggcgccagcatggctggcgccgccccagggaggagggcgccagccatgccgcctccattcctgtttctctgtatggagttgcaacggtgtcatttttattttatttttttggatgttttttcacactcaggatcacgatacaaccaaccacaaaaaaaatttaaatacgaactaccacttagctaagtctgaaaatatctagcataccacttagtctactttgcaccttcactaaaattagaccataactcctttagtaaaaccctttgatcaacacgttaaacataatgcactctaccactatatgaaattacttaatataattcaaaatataaccacatgaaatgacatatataagttaaatagtatatagagatgcaattttttatttttatttcatttttttgatatttttttcacacttaggagaacatagtaaccaaccgtataaaaaataaactcaaacggacaaaatatgtgacatatagaattttccaaaactctaccgaaacggacaaaatatgtcatctattaaaataggcgtaactttctcatacggactcggaatcagtcaaataatatatgcacggacatctacagaaaatgttacatccgattctccccggctttggcgatattaaaacctccaaattccgcttgcaagattgtgtttttgaggagagaagtttttcggtggagctttggaaaattccacatgccacatatttcatccgtttgagtttattttttacatggttggttcctgtgagttcctaagtgtgaaaaaaaatatcaaaaaaataaaataaaaataaaaaagttgcacatctctctcctctgcaatagttcggagagagaggagaggagaggaaaaattctacatgtcacatattacgttcatttgagttcaatttttctatggttggttcttgtatgtccctaagcgtgaaaaaaatatcaaacaaataaaacaaaaataaaaaatttcggggggggggcgctagccactctggcgcactccccctagccacctcagcatcgccccgccacgtcggcaggggaacggcgccaaagaggctggcgccgtcctgttgaacgacggcgccagccactctggcgcactccccctagccacctcagcatcgccccgccacgtcggcaggggaacggcgccaaagaggctagcgccgtcctgttgaacgacggcgccagccactctggcgccccaaaaaggaccatttttgggataagtttttctaggggtctatttacgaaataagtttttcaaaaggaccaaaatgtgaaaaatcgtcttctaatattttgatattttgcttgcactgtttgatcacttgttttattattatttttaaatataaaaaacgaaaagttgtgcttaaagtactttgggtaataaagtaagtcacaaataaaataaataataattctattttttaataagacgaatagttaaacagtgcaaataaaatatcaaaatcccttatattaggggacggagggagtacatcatatgtatactattattagtatgaatgtagttaagtttttttttcaagatttatagtagtaatgtgttattattttcgtaatagatgaagtgacaacggcgcgtgtgtgcgaacactggcatttcgaatgagttggaaaacgacgacttcgattagtagttgatcgaaaaagtaaatcaagtcgcttgttcggattggtgtctcgtcctgataatgatccgcgatctgcttggagttcaaacacacgcacgtgcgctgcgctgccgtccgcgcgctggattgctgggaacaaaacgctaccgagcgtaccgcgcgctgtggcgttctgcctctgcctgcctccatgtacaccacgcgatttcctgcacggatggcatcaaatgtatctatccgtgacacgtagcttagctattatgtaaaagcatttaattttacatttttttgcggggaatttaattttatatttttataactctatttaattttatagttgagatagtgttctgagaaggacataaacaataaataatattttcattcttacatattttttaaatataatacataataatcctgtctttgttttaacataggctactgcctcttattataaagttttttttctctaagttgaaccaaatatgaattaagcaacaaaaatatgatgacaaaacaggtttgaagcacatgaacacaaaagaagaaatacatattattgcagcctaccagtaaatctccatactaatttaaagttgatgaatattgacatgatcggtgacttcgaattgttgcatgcaagttaaattacatatttattcacgtcgcaccttttgtagttgggttcgaaaccgaaaccagaatgttgccgtgaaaacaaaatatctttatcatgaacttttgatatatgctttattgctctaatttagcaaataatttacctctacagctccaagtttttttttagctttagaaattattggagttggagctgctgatatattagagttattaggatgagacattttattcatattttacactcctccttttcccctttaacttggactactaattaagatccattaacggctaatattagtgtattgcctttttcgcttagctatcacacgcatgccaaacatgaccataatgcacattatgggctccaagaaaaccatggagcgcaaagtcatagagagaatgggagaggaattaatgccgtacattgtacgccttttttcttttatattatatgcggcgttacactacagtcatgcgatccatcaagtcagaagtcgccttctgttccgttaggcaggcagaggcctccttcccctttttgattttcttggcgtccaaggtgctctgcttaataattagtctcaaattaatggcctgtcaattggtcaaacctcctgttattttatatacttcgtcgtaaccaagagccagcagctcatggacttttcgtattatttccaccttctgtttttgatctgagtatcagagtatcatgaagcagatatgatgcttggtctccaaggctcatgcttcgcttccaaggcggcgccagtacggaggtccacttgatatgatgattaaactaagaggccatccatgtggggctgtgggcatgcaactagatcttaatttaccatcatccaagatttgcctttttttagtttcaatactccgtatgtactccctccgtctcataatataaaagattttgagtttttgcttccactgtttgaccattcgtcttattcaaaaaatttgtacaaatatagaaaacgaaaagttatgcttaaagtattttggataataaagtaagtcaaaaaaacaaaaaataattccaaaattttttgaataagacgagtggtcaaacagtgcaagtaaaaacttaaaatcccttatattatgggacggagggagtagctaagatcgattaacctatataaacataacatcaaatttctgctaagctttcacacatgacatgtatcatcactactctctgtcccattctaagtgcagccatgatttttcgtacacaactttgaccgtccgtattatttaaatttttttaaaaaaaattaagaaacataagtcacatataaaatactaggtttatgagttcaaatcagtaggatattatgacatgtatggattgaatctgatctctaagctcaattaggcacgtgctcgataaagatagcctgtttaaattgatatggacacttaatcagcctctctctctttttttctttttttttttgctctaaagaacttgacgacgttgctattatacagcatgggtttggttgataatcctcgcagaaaagttaaggacaggatcacatcgattgcacaatccaccaatccaatgcaatctcatggggtttatctccgattaaaaatgagctgaatcgtacggttttgactcgcccattgattgccgaaacgaagggcgtcgcagttaatttgtggtctcgtggatggccggaaagagctctttcttaattactaatccctccgtcctaaaatatagctatttctagcacagtgtcttatcctaaaatgaagttatttcttcatctacctcctcctctcaaccaatcacaaccattctttttcacctactttctcttttcaaccaatcacacacttcctccaatcattctcacctactttcttaatacctgtgccaaccttaaaaatagctttattttgggacggaggaagtagtaattcttgtcacttcctggtgatgctatcttctagaagagagtactgtatgtagctgtctcgtgtccgtgatgcgactgtgcaagtggcgtaatcgatggtgcaagtggagtaattgggaacacgaaacgcacgtcacatgctacgtacaagctgccgttgagctctgcacagcctagcagtttaatttaaaacgttgatacggttcatgagatgccatgttctcgtgtttatcgtttagctatccctgtcttctgcatagagacgcgggcacaagcgatactcaatcatacaaaacaggagtggtacagaaaggcacgaaacttagcgtaaaacaaaactggaacaacaactcaccaacaccagcaaattgaacgaatagattgctccatctgccttcccgcttaatcagcgtagcaggcatgcgggagacacgccctccaaatcactaaaagcagcactaataatcggcagtttatgaatccgaatgaacatttcaggccattttggtttgactccaaaatatgccatattaaattgttggtattttattaaatagtgaaaaccttgacctgcaggagtaaaatagcctcaagcatcatgcgtagaaaaccttctcacacacataggttaagaaaacccctgaactttaccccaccataacccaggcatcatgcgttgaagaccttctcaggcatgtcaagaaaacccccgaacccgcccccatctttacacagcgacaccgtaacccatgtgagaacaaccaatgacctggcatcatgcgtaacgtaacccgtgtgagaacaaccaatgacctagcatcatgcgtggaagaagaccttcttacgcacgtcaagaaatcccccgaactcctacccccacccttacatagcacatcgtaacccatgtgagaacatctaattacctggtccgggtctaagagctatactttgacatgggacagataaggggattttttttaaccctagcctggaattcgctcccatggagaatcgaatccagtgaggagtgctgttagagccacctgaccaactcagctaaaggctcattgtcagggttatggataccacatacctaatagtagttgactaaatctcggcaggatcgactacataccatgtcctatacggaagcaaccttcggataaagaaagacacccagagttctacatggaaacgacaatgactactcggattgtatctatattgattttcctagttctacttggacaaggagacacctataggtataaatacaagccccctaggaggagaggggacacccacgaggggacgacacacacactcaccatgaagagacaatctgtagcgcccgttccgtcgtggcgcctagcggaaaaattatctcttaaaaaccctattgcgaaatttgtttctttgcttgttgtctagtgtccgtgccatctcagatctcaaatccccgatctatcgtcgagttcaatcccgaatccaaatccttccaaatcaaatccctccgcaaaagtctattttgccttccccagggtcgatgggccgaatctctctcggcccatctccccctccctcccggcgctctctctctccctctctctctctctctccctctctccc

SEQ ID NO: 69292 - DNA, 12826 bp, Oryza sativa
aatgcacattcagcttagaaattcgggttcgagaatttctgggcgtgacaccggcgccgaccgaccgaccgcctccgtttcccgtgctgttgcttgccaccgcacgacctgtgcccatgcccgagagagagggagtctcatcgtgctctgcattccgccccagctcagcctccgcggcgtgcagtcgctgcccggcggcgccctccaccgccgaaagcaccgcccgcaggtgccagcgccgcccctccatcagcccaccgcccgtccccacgccgccacccacctccccgcccctgtgcgctgccccgtgagagagagaatagagaggagagggaggaagaggggaagaggagtatgacaggtgagacccacatttttttagtatataaaatgttgactggattgtcacgtatacgccacgtaggacaaaactgctctggattgagccgaggtggggtaattcgtccggtattgaaagttctgggtgagtaatgtctggttttcggattcagaggggtaatttggtcgaccacgatagtttaggagggtaattcgtactttttcctttctcaaaatccttgcgccaccatctccactttcttctctggaagcaaccttggaatatattagcatattcgtgattgtttaagtaagaaaatcgctagttagcatttagcaagatgggtgcatgcgtactaaaacatagagcagtaaccaacatgatcatcaaatatgttggaaatttctgtacctaatcctaaaacactcgctctcactgaactctgaatgttggtttctaaagtttttcagactgctacaattaactgacggaaatcgaaaaaaaacagagtatcgaacgcaaaaacagagttttggtgctgcgtaatatttcagcaacttttctcggttctctttcattatttatattccaaactccaagagtttgttacaaacggaaaacaacaacaaaatcgtgacttgaccgtgttaggaaaccaatgtcctatgaagacccagcccaattacccactattgagcacatcactaaatgaactttggtttgaaagtctgaaagtgtgaaattctgaacatgcagtagctaatatagatcggtcggtcgaggcgtggtaattatattgaaatttccaatcaattctaatttggttgcataataaattccgatttgactccctctcgatcggacgcccgaccgggagtcgcgtccaaaaaaattctagagtccatatagaaataaaatttataaataaccgaaatttagaattaaaaaaaggaatattaggggaaaaaagtctgaagcccatataggaatacaatttacaaatgataaaaattaaaaattaaaaataagaaaaatcagatgaaattctcatggcctagatattttcatattaattagaagaaagaaaaaaatagaatccacataaaaataaaacctaaaaatagttgtaattcagaattaaaaataagcaatattgaaagaagagactaaagtccatactacaagcatataatttagaactaatgaaaattcagaattaaaaaaataagaaacatcaaaagtagagtttagagcccatatagaaatacaatttagaaataactaaaactagaaattagaaaaaaaaggaagagtgggagaagagtttacagtctatataggaatacgatttataaataattgaaattcggaattaaaatgaatgaatattaaaaaaaattctagagtcgatatagaaatataatttacaactaactagaattaggaattagaaaaaaagaatattgaaagaaaagtttagattccatatataaatacatttacaaataactaaaattaaaaattaaaaaaaatgttagaagagatgtctagagtccatatagaaataaaattcataaataatggaaattataaataactaaaattcgaaattaaaatgaataaatattagaaaaagagtctatagttcatatgaaaatgcaatttagaaacaactgaaatttaaatagggaatattgaaagagagttagagtccacataaagtacaatttataaaataactaaaattaaaaattaaaaaaggagtgttgaaagaggtgtctagagcccatacaggaataaagttcaaaaataatagaaattcgaaataaaaaactgaggaatattatgagaggaacttagagtccatatatatatagtatataggctctgttcggcaacactactctactgttgtaaccggctgtgctgtacagcctatttatatattttctttaccatacactgtagcggctgctgttgtgcagctgcagtttagctacacccaatagacccataaatacaatctacaaataactatcacatatatacaatacaatataaatatcacacattggttaataataaaatgtaaaactatatatgctattttaagaaaaaaatataacgatactagccgcgcaatctgcgcgggccaccatactagttaaaataaaataaaatttaagccattagatcgtgatggtatcaaattataataggttttgattgacagcaataaatattttcactttcgctgggacttttgggttacttatacataataaagatttagtatgagccagtacaaacctatctctctaagagtaatatacacaaaaaaaaaatgacatatgggcccacccgcatatgaagccttagcggtttcacaacaaacatcacgtgctagcggtggcggatctaccataggggctatgggatctcgagccttcactactgacgttgaaaccatgagagccctcgtaaagcccccactaaaattttctgtcatacatccattagaagagggggctatagctttgtatagtttgttttatctctcctattagttatttctggatccgcccctgcgtgctagtacaccatcaccttataaaatttgttgcactggcctggatctgcttaagctgaattatttaaggtaaggtgacctcacgaataataaagttcaggcttagacaacctaggtgtcggtattgccaccagcggtgtggccttcttcatcacgatcccaaacttctcggacaggtcaagctgcacgccctgcggcagcttccagtcgaacgcctgcagcagcatggcaaccgagtacaccatcaccttctcccccatggccatcccggcgcacatcctccggccggacccgaacgggaggtagtccagctggctaccggtgaagtcccccttgtggccgccgtccctggcgaacctatccgggttgaaatcgagtggcttgttccagaccagtgggttccgctggatcgcccagacgttgatgagcacgcggcagccctcggggacgtggtatccgccgaccgtcgcggcggcgctcgggctgtgcggcaccaagaggggcaccggcgggtgcagccggagcgtctccttgatcaccatgcggaggtagtggagctgcgggaggtgggactcctccacgacggcgtcccggcccacgatgctgtcgagttcttgctgcaccttgttcagaacctgagggttctgcagcaactccgccataatccattccacactgttcgacgtggtgtccgtcccgccgaccaccatctcctgttcacgcatatatataacatatagagattaaccgatttctgattattgaaattttgagaccatttcggaacctgcgggatgaaatgctaatgtggagaaatgaaatcgagttgcaattaattaattaattaccaagaggaagccctttacgttgtccatggtaaaggttgttttgccgtcgctaccttccttttccatcttgagcaagcactccaagaagtccgttgtcatctcgcccccgtcttgctgggatctcatccgctgctgtatgatcttggtgaacaacaggtcgaaccgcgacctgagccgctccatcttcctccggataccctgcaggtcgaacggcttcagcaccggaaacaagtccgagacgttgggcgttccgaggagctcggtgacctctgcgacgagacccctgaactcgctccccaccgccgacctctcgctctcgcttccgatcgttcccccccacatggtgcccgtgatcacattcatggtgttcaggaacatctgcgcgccgacgtccaccggctcgccgggcttggagtggaggtaccggagggtggacctgaactcgcgccgacggaggccgtgcacgctggcgagccccgcggggctcatcatctcctggacgcagacgcggcggagcaggcgccacataggcccgagcgggttgcccacgatattctgtgcgccgccgaaggagacggcgtcgccggcatccagcatgacccggttggcgaagacggagtcctggtcgcggagcacctcgcgggccagctgggcggaattgacgacgatgtccaccttggaaccgaggcggatggagaggatgggcccgtgcttcgcggcgaggctagcgaagtaggtgtgcaagtttgggtcgatgaatgggaggctgccaacgagaggaagccccaccggtcctggtggcaagcggcggctgcgccgccgggtgacggcgaggtacagcaccgttggcacaagcaatgcagcgtagagaagatttgctgttgccatgggctgcatgactatggagatgcatcactgtgagaagtagtagcagtatcttatcaaataccacgctctacccaagcgatctataaatgccactgtcagctagcttcaggccgaatttgaaaggtatcagtcgatgagaacaattgagattcttgttttgtcgacaacgtactatccaatcattctcacccttccattcctcaatctattatagatgtggatttttatccctacagggaacctcccctcattgtttacatgtcatctgaatagttattaaaaaaattaaaaaaaattaacaatatagattaataagaaatatatcactccataaatatgtatgaccaaatttaacttctacaagttgcaataaaaatagtacattaaactaaaaatagttatcgtacattcacaactatatttgttatttttgttacaacttgtagaagttgaatttaaatttgcatgtttgtggagtgatatatttcatattaatctatgttgccaattatttcatattttttatgactatttaggtggcatgcaccgaacaagaggatatccctcgagggataaaatcactttcccaatctattactatttgctcaaatcagtcgtgaaatattctcaatcaatattgatgatcggattgagatccaatgattctctttcttttttttgggggaggggggtgcggctagtgttgggcaaagtaggagggccaggatagaagtagacgatgcttaagggagaggaagatggtagagacaagaattttctacaactaggtgctatagcagccgttatttacatgtgatttaaatagttatagaaatgttaaaaaaaatagtaacaccaattgggatgacataaatctatatagacaaacatgcaaagactaaatttgattaacaaccactaaaacaaacataataaaatcagacaatgaatagtatttgtgcaatgcagataaaatttattattttaatttcttcatttgtagctcgaatttagacttgcatgtgtggacaagaccataattaaggagcaaaaagggtttatctcaattataaatactcatgtaaagtacgcaaggaagagatttagcacaaataagtaattatgcctaagtgaaaaaaacatttgatgtggttttgggttaaggggacatttttaatggcttcggatttataaactaaaatttagggtatacaatttagtagtttaaggtgtactttttgtaggaatatagatgtgaaatcatttcgtcaatttagtgttttgtgatgaacaatttgttgtgtgagtgtctgattaattttggatcaagtgttctggatgagagagtgtacccagctataaatttagagaaaattcaattcatagaaaaaaaaacaacccggtaaaaaaagatagcacaagaagttttcccttccatcaaaaaacacaggtcgtacatatttatcttctatatataacacttctgttacattttgaacaaacgacgttagactgaagtagagtaatctatccttagaatattttgcccttcgttttcctcggtgagcctactcgctgccagcctcctgtacccgtttagccactgccgcgcggcggcgcctgaatccacgacgcgcccgtgcctgctcgatctcgtgctgaactgcacagctgcttgatgctcgctcctgtgcctgcgccgctgcgcggcccacgccgaccgccgccttgccaagcctacttgtcggtctcccgagccgtagccactatcacgcgtcaccgccatgagtccgcaatgcgcctgcaccacccacaccaccatgcctgctcccgtgccgaaccgcctctttggcacttggctcagtgacgatgaaagcaaagagcaaatttaattagcctgaggataaatttctctactcggataaaatctaacgtcatttactcaaaatgagacggaaatgctacttatcaaaggaaaatcggtgacctgtgcttttaacttaagaggaaatttttgtgtgctaatttttttacccttttttcagatcgaattttctctcaaatttttagtcaaagctatagcacgtgccacgtggaaagaggtgatacaatattttatttttgcaggtctcatcggatgaaaaaaatagataatggtggacttaggtgatatgacttatctatagctagcagttatagatagttctatttgtacatgctctaagacaagatttgattcattttttctttttttaaaaaaagaacagagcaactaggtagcgcctcaaataagacaacagtatggtcgcagctgctcgaaaaaacagaatgcatcactctggtatattccttttaagtttgagggaatctggccagccggccatgcatatagaacccacttaggctgtgttttccctttaaacttctaacttttccatcacatcaaatgtatggacacatatatgaagcattaaatgtggatgaaaaaaaccaattacacaatttgcatgtaaattgcgagacggatcttttgagcctaattacgttatgatttgacaatgtggtgctacagtaaacatttaataacaatggattaattaggcttaatttatttgtctcgtagtttacaagcggaatctgcaatttgttttgttattagtctacgtttaatatttcaactgtgtgtctgtatacgtcaaaaaatttaccaaaacgactaaacacggccttaatattttagtgttcaatcttagtggtatcttgtattattcgtatagaacatgcagagcatctccctaaaactattcgatcaataacatgcttaatagttaagaaaatctgtaatgattgtcaggtataccaccatcagcttgtgtctaaatttctatccaggggcagttgaagctaggtatcaaaaccattgagataccaaggccacaataagacaaaccaaaggagagtaggagaccatatacttgtttaaaatttagagatatgtgcacctatcagggaattgtttttttccccttcaaaatacttatatgtacaaaagtaaagaattacttcccatctggatgtccgctggcatagttacttcgaccaccccaggcaataaaactgaactttcaatacattaaattaagccgaatctctaacacagtaagcacataaaaactagagtttgctggcgcgtagaacaagctgttgatatttgcgggtcgtactttcatactcctttcgatttttaatatttaatagtaccttttacttttaaaaatatatttgaccatttgttttataaaaaatatgtaattattatttgttttgttatgatctgttttatcattaaaggtacttccagtatgatttatatttattatatttttataaaacttttaaataaaatgaatgatcagtccaatagttacgtcaaatattaaaaaccggagacagtacaacacatgcaaagtgaatttgttcaaaaaggaattaacacctttgttttggatacttgttgccagatccatattcaaacttttatcacttgattggcaaattgattaataaagcatgtggatttcaccaaattcaaataataccacaaaatttgttagagagtgccaattaataccatgacttccatttataccacataactagataatgtgtcacttttgccccctttctaactctcttaccttcactttttactcctaaatatcatgtggtattaattggtactttccaaattttgtggtgttttatattttggccaaatctttatgctaagagttgaattctcataaaaatgtgatcctcgaatttttaatagacaacacctttgacttgaaacatatgtttgactaaccatcttatttagaaaatcttgtacaaatatgcttaaggtacaattaatgataaaccaagtaacaacaaaataaattataattatatatttttgaaaattaaatgaatggtcaaacgtatgtataaaagtcaattgcaccattaaaaatcggggagagtatagtataaccacataactttcattcattataaccttactatttaaaaactatgggtgtatttagttctttaggtgtaaagtttttaagtatacgggcgcacatttgaaatattaaacgtagactaataacaaaacatattacatattctgcatgtaaactgcgagacaaattgattaagcctaattaatccgtaattagcaaatgtttactgtagcatcatattgtcaaatcatggcgtaattagactcaaaagattcgtctcacaacttacatgcaaattgtgcaattggtttgttttccccacatttaataccctatgcatgtgtccaaatatttgatgtgacgtttttggtcaaaattttttgggatctaaacaaggcttatataaaaattgaaacggtaatagtagccaatactgataaatattttaaaatggaaaaaatcatttcgccatggtagcgcaatccactgaattccttattccgattgcgtgccttgcctataaatatcacctcaacacctttggttttttaaaaaggaaaaagctgcacgtacatactaacttttttcttactaaattcttactagcacagatgttactaaattcttactaacatcgatgtgtcatgctatgagtgcatctagattttttataatttctatttacctaaatcaaactgttgaaatatgattgttagtaaaaatttagcaagaataatttagtacgtgtaccggtgctcttaaaaaatcacctcaccacgcagtactgtgcagagtgcaggacttctcattttcttactttcttttcttttagggacagagtgcacgacttgacccaacctggagtggagatcagaaatcagatcgatcgtcctgaagtaatgtgcagtgcatgtattagaaaattttgaaggtaaatattattgttcgcctccgaaaatgtttacggtcaagtccacataaactaacccaaataattaactggattgagtttcctcagatttgccttctctctaacttatgttactgatatgtgggccttttacgcagcatgtacagcaccaattaatcgcagcacaaatgacttccttttttttttcattttgaaacagtccaagattgatcgatccagtgcgcaacattatatagcataatattgcgtgaattcttgatcagcaaactgccggcgatgtcttcttcactccagtgccccgacgacccggcgccatccatgaacgtggaggccgtcctccacatgaaggaaggtgtcggcgagaccagttacgccaagaactctacgcttcaggtcagcactccacatcggctcgtcaccatccatatctatatagttatctacgcatacggcatacgcccttggttaatccttggaaaaactaattggcgctatgcatgcatgcacgcccgcgcgcacccgtgttgttcctgcagaagaagagcatggacaccgtgaagagcctcgtgacggagtccgcgagggacgtgtacgcgtcgctcaagccggaaaggttcaccctggccgacctcggctgctcgtcggggacgaacgctctcggcatggtggaggagatcgtcaggagcgtcgccgaggtgtgccgcgggtcgtcgccaccgccggagttctcggtgctcctcaacgacctccccaccaacgacttcaacaccatcttctcccgccttcccgagttcaccggcaagctcaaggccgacgccgacgccgacgccggcgacgacccgatggtgttcctgtccggcgtccccgggtccttctacgggaggctgttccccagcaagaatgtgcacttcgtctgctccttctccagcctgcactggctctctcaggtacgatgcgcgcgtcgtacgaacgtgcaatgttcgatcggttgatttttgtgatgatatccttgtcagttgtctagatcatgtcgttttaaaatgcacatttctcaggttcctcccggtcttttggatgagacgaacgggcccgtgaacaaggggaagatgttcatatcgagcacgagccctccagccgtggcagcggcgtactcgaggcagttccggagagacttcagcctgttcctcaggtcacgcgccgccgaggtcgtcgccggcggccggatggtggtctccatgctcggcagggagggcgagcgccacgcggacaggaacacgaccctgctgtgggatctcctctccgagtcgttcgccgcgctggtgtcacaggtgagccaagttttcacatagcgtcttcggccgtgcatgacacgcgcaatatgcattgacgccgcgtgtggccgtacgccgcgcagggggtggtggagcagggcaaggtggacgcgtacgacgcgccgttctacgcgccgtcgataggggagatcgaggaggaggtgcggcggcaggggtcgttcaggatggaggtcgcgcgggcgtacgaggcgagcctgagcggcagcggcgacgcgaggaaggacggaaggacggtgtcgatggcggtgagggccatccaggagtccatgctggggcaccacttcgggacggagatcgtcgacgcgctcttcgccaagtacaccgagctcgtcacggcgaccatggagagggaggaggtcaggagcgtccagattggagtggtcctcacgaggctgtgacctgtcagcttggagactcggggagccctatgtgtatgtgttgacttgtgccgttcagtgttacaaaagaaagttctcaaaacaaaccagttttgtttcttatgggacaaagggatgtatgaacctaagcaacgtatgatggtcatcgttcctaactcacctcctttatttttcacacatatatttcctaaactgttaaatagtgtttttttaacaaaatttttctataagaaaattgattaaaaaagcatattaatctattttttaaaaaaaaatagctaacacttatgaatcgtttcgttttagttccaacgtcatccaccgaacacagcctaatgttcgtgataacatcacctaattcggtcattctgaaagagtttaatggccttatcgaatgaagagccccccgtcatcaaaatttctgactttttaaagtcagtttggtcacttaattcttttggtatatatttaaaaaaattacaggagtgagtatgtacggcggaaaaaacatactcatgcattttcatataaccaaacatccagactacacatcttagacaaaaaaaaaaaaaaacctttggtcaaaataagtacaatttgactctatgcttgtcagggagtcattcctttttcacaggctcactctatgcctcaccagagatagtcaatacttttttcaggaatacgccacaggcgcattttttctattaagagaaataaaagttatttacaattaaagatcgaaaaacagcagggggccgatactggaagacagaaacaaaatggcctgggatttgtgaaagaaatgatgggattgccgagtttgccgcccgccagagcgccgcttcctccgtcattcccttcgcaacatcgacccagatagtcaatactcaatactctactaatttctcacctagaaaagagttacttaactccgacttgcttttaatatggtctgtaactaaactaagttttggcactaaataaaaattatcctatactttcgacataagcaggtatttttctccgagcaataaccaattagagagtcgaaatttcctgtcaagactcgctgtacagtgtctcaccaatttgaagcttcttccgcaatttgtagaaacctcattaaagatcatgagtgatgttcttcctcgttagaagatcctgttttcgttgatgttgtttgaggaacagtcggatggctgtacttcttgaagacccgctcttggttttcccgccaccattcttcagcctgattctctgcaaatttcttcttgctgtccgacaaatttaaggagacggaaaattttagatggaaaggatgtagcagtttaacatctagattgcagcatggatagggagatgtacctgaaccggacccgcttgaatactttgctaccatccttcagctggataagtgtgacatatacaccaggttcaaactgctcaattaattgaacttctccatg

SEQ ID NO: 69293 - DNA, 22426 bp, Oryza sativa
ggtgggtgttgattgtgtggtcgtgcgtgtcctcccctctcctcctagggggtcttgtatttatatccataggtgtcctcttgtccaagtagaactagggaaaccaatatggatataatccgagtagtccttgtcgtttccatgtagaactctggttgtctttccttattcggaactccctccatatccgaagtcagtttccgtataggacatggtatgtggtgggtcctgccgagatttagttaactactattaggtatgtggtatccataaccctgacagtagcccccgacttcaatgcaaatgaacgaattcatattctcgaccgcagaccatggagtaactgttatcgagctcaagtgaccgttctcggtgagttcagagataacgttagacttcctttatcagcctcgtgcgggcacctaaagggtttgtctgagtcaatctctgacgtcaaccaagaaagtacagagcatacaactaagtctcacgtcttgccgtaatcgagaatttggattgaagtcaagaaattttatctcggcgggtacaccatctcttcattccgtattccttgtcgagatccaccaaaccattctcgagtgatcgagaaggcgtagagtctgcgacggagccttgtcaacatttgtcgtactcgccttagtcgatcttggtgtggaaccatagagacatggagtcttcgataatgtcgaatagaattttcctaaaatcaatactcagaaaagaatattagatagaaatagcccccgagcgaatgctcaaagggtgacatgttataatatgacagactagtgaattgaatgtacagaccagtgttttgtatatgagcgtcttctctcttaccgactccgatcagtcagtttgtagagtcatacactccccctagcccccagccttgtcgtcggagaatcgttctcggatgataaggctcttggacctttgacctgcttcggttgaacaagcactaatcctagcccccagccgtgaagttggaaaactcaatttccgattacacggcttagttaatacgcacggcgagaactcttacacgatcagatcttatatggtcttttatctctacaggatccgacaaggccttatcggctctgggcgtccccagccgaagtttccttaggttcctcggaggccttgtcaagacggcgtcaagggacagtaggataggtttcaacgctaggtgtcatcgtggtaagggatctctgggtaaaacacttggcgatcttgtgtacctgatatcaactttgttggagtagaggtaatgggagaatcgctatacctctggtcggggactaggtagtagtcgtaactcaaccacttgaagtggaaatagtgggagaatcgctacaccgctggtcgaggacctggtgtagtctaaacccgaccactagaagtaagggtagtgggagaatcgctacaccgctggtcgagaacctggtgtagtctaaactcgaccactagaagtaattgtacgagagatcgctacgattgactggttgagaactagtgagtaggtgtctctcgatcatttgaagtcgtctgaagtcgtagtgcaaggaccgctactctgctggtcgaagaccagtcatagtcgtacctcaaccgtctaaagtcatctgaaatcgtggtgctaggaccgctactctgctgccggtcaaagaccagtcgtaatcgtaccttgaccatctgaagttaaggcgcgagagattgctatgatttactggtttgagaaccagtgagcgaatagaattatctctcgaacgccaatggaagtcgcggtgtgagagattgctgctgtcgaatggttcgggaaccagcgagttgaattatctctcaaacgccaatgggagttacggagcgagagattgctacgtactggttcgggaaccagcgagcgagcagaattatctctcgaacaccaatggaagctgcagtgcgagagattgctacgtactagttcgggaaccagcgagcgagcagaattatctctcgaacaccaatggaagctgcggtgcgagagattgctacgtactggttcgggaaccaacgagcgagtagaattatctctcggacaccaatggaggtcgcggtgcgagagattgctacgcactggttcgaggatcaacgaatgtgtagaattatctctcggacaccaatagaggtgttgcggtgcgagagattgctacgtactagttcgaggaccagtgaacgtgtagaattatctctcggacaccaatagaggtgctgcggtgtgagagattgctacgtactggttcgaggaccagcgaacgtgtaggattatctctcggacaccaatagaggtgctgcggtgcgagagattgctacgtactagttcgagaaccagcgagcgagcagaattatctctcaaacaccaatggaagctgtggtgcgagagattgctacgtactggttcgggaaccagcgagcgagtagaattatctctcgaacaccaatggaagctgtggtgcgagagattgctacgtactggttcaagaaccagcgagcgagcagaattatctctcgaacaccaatggaggttgcggtgcgagagatttctacgcactggttcgaggaccagtgaacgtgtagaattatctctcggacaccaatagaggtgttgcagtgcgagagattgctacgtactggttcgggaaccagcgagtgagtagaatcatctctcaaacaccaatggaagtttgcggtgcgagagattgctacgtactagttcgagaaccagcgagcgagtagaattatctctcggacaccaatggaggttgcggtgcgagagattgctacgcactggttcgaggaccagcgaacgtgtagaattatctctcgcacaccaatggaggtgctagagttggtttattacatgtgcgtctcatgtggccagcatgactcacacacccaacttgtagcatatccggatgtccgttcacaatcatgtcgggtgatcaagccgacggcgttcgcgaggaattatccgttaacaaccttttctcgagtagtccagccacggccggtgctatgagataggtcgtcggtcttcgttggtaggttcggcgcgacgactctgcatttgtcgagatcgttctcgataatgcggtgtactcgaccacgacctaatcgagtgcttaattgttcctgaaaaatattttctagaaggcaagatatatagcagagaatatcgagtatgtaatcaaaaaactgcatggatcttctagtattatcaggatataacaagcagatgtaaatatcaggcattatgtaaaccgtaaacaagcatgatttatacagaagagaacagagcgagcccccagcgttagaccgtagtcggttttacgtcggaaacattcgcgcaatagatattgtataaaaaatatgctctaggtaaacataataaattatagatctgacaatgctgtatgatctgaatagatacgataaattacgtataaaatattacgtacctttgtatatacataccggatgtatctacgaaattagtagatcaatttaaaaaatcaatctcataattacctttgtttatgcctgctacagtcgacaagcatgtagtagagttggacgtgattactttgttggtcctgaaaaacatgccgacctgtcatatgcttacacgtgtgtgtttgtgcacgtgacatgtctaggccaatatgctttgttgaccatctccgggcaaaacacgtgatagcacaagtgcactggtactcggatgaatcccggcggtgcggcgttgcattgtgctcggcttggacatggtggcgtgttggatctggactcggtcagccggtgcttgcgcagcagccataccagctgatgtcgtaggcggaggtcttggcagttgattctccgcggcgttgatgttggatgatctcggtagatcaaattgttgatgacgatgattccgatcttgtcgggggacatactccggtcaggttagatcttcccacagcgaagtcgtcgagtatcttgttgtcgaagaatctatcttttgaactcatctcgtcgaaatcctagagcaccaaagtcccctacctggcgcgccactatcgatgtttgatgtcgcgattccggtatttgcatagtatggggatcgttggtactagggtatacgcgagactaaggtaaaagtgacaaagacggggatttttatacaggttcgggcccctcaattgtcaggtaataaccctatatcttgttggccgaagccggtattgctcttattcaccataatcacaccagtacaatatttggggtagcctatctaactgttgtcgacatggtggtctgaaggtctgactcgtagtcgacaacagggtagtcttcctcctcgagttcgtgcccggcgagatcagagataacgctttcgtctctcttgacagtatccggagacaccgtaggggactagccgtgcttatccctgaagtcgatatccggcgtcttgtcttggcgtatgttggcttgtatgttgatctatgttccgtgtatgttgattgtgatgggtgtgtattgtccctgttatctgttgattgtggtgggtgttgattgtgtggtcgtgtgtgtcctcccctctcctcctagggggtcttgtatttatatccataggtgtcctcttgtccaagtagaactagggaaaacaatatggatacaatccgagtagtccttgtcgttttcatgtagaactctggttgtctttccttattcggaactccctccatatccgaagtcagtttccgtataggacatggtatgtggtgagtcctgccgagatttagttaactactattaggtaggtggtatccataaccctgacatatgtatttatattttttttaaaaaaaagatgagactgtacacgcatttccctgttttagtgttttatcattatgggggtgctctccttccggtccaaagcaatgttctctttgtcgtcaaacaatcaaattgatctatttaatctcttaattatgagatgcactcctttgagttcaaatcaaattgctctatattatctctttcttagaagatgctatcttttgtccttcacttgttaaagaaaaaatactaggccactaggggggtcagcttcatcttcaaggtcccccgagcgttatctttccgaaaagttgttcatgacatgggttagatttgttttatacgcacaaccgaaggccaaacaagatgtacctttcctctcgtcgaatggtactcttctggttttgttttcctgtctcgtgcagacttcaacacatttgtccagtgaaaaaacagctccttcagaagaagaacgaaagtgtcaagctgcgaatttcttcatccagcaccctgtttcccaagatatcgactcagatttggtttgatgaatttgatccaagatgttattttgctcatatattcttagagatggatcgtacactaactcactgcactgataacttgctccctcttgatagtttgcttttccaggattacattttctagctaatgctaagtttgggcagcgggatttttgaaaacacgtacggaaatgaaaatctcacatgaaacagttggttggagcatagaaaaaacacaagatttttagaagaaaaagctatacacgaaggaaaaaattttagcgttttagctgacaataggaatcgttcaaaatttctatgaaacatataattccatataatttttaaaggaattatagtgtctcgatcctttgtttcaaagtaaatcatagggatttttttctactggattcaaattatttaaaaaatcttatatgtttcctttgttctcatatgcatatcacggttaatactcaaaccttttaatctctaaaattttggggtttccacctagcttcatccagaacctcgtatctgaccacaaacaagaaccggcacgacaaccattagcggacaagaaccattagattgttagaacatgtatgtaagaattttattttttatttttaaatatgctatttcgttttttcctccaatatactaaaagcaaaggttaaaaataaactacaataaaaaaaaactttaaaatcaacttaaatttaaatttaggactaaaaaaattaaaatttagctaataagggtctgtttagttcgtgaaaaggaaatttttgggtgtcacgtcggacgtttgaccggatgtcgaaaggagttttcgtacacgaaagaaaaaactaatttcataacttgtctggaaaccacgagacgaatcttttgagcctaattaatccgtcattagcacatatgggttactatagcacttatggctaattatggactaattaggctcaaaatattcgtctcgcgatttctcctctaactactgttaacgaccaaatttggtaatatcagcatcggaaaaggagattagatcaaggtggagtcgaaggcggagattgatccgagaacagagcaagaatcggctgaagtccagattggctacgattagaatcggctgggtctgagtcggactaggtgagccgatgcggccgattctgacagtataatttgatgtatgacattgggttgaattgaggtgcttcaagatgattgccgcacatggataaagtcctgagaaggcaattgtatctattaatttggatgttttatataacttccttagagatatgtttgggcaaaagtctgccgcaaagacttatggtatcttagagttttttagagatagtggtcgtgtccggtatggacatatcttgtaattctcgagtataaatagaccccgagccctatgtaattttagaacacacacgttcaatataatttcggtgcatcgccacatttttgctttagttttgtttcgacgagttcttgctttcgggttgagctgcatcggtttcgatcttcaacaagaggtaatacttgttatgacgacttgcgttctcgagattagtgcttccatctttataacactctaatcttgtctatataattcgtcaagttatcatatatcctacataatctttggtaatatcgtcatctaacctacaatcggctaacatctgttaatagaaggcaaccaattaggttaaatagcgacattgtcctagattatataagatatctaccactttatgaaacacccagcggtttgattgtctagatattgttcttcttttcatacttaatgctgcatcagttgagtttgatctattaagtcgtgcttagaatatcaatctctagcctgtcctctggttgccgattagggtagtatcggagtttcagccgatcttatttgatttaaccatattcgatctatatgcttcaatgacatgttaaatccgccctttatgtcaggatcttattgcatttaagtatattaagcttttgtttggtatatgatatttgttttgatatctttatataaagtagtatcggagtattagccgatacatgctagatctatctgatcggctatgctataaacatatataatcttgttattaatatatatttcgatctaagtgatttatactgtctcggcatgatgaccgatctatcccaatcacttgatttaagtatatattaatataagaactatatatcgttaatatctacagccgatcgaatagatttagttccttactatctatttataaccgccgatcgattcatatatgacatcggctcaaagataaatgatatgtcatcggcacccagccgatcggctatcatttatagatttaaccacgaattctttgtctctatttcttgttgattataggatcaaatcaactggcacgctcatacattcgaaggcgagctttggacctgcactggagttaagcagatctcccaggcctcgtgttttctgtcaacaactatgcaattagtttttttaatttatctatatttaatactccatgcatgtgtctaaagattcgatatgatgtttttaggaaaaagtttttggaactaaacagggcctaagtactccctccgtcccaaaatatagcaatctagaaccagatgggatatatcctaatactacaaagctagacatgtcccctatccatattcgtagtaatatgatacgtcccatccggttttagggtgttatattctactctctccgtttcacaatgtaagactttctagcattacccatattcatgtagatgttaatgaatctaaacacatatatgcgtttagattcattaacatctatatgattatgggtaatgctaaaaaatcttacattgtgaaacggaggaagtaggacggagggagtataaggtaaaggaaaagacaaggctattcgttggcatctcggaagtcgaaagcacacgaagcaaggcaaagcattttaggccacaaccacaacgaaaacgcttcgtatcgagcgtccgatacgagacaaactccggacggtcgatggggcccacctttcccccatcttatcctcttccttctcatccccaacctctcgtttaacttcttctcagcgtctccacgctgcacatgcggccgcggtgtcatcagccggtgccgccaccgccgccgcagacggcggggctgccgtcgcggatggccggattctggcgccgccggcgacgttcgttagcggcgtcgtgtggcaggcgcggtggccgtgttccgggcggcactggtaatggaggcgccgggcggcgtcaaacagcgacgaccgcgcgccgctgttcttcaccttctccctgatgacggatggaagaggaagcgtggggtggtgctcgtcgccagcgaggactaccatgcgctcgagcggtggccggtgcagcagttccggcggcgggatgcggtgagcgccggcacccacgttggcagcaacggggcagcacgacggaaatgcttgagacgccatcacctgagagggttctgagctcggcgacgaaggtgaggaggctgcacactacatgtttttttgttgcacatagtgtgttcctaatgttgcaatccgttttttctggatgtttcttaaatcggtaatggatgttgcatttagtttcttcggatgttgcatatattggttttttttgttgcagacaacattatcgagtgttgcattcgattgaaacatcttcgataaagtggtgaaacattttttttcgagcggtgaaacattcaatgaaagatgaaacatcgagaaacaatttttgttgaaacattttttccgagcggtgaaacattgcaatattcattcaacatactgtgaaacatcgtctggagattttatgttgaaacattacaatattcattcaacatacagtgaaacatcgtccggaaacgtccaatgcgtagctttctcctaaccacaaccgctgccgccgtcattgcggcacaccggataggaggtgatccggatcggagccagtgccatgggacgggccgggtatgttcatgggcaaattttttactggcggtgggcttggtctcaaaagccgagtttgactggtactgtgctcgcgtgggccacgggccacggcctccactcttcttgcctctctcactgtgcccaaaaccagatcaaagctactggtctcactctcacggtctcacctcaacatatgttttccctcttgccgcgatggtcgctcgagttgttgatgctattgatcagctagttattccccggataaaatcctttccattgacgctgcacatataagaattctcactactagtagtactactactagtactactacagtactacctagcagcatggtactagtataaagtatgtgtcctggtatagaattactacatgtgcaaattggcactatgatggtacagtgcacgggacgaatcgccaaaccagaactagcataggagtagctagatgcatggtcagctaggcatggagtatggtcctccgatcctaggagaggtgatcatcgagcacacatcgatcgatccatcgatctagcacgtttgtcttgagttttactcctacatgcacatgtcgtcctcggaatgaataaggtggctccacgtactactactcatctcccttctccaactccaatcgatccatggcaataatatctgcactgaaacgaactgtcacctgttgtgttgctgctggtacgagtagtaggaccagcaatgagcaaaatggtacagtactactcctccaatagctaacgctactagtactcgtgctacagcactggatgtcatgccggccaacgaccaaaatggtacagtaccagtgtaccacttccaccacaaatcaacagctacagtatagtataggctgtatagtcatgcatggaaatcgttggattaggagtacaattaagggggtcaaaaggagaaagtcagggctcgtttagttggaaaaaaaattaccgttgcatgtcacatcggatatacggatgtacatttaaaatattaaacgtaatctaataacaaaacaaattacagattccgccagaaaattgcgagacgaatttattaggtataattaatccgtcattagcaaatgtttactatagcaccatactatcaaatcatgacacaattaggcttaaaagatttgtctcgcaatttcctggtgaattgtgtaattggttttttttgtctacatttaatactctatacatgtgtccaaacattcgatgtgacagcgtgaaaaattttgtttgggaactaaacaggccctcactctatccatccgaaaataaactaactcttaccttcgtaagtcgagaaaatttattacttcaatatcccttacgtaccaactaatactagcatacaatatttacattaaataaggatattgtggggtttttttctctccttaaaattactttgacatgctagggttcgagattttgggggtatattgggagtgaatccagaggccgggatcagcatggagagacagcactgctgagcaacaaagcaagcatcccagcacagcatctgattcccctgcccatccgatgaaacattcgttgcagcgaaaaaacacaaaagtcgtcgtcgtcgtcgtcgatgaaaaggcaccggatcgatcgaggtatgattgcatggtggtcatggtcaaatgctgcttgggcatatgctgctgctagcggcgggagggccccggccggccgtcgatcgactgcagttggaacagcggccgtgagagccacctttacccaccacacccatccagcggcaaggcaggggatcgacccggacagacagccgcggaaaaggttgccggccggtgagccatcagccatatggacaccaccaccgtctgtcactctctcactctgtcatcagtctgtgtcactcacactgtcagtcacttgccactccaaacaagcatatggagttcggccctgtttaaataccacctaaaatttttcatcatatcatatcaaacgtttgaattattaaacacctaaagtattaaatataggttaaaaaaataactaattatacaaattacgactaatttgcgagataaatcttttaagcctaattgctccaagatttgacaatgtggtgatacagtaaatatttactaatgatatattaattaggcttaataaattcgtctcggtttaccgacggattctataattatttttttattaatacccaaatactcttatatgacatcttatgtgacacgataaagctttacactcctgcgtcaaaaaacacccctggtagaagtactagcagagtaatgtagtggtagtagtagcatatgcacggatcaccaaaagaggtggatttgccagcagagtggtacacgtctcctgcagctgagctcgccgttggactggacgcccagctactagccctcgccattgtcgcgcgcctcggaagtcgggaccgagtaggagtagtgcgggaatcccatgcatgcatgcacgcgtagccggaggccggagcatatgccgaagagaaagccggccggggaggagggcgccgacgtcgacgccggctggccgcagtactgtggttctctccccagtcattggccgataaaagcagcggcgagcgagagcagcatgcctgggatggttttattaacgcatgtttaattaaatattagtcataaaaataagagaatggataaatataatttttacaagtacttttttttataaaagattttctttttaaaaataaaaataagagagaaaatttctaacatagaacacaccttaagttgtgttcgtttttttttttgctgggaactgattattttccacataccttattagcacacgattaattaaatattaattttaaaaaacttaaaaaataaattaatacgattattttaaaatatatatataattttttatagaaaaatatttaataatttggaaaacgtatgctcaaaagacgagtgagtgaagttaggaaaggtatccaaataacacatgcttatgctccgttttgagatctcatttaacttttgctcttttaccaccgcagtacaagaaatatgattaaacttgaaaaacagatttatttgatttcttttttaagaaacttaaaaacattaaaaaagggggagaatatattagaaaacgcacgaaaacatgttcattaaaaaatgagggagttgcggagaacgcaccgtgtgctacactaccagtcagtaggcgtctagtaggccgagtataggccattgccagcggcgacgatgcaacagcgctgtcctaggctcctagtgctagctgcgcaagacgacgatgatacccgaagagctttcactgcactgtgctgacttaactctgacagtagcgctgcgtttcacagccccatcaatcagagttctttctcctttctcccctaaaccaaacaatctccgtcagctggtagctggagagtactccatccgtcccaaaatataacaactactccctccgtcctataatataagagattttaaatttttatttgtaatatttgaccactcatcttattcaatttttttataaatatataaaacaaaaatttatgcttaaagtactatagataataaagtaagtcacaaataaaataaataataatttcaaaaaaatttgaataagacaagtagtcaaacgttgcaaacaaaaactcaaaatcccttatattatgggacaaagagagtaacttttagctcttaaaatttgtcctgaaatataataatttctctaccaacattatattcccatccaatcacgaccctcaaccattcacttttctcacctacctccactacccatccaatcataaccctccaccacttacttttatctattttcttaataaccgtgtctaattctaaaatttattatattctgggaccgacggagtactcggtttcacccggccaaacatgtcagtcacacatgaatgagcacaacttgtcaagctccatgcccatgatgaattcattaattatattcatggcacgatacgtacagtagcagcagtattaacacggagaagacagagagatcaatgagctgtgggtgtcaatgcacctggctagtactacctcactgccttaatactgtatataaatttgcaagaacagttaatggtgtttcaccggcaaggcgatcgatccgaagtcgaacgccgtgcaaacacgtgaaccgcgatggtctgtcaggcggttggcgggaagtagaaggggtgatccgccgggaacggcggctgccggcgggtggcggcggcgacgccggcgccggcgccggcagagaatcctgatgatgctgcagcgtggagcaatggcaagtgagaaggggcctgcatttgccaagcctgtgttgggaacggcatgggacccagctcaggccttctgtccattggcctctcctgcagttccattgcaatttgcaacagagcaatcatctatatgagctttttttttttcacattgcactgtatctttcatgctatcacagcataggattcttaatgctataatgcttctcctgcagttggaacagtacatattctaactaaataaaaatttcaaaaggaacagatggcacaattgattggttgttcgttacattaaccttagttatgcatgcgtgcagtgtgccagcagccagcaatataaaggatggaaaagcaagatatagtagatcactcagagccgtgcaagcttttaaacagtatctgaatctagagcatcttgagggttaaaagctgcgccaggtgatcagtgtactaacttgaagttatatcagaactgtaatactggaatgctttttcaaagaaaaaatcatgctgacagaaccacctgacgaaatactcaggtatttatctacccatcagaattcacaagggaaacggtatctaacaactaatagctgcagataaatacctgtactcgaggtagaagtactaacaaaggtagtaaaaagtaatgtttgaacttgctagatgactgttcttaaggcagaaagcatagtattcagttatagaatcctaagctcgttaacgataatttatttgacaaacccattagaattggtaagcaaggggtgttgataataatacctgtaggttcgggaggaagccaagacaatgagatgggtacaaacgttgatgctgagggggcagtggtgtgctttggtgatgcacagtccattggggagacgagcccattggctacagcaacgccaaaaggttaaacaaacgttataatatccggtctttcagaacttggatcatcgacaacgtactgataaaaacaagaagtacagtccatctttataggaggttacatggataagagaaagctacagttgtttccattctactaccatttttttttttttgcatgcactttttttcgacagatatatacttgcagagaaaatcataaaaacaggaaaaaaaattgaaactaaaaacagaattgagaatttattactttctataagcattacggcattacctggtggactgtaatatttgaagattcaggggaatcacaagttaactggaggccagttgtggcgacatcgcttttggagtcacgcgcattaggttgcgaaatccgcaaatccaaatcaagatcgccatcaacaattgctaaagaaaaaaacagtgatggctatgagaaatggtgtttggtgtgcttcggctgaaacggaaaattcgatggtgagactgattgtagtaccctcatttccggcgtctggtaaagcatccacattgtaggatgcaggctcgaagttggtaacagcttccctcccattgaagcgaatagctgccctgtcatatgctctaccaaattcaaccagacatgaatcgaaagtgagcgagaaaccaggaagttcatgactcgtcatgcatgtcacttcatcaaaggaatagtaccttgcagcttcaacttcggtgtcaaagagcccaaggtatatgtacctgcaagaagatatttctgaattctgagaccacttcagatcagaaaagcgtagtacatgcctaactgctagctagactctttgatgacaatactgtctctccagctgagaaagtacatgtgttttccccaatattggctgcgaattgatgcactgagaattggagatgtggacctctcacccgaatcatattaagacgccccaaccggaaacaacttgtgtcacactagcatggccatggactcaattaattagcttaaactcattatcattcctaacctgaacatctcacatctgtactttcgtttgtcactcctaattatacggttgtgaaattgaagtattgatgaagggggatcactagctagctagctaattaagcttacttcttgccaagaagttggcccatgcgtgcctcccagcggccgcacttgtgcagcgtgacgccgcggaacttggagctccccctcgcgaatcccgtgctctgtcgccggagtatgtgcacgaactcctccttggtccagttcctcatctgcagcaacccagctcagttcactcacatgagatcgaaaggtcgagacgagctagctagctagcatggagtatcatactacgattagtatgtaatcatatatctagatcacctgcttcagatcgtcctcgtagtcgctcaggttgaagttgatgtcagcctccagtccccggaacttgatcgcagcgcgatcgtaagccctgcgtaaacatgatcgatcgatgcaaatttagcaacaagtacatcaacctcgatgaatcaatatgattaccagttaatccaacaaggttaattaattctattcacgcgatcgagcttaattaatacatcaccttgctgccgcgtgcgccgtgtcgaaaccacctgatgataaatttcatcagcgttagcacaatactacaagatagagagctatagccagcaatcgaattcacagcaactaatgaaactgataattagttgaattgctcatcacctaggtagacttgcttcccgcaatccctgcagagattaggaggaagaaagcgagggattaatggcggtaatcagctagacacggatgtggattaatcagttgatgattagttgattgattaattaccatatgtgcgactcccagcggccggtcctcctgtagaaggtgacgcccctgtactgcgagctccgcgacctcggcccgcgccgcgtcttcttcgcgaccaccggccgctgcgcgagggcggcatcctccgccgcgcggcgcggcggctgccacgccggcgccggcgacggcgccgcgggaggcggaggcgggaggagctgacgcgtcacgatccccgaggcggccggcaactgatgctgctccccggagcactcgtcgtcgtcggggctgctcgcgaggaggtcgaaccggaataatcctccgccaccgccaccgccaccgccgcctccggcgtccccggagtttagcaccgaggagctcgacgtgccggaccgttccggcgactccacattgagatccaacaacatctccaatcctcaccacaccggcaacccaaccaaacacttccaccctctctcgctcttccgacttcgatcgagttcaactcaccaccaactctcctcgccttctgcttcaccctggctatagctcagctcgatcgttggcgcctcgactgacgacgactcactcaccggcttcgagcggtggcgaggcaggagcagcagcaaccacagcaccaggtggtggtcgccatggggggttggatgaagaagaagaggaggaggagagagagaggtggggagcagcgggagaaaaggaaatagagagagatggatgggacgtcgaagtggcggaggagggtatctcagggaggagatgagaaactatcgcacaggggattagaatttcgctacggccacacgcgcagcggacgcctccggtggtagggacggcggcggtggctaacgtgtcgcacggcgatcggctcgccggagatggccggtctccactcccaagtccccaacctctggtcctttgggagagagacgatgatgagcgggtttgcatttgcgtgggtttttctaggcgcttatactcgataaagaactactgtacccaattggggcgattttgtatgcgacaaataggacaccacatgggtgttagtttattcaaagtcggcagattctgacgttaattatagcatattaataatccggatgatagttgggctttgggttgagtttttttttaagacgttactttatatataatcataggctagatttgttgtgtactagttgtgtcaggtgaattgttattataaaatgaaggacgttgtcaaggtggttatatgactcgtgcgatattacttttattcgtgaatgtactatgaaagtataagtgagtgatgtgatttacaaatcatgtaaaccaaagactacaggtggaatattctaaacgttctttagagcttccgatatgttattacatggtggtaggataaagtaaagtgaaccatataaaaaaagtcaaagtataagtctattgaacaataatgaaacctttttataatatacatagcaatatttaacaccatataatttactagtataataagtattataagatgtattcctaaaacagacagtgtatagtgtatgggacacatggccattcatatcttattgtactagtagctaaaaccaaataaacttataaatatcttcatcgcagaacaggttttctttatcgtaaaaaagggaacaaccgtaccctcttgttggatagtttagccatttgaggccaccagccaagcgcgcagccgggagagggagcacggtccagaccgtgcacgttggatttgacagccacaatcaggaatcaacaacagcaacaacaacgcggaaaagtgcaccgggtaagattagttaggctacgttacaccagtggccaatcagcaacgaaccatatgtgcattgcatgcacactggcgtgcaccagacaattccattgccctccacttcaactttttttcatttttcacggcaccgcgcgcgacagccataatggcaggcagcatcaaaactcctgtggcatccaacacgctgaaagcgccgaacgccgtacagcctcgggcgcagccgttttaggatgtgtttagttcacgcaaaaattaaaagtttggttaaaattgaaacgatgtgattgaaaagttggaagtttacgtgtgtagaaaagttttgatgtgatgaaaaagttgaaagtttgaagaaaaagtttggaactaaggccctgtttagttcccaaatttttttcccaaaaacatcacatcgaatctttgaacacatgcatgaagcattaaatatagataaatgaaaaaattaattgcatagttagggaggaaatcgtgagacgaatattttgagcctaattagtccatgattagctataagtgctatagtaatccacatgtgctaataacggattaattaggctcaaaagattcgtctcgcggtttccatgcaagttatgaaattattttttttcattcgtgtccgaaaaaacccttcagacatccgatgtggcatccaaaatttttcttttcataaactaaacaggccctaaacaaggccttaggccattctcaacccaatgactagaatggtgtctatagcattaaataagctgccacctaaaatgaaaaatgatgtagcaagtgaataaatgaggaatgagaaggaaaacatatcttgcatgagacatggtttctacacaacattcaagacatcatgtgagataagtggcattaattgaagtatggattagtgatatttacattggaatagtagtgtctagtactaatttcttgatgatgtggagcttacagaaactatgtctagtgtcatgggttgagaatggccttagccgcacttgtacaggcaaagtggagtatatccatccatcacgcacggcacggtgagtggacttagccgcggcgggccgtgcagttgcagtcgctgcccgcgccgcgagcgtggaggtcaaaccgcccgtgcgccaccgcgcagccgcccgctcgtgccgtcgccgcgcgcggcgcgcggcgcgtggctggctgtacgctggcctcggttacgccgcgcgcggtctcgcggcgcgcacggcgcacgtttcttcgtttcaccgcggccgcgcggcgcatgctgctttgcggcgccgaaattataactcgtagtaactcgtaacagatcgatggatgtgtgtacgatatggatcgatcggctaagtctacgtcgcgttgatgaactcaacacgttaggccaactgttactatagtctaataactgggcccgtgtatagctgtgtacatgggcgaaaattatgctatgtacccggccggcccatggcgtgccatggccgtacggtgtaccggctctccgatcctggacagtgcagaggccgccgtacgtgcacgatcgatcgatcgatccaagcggggaaacgttattcgtttctagaaaaagcttttattggcgtagggcgacccgtatagcgtatgtacaggtttgacgtgagaagtgagcgaatacgtagctcgctagctggataagccgcgttttgtgccgtgcgcacgaacgactcgcgcgtgaaactcttttaatcactttagtcgacgtcaacttaataattacatataaacttaaacagggacggatctagaaaggattaattaataaataagagggcttaaataaactatacaaaattatatccctcttctaataaatatatgacagaaaattttaataagatcccatggttaaaatcgccccttggtggagaaaccatctttcgtcggtcgggttatttccacaatagtcccggttgcaataaaaaccgggactaaagaccggttaaaaagggtaacaggcaatttgatttttagtccccgttggtaacacaaacggggactaaagatgatcctagtcctagttcaaatgttatcagggcttgtcaggcctccccaggaaccaaccgggattaaagatctatttatagtcccggttgataacactaactggaataaaagatcggcatgcgcaacatgggcgccggagagtacgaggctagatcgaagaggaggaggagcagttaatatattctatctcctccctggccttatctcttcctcctccatatctcttcctcttcctcctcctctcctttgaacttctctcctccttttcctctttctcctctacgagcgccgacgggcggagggcctggtggccggcggcgtgccggcgcggcggcgcggcgctaggcgatgcggcagcacagcggcctgggcagcctcttgggcggggggccgcgcgcggcggcggcggccggcgggccgcgccccgcggcgacgggcaggcggccggcggggccacgcctcccggcggcggcgccccgcggcggcgggcaggcggccgacggccggttgggccacgcccggcggcagcgagcggccgtttttttttataatctgtgattattgagatgtataattttgtgattcattggacatttgtatagatctgagatgtataatctgtgatgtattttgtattgtttaggatttgggatgtatttgatttgtgtgtatgagtaactttaagatttgtgatgtgagttgagatgttatttgatttggggatttggggatgtgcatgccactcgattcgggagaaaataaaaagaaaataaaagaaaagaaaaccatctggactacccgctactctctctttagtcccggttgataagaacagccgggactaaagatccctcttttttactccggctgttgttatcaaccgggactaaagatcaatctttagtcccggttattttaaccgggactaaagatacctatctttagtcccggattgctactctcggttgaaaacccgagattaaaaggggttaccaaccaggagtaaagaaggtttctccaccagtggccatcgccatcgtccttacgacgtcgtggtctagttcactgtggggattgctattcaaccaccttatcctggtcctcgaaaaagaatggacaactgttcgggattagctaatgaccattatcattcatgaatagcactagtacttggttcgtggccacacgtccatatatattctactccctccattttataatataagtcattctagcattgtttatatttatatagatgttaataaatctagatataaacatatatatcgatttattaatatctgtatgtatatggacaatgctagaatgacttatattatgaggaaatactgtttttaaacaagtgtttggttctctgttactcatgttagagcatgttagcgtaccacatatactatttttagcgtgctccatgtgtgccaatagtcccggtttttcaagtcaattttgctgtcgaagttgtggtgccgtgcaccaatggaaagaaggatttgcagccaaatgtgtcattaccttagtattatccattcaactgcactatgactatcactcaataaaataatagttaatttgcaaggtcggagataaacttcagagtgcaatagcaaacggtgagtggttttaatcctgagatttatgttcaatccctaacacgcttacaatttctttttaaaaaagtttggagcgctcacaatttctttttagaaaagtttggagggatgtgtctccctccaaatcttgttttaaatttgcaacgttgtgtttgctaccaaatttgtaattagctcggtattattaccagttgcacgctgattatataaaatagtgaattttcaagtttgtgtttaataccaaatttatcattagcttacggcctgtttggtagagctctagctcctaaatttagctccaggagttgggtctggagtggagttg

SEQ ID NO: 69294 - DNA, 9128 bp, Oryza sativa
ctctacaagtttacctccagctattccaaacataaagtactccaccggtattgatattattgaaattatacccaggacaacacacatcaaaccccaaaagctagcatccttttttagtttgtctgctggctcaaagaaagttttgatggcattggaaatcattactccaaacattgggaaaagcactccatgaactcctgcagccagtgttgctaacaaaagtatcggtacctctggcttgtttagtctagccagtcgtccaataggagctttctgttggacctcaccatcaccaccctgctctgtctgttcccccacagtcgaatcattgccttcaagcaattcaactgagccaggcaagccaaagggaagggctagagaatgcctgctactatttcctgcagaatccctgctaattgatcgcttgaatgacaaacttctacttttagaccttgaatcagatatgtgatggtctaatttcttctcttcttcttcgtgggtttcttgtagcctaatgagttgcgaataaacaccattggggttcattaccaattcatcatggggacctatgcaagtattcgtgtaagaaattgatcactgcagttaaattaagctgaataactcacaatcaatacaaaatgaacagtggcaaggggatcctaaccttgctcaactatctttccttgttgaacaactgatatacaatcagcattcctcactgtggtcaagcgatgagcaaccacaagtgtggttctgtccaccatgatcctgttcagtgcctcttgaactatcctctctgattccacatccaatgcgctagtagcctcatctaacagaaggattttggggtttttaagtattgctctagcaatagcaattctttgcttttgtccccctgagagctgtgcgccacgttgaccaaccattgtatcatagccctggtacaagataagagaaaacattagacccagatctgataacaaaaaaaaaaacttagacatgcaggttaatttattggagttatcacatacatcaggtaatttgtcaataaaatttgctgcattagcaagctcagctgctctcctaatctcttcaattgttgcatcctctttgccgtatgttatattatctttaatggaggtcataaagagcaatggctcttggctgacaagaccaatcttccctcttatccaattaagcctcaagctcttgatgttaatcccatcaatcaaaacctcaccagcctgtggatcatagaatctttcgacaagactaataacagtggacttgccgcttccactctccccaactatagccattgtcgtgccactagaaacatgcaatgaaaatccatcaaatatcagttgctcaggccttgctgggtagctgaagtacacatccttcaattccacatcacccctgatgtcctccaactgtttcccagttatgtcatcaggatcaatctgtggttttctcttgattgttttgaacaatctataagctgcagattgcccttctgcaaaggctgccatacatggggtcgcattccctaaagacctgccacaaggaaatggaaatttttacctccattcgttaaaattaaaatatcataataaattaagaactcacattgccccagtcatgacagcaaacaagatatttatgatgtctcctcctgagtatcctttgctgactaccaacttgccgccataccatatagctaaaccatagctggagaaaaatatgaagaaaacggagcccatgccaaaaccgttcgtaagtccttcctcaacagctgccttgtatgccttgtttatgagtttattgtacgatgcaacagcctgcttttcaccgttgaaggaaacaacctgttttcagataggaaccacacaaaactggtgagttcatgccatttcagatggaggtagagggagtgaaattattctaacaaatgaacttacagtttttatggctccaattgtctgttcaacaacattcgctgcatcgctatatgatgcttgacccttgctagagatttttgctagcatcttcgatacagctccaccagcaatgacaacaggagggatgcaggccaacatgacaagggatagaagccaacctttcacaaatgctacaacgaaaccaccggcgaaggtagccacaagttgtagaaacttgccaacctgcagaatttttcatcacaacaggaaaaaaatatttatgttgtagtatgtcagttagtgctattggtcttcatataataaagatatatgttgacaattctgttgaacttgagagaaggtgattaccttctcaccaatggcatcctgaactaacacagtgtcaccggacattcttgaaactatctgcccagttgtcatttctacatcaaagaatgctatatcctgtctcaggacagatttgaggtatagagatcgaatgcgtgtcgcctgccgttctccagtcattgtccagcacgccacctctgcacagacatcaaattggcattggttatttacagtgatgtgagcgccatatgccttgaacatgtagaattatgtttcattttttctaatcagtttagtttgctaaatcaaaagtagtagtaccgttttttaatgtgcagtttgacatatgcttattcattttccactttcgaaagggaaaagtaaaacatgtgtgctctgtatctcctattcaatagtaagaggataggtttaacaggaatattcgattcacaatcttaaaaattatgtgagtgaccttttgtggactgtgatagcattaataaagagaattgtttgaactttgaactcatattaccaaaagtcaaactttgactctgcattgatggcagcgtgcaggtttgaaacgccaatattggcaaaaggatgatatggagtagtagtattagataagttgccagcttgctaagcatatgctctcaccgttctcttaatcatgactaatttactaatgataatccataactagcagcaacagttgacgcatgtgcagtgtgccaagtgcatacacataccaacagaacagtaaattctattacttacgaagaaatgaaacaaccgctgtcgcgatgcccaggtagacaaagttgagaaccgcctagagaaattgaaagaaaatgacaccaaagtgaaaagtgtattcatgtcatcactacctttaataacgtgtaaccgtaaaggtaacgaattcataatgcactaggagtagttaactgcaagctgaatgttaatggaaagaagttttctgtaatatgacacactggcggtgataaaaaacggcgaaccgacaaatttgacagtgtgtatcatcaccactcattcaaaaaagattaaaaaatataacgtgtcgatctctgacctcttgataggaaaaagattccaaccattacattgattgatactctgttatcctatatgacatttctttactggaaatgggaaggactttgatccttcttgctccaaaaaaaaaattgatactctgttaactcttctgttgtctcttgttggaatattaacttattattacaagttgcaatcatttggcataacatatttactttattgaacaattactacaaaaacatagctaactgaaagctgcacactgtaaagtttgccggtataaaagccagctcccaggtgaacgagaaacaagctacaataccactgaatattttgggagaaaaataaacaaattcattatccttaataaatagacgtgagaatctttaaaaaaaagaagagagagattgagagaagaaatatagaaaagtactatcccagaaaataaaatgcaacaatatttagttgaaaaaagaatatcgcggtacgagaggctgtttggtttaagttccatagatcgaagaattatcccaacttgtcggaagaattgattccacaagcgaatactctctttttttcctttctcaagaagcaaagcaaaggaaagaaatgagtcgagaagacgactgaaaaaaaaaaaccccgaaggcaaaatcgacgaggagttaataccgccaaaagtcaagatacgagcacatcgttctccgagctccaaaacatcaacaaatttcaccggagctttctcaagatcaaacccacatctaaaaagacaaagaccgcaaaatgaatgaaatgaaagggagtggaattgattgaattggccaaagctcgatcgagcacgccgctaatccacggcgcgcgtttccttccacatcgacggcgagaggattaatcgaccggaaagttagccgcgcgcggatcacggccggacgggcggcgctagctgtggcggggaggcaggcaggctcacctggttgacgcggtggaggacgtcgccgttggtggcctcgccgaaggcgttgatgacctggccgaagatgacggtcatgagcggctgcgacaccccgttggcgagcgccgccaccgtgccgaccgccatcagcagcaggtccgtgccgtcggcgtaccggaacagccccgtgaacgacaccttcttcccggcgtcgccgtcctcctccttcttcttgtcctcgccgtccctgccgttcttcgccttcttctccttgccatccctgccgccgttcgccgccgcgtccattgctggcagctttactgtgtgtacaagatagatacgcccggctcgatcgcctcggcctgcggcgccggattcctgagtcgtagctcgcggctcaacgcctcaaccctttcgcgggtatttattgggttggccacatacacacaccgccgcacgcagggagagatgagacggagaggagggtttggacgacgaatagaaaatatcactgcgccagctatttccaaatggtctatggagaaaatgttcggaaggatcattacaaaaaaaatggggacaaaaaggtgtagtcctgtgcttttttttttgggaagcgtttttgtttctttgtacttacattttttttatataggcgaaggtcatagatgcatgttactccactaagatggggtatgaaaattcagaagggagttatgtggatgattaatatatgatacagctggtagtagtatatattgcttagagctggctagaacagggatttcctctagatgctattgtagtggaaagagttttttttttgtgaggaataagtgaagatcgtagcctaataaggtattatagatgttgatcatgttattctacaaatttagttaaactttaattgtatatttgtcctaaaatacgaatgattacattgacaaattcacttgtgttttggaatatatgcagtcagtttaattaggacaaattaatacttcgtatgtcccattttaaatgcagccatgattttccgtgcacaactttaaatgcctgtcttatttgaaaaatttttgaaaaaaattaaaaacataagtaacgaataaaatattattcatgttttatcatctcataacaataaaaatactaattgtaaaaaaatttcaaataagacggacgatcaaagttgagcgtgaaaacttatgtttgcacttaaaatgggacggaggagtataaaacacatgccttttatattggcatactccttctatcacaaaataaattagtttttcttatgaatctagacaagttctaatctagacattaagatttgatttattttagatgaagggtgtagatgtcatcggttagaacaacttgtatccatggcttcactcaaatacttgagcttagttctaatgtgcaagttgctttagcttttcaccgtcacttaaaacaagacgagggatagggtataattaattaagtattttttattataaatgaataaaatagatttatttaatttttaaagaaattttcactataaaaaaagtgatatgagacgtcgattaatataaaaccggcacatgtgatctttctccccatccttctaatctctcatatgagtctaaactaaaatcggcacttacaacacattattggtgttgtttaataaaaaaccgccaaatataagtttcagtgcatgttttttcaatcacacaatttaactggtacctatgaaatagccaccggtgcgttttttttattaaactgacacatatcgagaaaacaacgttgagccgaacggggtggaagaaataatccgctgagctcgagcctctctcccattccacatgtcccatgtttattattttacttcgatctactctccgtctctttcccacaccctccatatcctctctgtctctataccaccgccacccgcagcccctcctactcccctctccaccggtgcggcatcgtggcatcctccccctcaacggtggtgactccggcgggctgctctgctagctgggacaacgatggctcccatgggcagatctgtcggtggcgacggcggagactgtgcagatccataggctgcggcggcggtggctcccgcgctcggatttgtcagttgcaacgacgatggctcccgtggccggatccattggttcagatgacgacaagcatgggctcccatgagcggatccggcgatgtctcccgcagatggatccagtggcgtcgatggctctcgcacatggaggcagcaatggcaacctcggcgccccaatgagcgatggcggcaggcggagttctcgtctgcagtgagtgactgcacctcctttgatttggtttttgatgaatgcttgattctataatgtgcaattgttgatggatatccggttgaaatttttgtgatttgtgctatgtgattttgtgcaggggatgttgttgttagatggattgatgggtgatttgtgttttgtgatttggaggatgttgttggataaatcgatggtggtatgggggtgatagggagcaacttaatttaagccgatgcatcgagccagcgttttttttttccgcattcgtggaacctcaaaggtgctagtttctaaactgaactttggttactcctcatcagtgccatttgaggggtttcggttgggaaatccaatacctatgtgatgttcgcaatcagcacctattaggttttagtgtgtgataactgatatacaaaataaaaaagaaacatctattaggttttagtgtgtgataactgatatacaaaataaaaaagaaacatcgtaaaactattactctctccatttcaaaatataatatttttcattggatgagatacatcttaggtagtgttcttttctcctaaaggtgaagatgaagattaagtttttttacgcaaaacgaggtggtattaacgtatgattgattgagttttaattattacaaagctgaaaatagattgatatgatattttagagcaacttttatatagaaagttttcgcacgaaatacaccgtttagcagtttgaaaagcgtgccacgaaaatattaatcttcatccaacacttgttagtactacgaatctagacatattgcctgtctaaattcatagtattagcatgtatcccatccaacagtggcggatccagaaaattgattcgttggtgtcataacgtgtctatctgtgtctagtatactaattatgcttagattatggtgttataatgtatgaataaaattgattcgttggtgtcataacgtgtctatctgtgtcatagtatactaattatgcttagattatggtgttataatgtatgaataagtagttttgctataggtttttgtaacgacccgcctctcccaggccgggctaaattcatagtattagcatgtatctgtgtctagtatactaattatgcttagattatggtgttataatgtatgaataaaattgattcgttggtgtcataacgtgtcaatctgtgtcatagtatactaattatgcttagattatggtgttataatgtatgaataagtagttttgctataggtttttgtaacgacccgcctctcccaggccgggcccacttacatctggcagctttcattggtcataaactaccctcacagaccaacacatgtcttttctgcacactttgtcctcactcgtgtgcacccgggaagaatttcctggtcggtcacccatcccaaattgctccaggccaagcacgcttaaccctggagttctttggagattggcttccggaaaagaagttgtaacttgttgatatattaatcctattaagccctaggccgggatgttacagttttgccaaaagtcatcggtgtcgcctgacacaggcccttataatgtagatccgtccctgccatctaaccaaaacttttttatattctaagacggatggagtattgtataagctcattcacataagcataagaatctaaggtcaaccctggtgggtggcgggctgctggcctccactgccacgtcattggggtttttcttcaccatatatgaaatcaccgttctggcaacggggttcggaaacgctgttcggcgatcgatcgccttagggatggggcagcgatccgatcccctcccccctccctccctccacccctccacctggtttacttttttggcaccgcattacttttctattttagtaaatttatacacctaaagtttatacacctcaagtttacacatctaaagtttagagaccaaaagtttataagtcaaaagtttatatatccgatttaaatttgaattcaaatatttttttatatatagtatttctatacatctaaagtttatacacctaaagtttataagtcaaaagtttatatacccatttcaaatttgaatttgaattatatctgattcaaatttgaattttgaatttgaattcaaatattttctatatatagtatttctatacatctaaagtttatacacctaaagttttaaagtttatagatccaaagtttataagtcaaaagtttacatacccgattcaaatttgaatttgaattatatctgattcaaatttgaatttgaattcaaatattttccatatatagtattcctatacatctaaagtttataagtcaaaagtttacatacccgattcaaatttgaattcaaattttttatatatagtatttctatacataaaattttctaacttttatttttttaaaaaaaattgtgtgtactgtggtagaaagagaagaaggggaagaggaa

SEQ ID NO: 69295 - DNA, 2699 bp, Oryza sativa
aggtggtgtcggggggcagggtgagcgtgaggccggagccgaggacggggtcggcggcgtcggcgagggagaaggggatgggggagggcgggccggaggcggtggaggcggagtggacggcgagggcgcgggtgtcgaggaggaggtcgccggagtgcggggcggagagggtgagcagcgcggaggcgtggatggtggaggcggcgaagtcgaggtagaaggcgagggcggccttggcggtgaccgggtggtcgccgtcggtgtacgagtggggatccaccggcggcatggctgagctgcagcggcggaggaggaggagatcggagtggagggtagggagggagggacagggtttggctttggcctgtgtggatttggtcgaactcgaatcgagacaggattgaaagaagcaatgcaacacctcttcagggaaaaggagcttcaaacctcgaattgaaagaagcaaatcacatgcttaacttttttttttaaaaaaagaatacagtactccatccgtccagaatataagaagatttagagttgacacggctattaagaaagtatgaataattaaatggtgaaagattgggattggttgaaaagtgaaggtaggtggggaaattaaatggtggagggttgtgattggttaagaaaaaaatgttagtggagaagttgttatattttaggacaaattaaaaatactaaaagttattatattttagaatggaggaagtacattattaacttttaaattatatactcacactatatctatatatagtacattattagtttctttaatatactagtagattgatcgtaagtaatgtgtatacgttttttctacgtgtcggtccgagatcatacaacatatactatactcgcactaagtcaaaacaatatactaatagattgatcgtaagttgtcagggttatggataccacatatctaataatagttgactaaatctcgacaagacccaccacataccatgtcttatacggaaacaaccttcagatataggaggagttccgcataaggaaggatgaatagagttatacatggaaacgataaggactactcggatggtaccatattggtttccctagttctacttggacaaggggacacctatgggtataaatacaaggccccctaggaggaagggggagacagaacaatagatcaagacacaagatcaacatacaagccaacatacatcaagacaagacgccggatatcgacttcagagataggcatggctgatcccctacggtgcctatggctactgtcaggagagatatagcgttgtctctgatcttgccggatgcggattcgaggaggaagactaccctgttgtcgactacgagtcaaaccttcagatcgccatgtcgacaacagttagataggctatcccaaatattgtactggtgtgattatggtgaataagagcaatgacggcttcggccaacaggatgtagggttattacctgacaattcaggggcccgaacctgtataaaaatcctcgttttcatctcttttatctaagtctcgcatatatcctagtaccaacgatccccgtactattcaaataccggaatcgcgacatcaaacgtcgacataagtaatgtgtacacgtttttcctacgtgttagtccgagatcatacaacacatactcgcactaagtcaaaaagaaataagtgatactttcgtaatccaaatttgatcaccaaaaaagaaacaaaagggaaaatgatcagcgtgtaacgttgagaggcctttttttctcaataggatgcaatgtgcttgggcatagagattgttcacattgtagtaattttagtcaaaattactacaagattgtcaaaattttagtaatttaataatattgctaggttttagcaagatttcttatgtatttatcaaagtttaataaaaaaaactaaatgtttgcgtacatttaacaacttttttaaaaataggatggtttgaaatgatgtcgatatgagcaacccataatcgtgcgagtgagtacaaccttgtagttccttcaataatgggaagttatttgttctccttgatcttgatacccctattttatgtggtgatcgatatacggaacacttaatttttttaaataagacgaataatcaaacatcatattaaaaaaaggcaacgtctcatctattttaaaactaagatagcatgttttggtaaataggatatattttcaactatctcaagatttattaatagaaaatgtctaagtttgagcgtatgtagtgttgggtgataagcatatattgtcgacgtttgatgtcgcgattccggtatttgcatggtatggggatcgttggtactagggtatacacgagactaaggtaaaagagacggagatggggatttttatacaggttcgggcccctcaattgtcaggtaataaccctacatcctgttggccgaagccggtattgctcttattcaccataatcacaccagtacaatatttggggtagtctatctaactgttgtcgacatggtggtctgaaggtctgactcgtagtcgacaacagggtagtcttcctcctcgagttcgtgcccggcgagatcagagataacgctttcttttctcctgacagtatccggagacaccgtaggggactagctgtgcttatccctgaagtcgatatccggcg

SEQ ID NO: 69296 - DNA, 690 bp, Oryza sativa
caagtctaaaattaagtggaaatgcgtgtttgtatatataaagtagcatatatacatggcagctaaattagcccctaaattttagcatgcgtacatgcatgcatgatgattaagttagaaaccataatggccaaattagcccctaacttttagcatgcttaactccagtcaacgcaagttaattattagctagcaagttcaaatctttggaacgaagatgggagaataggatctaacattgttttttctttttattactgtagaattaaagagaaaacatctttttaaaaagaatttcctcaatagtagcgattgcactttgatcaacacaataataaaaaaagacactttttttttgcgccaaacaacatggctgcatgataaaaacacaaatccattccttcttcacttaccatcgtatgttgtactttgatctttataagactttgtatctatgttcatgttcattggggggagaatatgtaaatatagcgtattgacgatgaattacattttaacctgcaaaccagtgatttaccgaggttacatgttctttgtgataaaatataaatcttaaaataaccgcgcaaacattcagacatattttatcctatggtatcattaggaacataatatcaaccttaaaaaaactacaatcaagttcttagggagaaaatgtaaatctaaaag

SEQ ID NO: 69297 - DNA, 507 bp, Oryza sativa
ctttatgttttccttttatctttaggaaagtttctttcttgtcttacaaggactagtatctccctatgggtataaatatgtatacccagggtcattctaatcaatctctcgatcaatacaactactctcggcgcatcgccaccctcattcctgaggttttacttatcaaccggcggaatttggcacctgacgcggggctgcatcgattcagttcgatctccggcgaaggggtaagtcctacgttccgccggccctggtgaatctaccggttacgttggtgttgatcaaggctgcatcgcttcgatctcttggatcgctctggtttggttgatatatttgcctacctgatatctcaattctatctttaattgcattgtgtttagagacacatcggtttagttgggactgtctcggttaggtccgatcttctatcttagccgatatatctctacaatcacaatgttgctctaaatagatttgttatatccatcaccttagacagatcta

SEQ ID NO: 69298 - DNA, 3471 bp, Oryza sativa
cgactatcaaaaccatgtgctcataacccaccataatcaagttttagttggcaaatttattatttaagcaaacatgactgaccatcgtgagctcctattaattagatgacaataagtgatagtgaagcataagttatccccttaatgagctaatgtttctaagcatgactaagcatcatgatagctttagctaaaatcatataatgttctagctaatcatattattaacctatttacaaaggacaagtaatcaatgtcaaaggggcataacaaagcatataggtcaaccctccggtgacactcgaaaataattcaacagttgaatagaaacaatagctttaaacaagttcaacatgctgaaaggggtgttttagaatctgtgactttccttgctgttcttcataggcttccaaaccttcttcatcataaacggtctcttcggaacgtcggaagctaaagcaaatgaacaaaatcaacaaaacagtaccaagcataaacaatacatatggatatttttaacaaatagatcttgattttatatgaatttagagactgaaccacctaaatccatgttacggtgaattagttatgaattttctaagtttaataggatttaatccattaacagacaatgtttaagatttatgaagaattatttttaaaaaggaaaagggaattattgtgtcatcatggatcgggtccacattagaccgggtgcacagaagcggtccacgaacagctcagattagatcggcttgccacgcaagcagacgatgaggtgaactggttgggcgacgtggcgctgacatcatcgatgacatcatcgcctgcggcgactactcgggaccctgttggtcaccggcaatctagggcacggcgttgaaaacggaaggcgccgacatgacaagcgtgacggggaacccaccggtgtgcggcgcgacggcaaatggcgacagacagcgacggcgacaaggttggagcgacggcttggctcggatcatcggtggcggcggcgttccagcggtagtcaatggcgtcgggccggtgtatggggtgcgtctcctccttgcaatcccaaagaaggcaacgggaagcggaggcggcggcgcggtgacggcggcgctagggtttgcagtggcggcggcgctaggagcgacggcgacggacggggcttgggaggatcggtagagtgcgattagggctacctatttataggcacagagggagagattgagcccaacacgatcgcggtggcgccgggaaaacctagggttcggtttggagagataaggttgaatccgagctcgattccacgtcggattcaaagggataagagccgattcttggggtaaacgggagaggaggataaggggaagatttcccctcaccgaatcggactcggggcaaaaggtgacggcagatttaagagaaaatcgacggtgagattagacggtgccatgtggcagccaaggagcgtttgtaggaataccacatgacagcttaaaagcgtttatagaaagtttaatgaattttagtatatagtagatagtgtgctaaagttagtgtagagacgatatattatacacattaacccttagcttatatggataaaatataaaaattgaacatgtttttgccggtattttggtacgttgtccatgtatgagtcgatttttaagttcgtttgtttttttaaaatacatattcgtatttgagtcggtttttaagtttgttcgcttttggtgcttttggtaatacagaaggaatcgtataagaaatctcacagtgaatttcatcttaactaaactatataacaataataagattaaaataaacttcacccgttgtaaagtacgggtattttttctagtatggataaaattaaaggtggtaattacctcttctataaaatttgctccaagtcctctagtaagccggccgggctgcaggactgtagttagccttgatatgccataattgtgttttacgaattgttacaagctttggctgtttgcgtgaatatgtttctttcaacgggttcacgttccaatcttatctaataaaccgatttcagggttagaactctagttcttgattgggacaggtggcaccaatcttagaacaccgatcgaattcttggctggagaagcgcaccacgtatcccacccctccagcagcggtacgatagcatatcgacggtgaaaaagacgtcttgcggacttaaatgtatattgaaacttttaagaggtcttttttacaaaatgcgtgatctcatctagaacagcccggaagtagaccaaaatatcctctgagaaaaaaaagaatctaataaaaaaatcaacaagcggttagccccatcacgtggcctaattccatatatagttttgtcactacgcatagccatttgattaaaaatctggcaaaaaaaaaaaaactgcccccattgcaagctttgagtctttgttcgaattgaagataaatctggaattaatacaaatgaaaagatccgaaaatgtggtgcggattgtaaagaaaataaggataaaaataaaaaagccaatcctgcccacgagccgctgccatctcccctcccacaagacgctatcgtcaaccaccggattcgtccgtcactcaccgtgagatggtgctgtcctgctggccgtcaaatccgaggaagtcgacgcggagcttcgctgcaggaggtgaaggtggagaatattagagagaaatgagcagctcaacatctgcctgcatgcctgtgggcagcggggagaaaagaagcaaaggaaaggaagaagaaaggtagaagaatgacagcgtcttctctctgtccgcccgtgaggccgtgacgacagaaaaaaaaagaggaaattaggaagagcggtgaaaaatgcatcaggaggactgagtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccaccttcgcaagtacgcatcgcatccctccgcgccatttcggtttctgggccaaccgtgccccgtccacgggccatttttcattcacgggcccgtactgacacggcgggccacacgcatgccgtgccggcacgggcacggcccggccattcacgggccgtgcttgggccggcggctcggcacgtgggtcgggacggcacggcccgtttcatgagccatgcctaacgggccgtgccgaaacgggccgtgccggaccc

SEQ ID NO: 69299 - DNA, 10186 bp, Oryza sativa
  unsure (1)..(10186): unsure at all n locations
tgtttctggcattcatggcaccgcggaggatcagctgtacaaggtatgccaatctcttgattgtcccgcaggctatgatgtgtttgagaagcttgaaaagaagtacatgaaagttgctgaatggtcaagatcagacaggaagcttatctttgatatggttaacaccatattatcagaaattcttgcaccatgtttggacatgcacccgtgggtgaaatctgctagaaaaatggcaccagtatggggttcagagggtctcctggagaagattttgcagatgttggttcagagacgggaagaacttgggctaagtaagactaagcctgagaagaaagcgttagatcggaagtggccagatttatcggattgcattgacagggtagggagggatgtggagaacatgataaaagatgatcttttggaagagatgcttttggatctgttcagttaggctgttggctgctttcagagtttcaggtttccatggcacaatacacttgcttcccccttatttagtttttgatttttcttaggtacttctcagcttgtaatgtttcttcgttggttcataaggtcaaaagttttttttttttttggtttgttgaagcagtggttgacgagttttttagttgagtcgccgtgcttgaggtatagagcaagttgtaaattttgttagtttagatcaggtccgtagattaaattcttttagaacgagaaagggcatcccataggttgtaagtctttggcggaatgtataaggagtatagtggctctctatttgttggattttctcagttgaaggcatttaagtctgtaaatcggggaaatagtaccctgccaacatttgtattgttcattggagaataaatgaagtgtgtacttctgagttttggttgagagaaacatatcgggcaagagtaaaaaatagtctgcttgaatgtgattattgtagtttagtatatgtaacatagagctgtttagatgatgggcatgtctctattgaaaaatagatcctgcatggctgcatccctaattcctctggttcttgaatgaattgtgtggttagcatagcatgcgaagctcctgattaattgttaagttcgacggcatattctctcttcgatttcaaacatagatgttttggactttataacttgtctccacacccaagtcgtagaatctttactgattgaatgctatcactcgtcatttccacaagcctaacctgtaggaacaattaattatgtttgacttaatttgtgatatactaaaaggaagcttttgtataaatccaccttataaaatgactaatttccacgtcccaattgctcccaaccatcctaaccatgcttcgtatggaccgtaataaaaaaaaaacagccttccaaagtgaagacactcgccaagaatctcaaggaaaataccagtaccttcttatagcacacaaaacaatactcaactctagccaactactcctccgttccaaaacaaatgtaatttcgcactattcttatctaatgtttgacatttcatcttatttaattttttttatgattagtatttttattgttattagatgataagtcataaatagtattttatgtgtgactaatatttttaaatttttttataaatttttttaaataagacagacggtcaaacgttggatacatataccctcggctatatttattttgggatggatatagtagtaacaataaagtaacagagtccaacgcaaaaatcaacttgatataaaagtggcatgatagctctaatttcacgaacacatgctattgttgtcaaacttgccaccaaacagcacggcagctccgactacacagtgatagcatcatcttggccaaagatatcatcaaaatgaacaaacatcaccgatttctcacagtcgacattagaatcattcttacctgtaaaattctaaacaaaacattgcttgtaaaagtgcaagaaggcttgcaggccagagatagagacaagacatccccgttcaccagcagcacaaaagaacgtagcaacgatcagtggcagcgttgcaattacggaccggtgtggcggtgttgttgcccatcccatcaatttagcagctgcgatgtcaccaccacaactattcattatagccacccagctaacaccatctcgtgcgctcgtggcccttggattcaactacccccgcgccttgatatttgcaactgcaaatttgtctatatacaaaatttgtctccacgttttcttggatagttagttgctcacccgatcctgtatccatggcggccgtgtcggaggtggaggtcgacggcgtcgtgttcccgccggtggcccgcccgccgggctccggccacgcccacttcctcgccggcgcaggtttgtttgtgtttgcgttgtgtgttccgtgtcagtggagaagtggaaatgccgtgcaagcgaacttgcttgctggtttgatcgatccgtcgtgcaggtgtgaggggagtggagatcgccggcaacttcatcaagttcacggccatcggcgtgtacctggaggagggcgcggccgtgccggcgctggccaagaagtgggccggcaagtccgccgacgagctcgccgccgacgccgccttcttccgcgacgtcgtcaccggtaactcatctcgctaaatttgttgctcgtgtcgacgggcggcgcgacatgacatgggcgtcgtctcgcgttgcaggcgatttcgagaagttcacgagggtgacgatgatcctgccgctcaccggcgagcagtactcggacaaggtgacggagaactgcgtcgcggcgtggaaggccgccggcgtgtacacggacgccgagggcgcggccgcggacaagttcaaggaggccttcaagccccacagcttccctccgggcgcgtccatcctcttcacccactccccgcccggcgtcctcaccgtgagcaccaatccgttgttgccgattactccgatgcgtgatttgcttcgtgatttggactccgtttgattcgatttgcaggtcgcgttctccaaggactcgtcggtgccagagggcgccgtggcggcggcggcgatcgagaacagggcgctctgcgaggcggtgctggattccatcatcggcgagcacggggtctcgccggcggcgaagcggagcatagcggcccgcgtctcgcagctcctgaaggcggaatccaccggcgacgtggcggcggcggagcccgcgccggtgtccgcgtgaaaatcgagctgcgaattaaccgcgcatctaagagctcctcctacacttcttgtacacttctactgccctcgtgtttgacaatgaaataaaaggaaaggagaaatcgcggctgttcttccgttccatctctgaattgcctgtgcacggctcgccacggtagaggtgaaaatggttacgaaaattctcgatcgacgccatttctgtataatgggtaccgttttcgatcttattatttttagctatttataatattttatacattatagtattaattaatataaacattaaatagtttaaataataaatatagttaattatcctgatcgaacgtcgttttcaaaagatgctaccaattcagatcgttttcacttatacgaccggtgagtacgggatattttctgcgattaggtagacgcgaatggctgatgtgagtggctacgcaattatgcgaagcgagcgaatgcgagacacggctttccgctaatggggcccggcccaattggcttaagtagatagggtgggccagtcaagggaggatctttggttgggccggcattaacaacggtgctgaaaccgtgagaaataagtccatcttccaccctcaactaatgctctttgtagggtttcataatgtctataaaatgaagacacatgactatggcagatgtgaacgactatgcagttacacgaagcaagcgaaagggggcagctaatgggcgggtgataagctactctctcacttcctcctcccctcttctcttcctactacactatatattttttaaaaaataaaaaaataaaattgtaaaaattcatgtatagaaatactatgtataaaaaatatttgaattcaaattcaaatttgaaactgtatgtaaacttttgacctataaactttgggtctataaactttaggtgtataaactttacatgcatagaaatactatatataaaaaaatatttgaattcaaattcaaatttgaatttgaaatataattcaaattcaaatttgaaatcaggtatataaacttttgacttataaactttgggtctacaaactttaggtgtataaactttagatgtatagaaatactatatatataaaaaatatttgaattcaaatttaaatttgaatcggatatataaacttttgacttataaactttgggtctctaaattttatatgtgtaaacttgaggtgtataaatttaataaaataggaaagtaatttggtgccgaaaaaggaaaccatctgaagagaagggggagcgcgctggggcgatcgctgggggcgatcaatcgccccttagcctttccgaagcgaaagcgggcactgtttctgctaatatggtccggcccaactggagcagtgtgggcaaggcaagggaggatgtctgcttgggccgacctttacaccggtgccgaaaacgaagggaaaaagtacaccgaaggtccctcaacttatcatcgagtttacaagatcgtccctcaaccacaaaacagatagctgacgaacctcaactaacaaaaccgttcactatacattttttggtgggtactatcccggttttgcgtggcttgagtcaacgtgggacccacgtgggccccacatgtcagaatgccagttatctctctcctcccctcttctctcctttcctcatgtctatctgacttctcccgatttgacggcgacccggttgcggtggtggcggcaacgggcgacgcggcagcagtggggggaggacctgcgggcgggcagtggtggaggggcgcnggggtaggancngntcncgggctcctcttcggccgccacccacgaggcccacgaccacgaggcggcgtgtgcagcgtcaagttcggctgctccaccacgacggccggctcgttcccggccgacgggctggtcgggctcagcggcgacgcggtctccctcgtgacgcagctcggcggcgaggcgtcgctcggccggagattctcctactgcctcgtcccgcactccgtcaacacatcgtcggcgttcaacttcggcaccctcgccaacgtcaccgagctcggcgcagcgagcacgccgctcgtcgccggggacgtggacacgtactacaccgtggtcctcgacttcgtcaaggtcggcaacaagacggtgcatcggcggcgagctcccgcatcatcgtggactccggcaatgcaaaaataagctttgttactcctgcaaattgcaagtgaacaaaacaatctcaagctaagttgttctttaatcagaagaacggtatatgaacatgcagaatttcaagatattttgtggcgccggtttcgctttcttacctcgctatagattctgtgagagatcaaattacatgacccataaattgtagagcaatgcaggagtaacactcccagctaagaaattgattgatgtataacactccgatcttctatcttcgttgggcgatgcaatgagaattcagaattctcactaacagccagcttgctagaatagagtatgagttactgatcttgaatgacctcatgtgtacatccagcaggaagcaaaccgaacaagcgagtccggacttgacgctggagttcggcggcggcggcggccgcgcggcggtggcgctgaagccggagaacgcgtccgtgacggtgcaggaggggacgctgtgcctggtaatcgtggcgacgacgaagcagcagccggtgtccatcctcgggaacctggcgcagcagaacatccacgtcggctacgacctcgacgccggcacggtcaccttcgccaccgccgactgcgcggggagcggccggccgacggagcagacgagcggcgggcaggcgcgctgcgggagaggaagagagcgccgacggggagcggggcggggggagcgaggacgtcgccgccgtcgtcatccatggccgcagttctcgcgcccgcgccgtcagcggcgtcgccggcgggagtgtgtgagcgcggggcagcggcgggcgaagcaggcggtggagggcagagcgggcacgacgccgaagacagcttcttcccgcgccggcgccaccggccgcctctcccttctcaagcgtcgccgccgccgccgcctcccgggcctctccgacggtccgaccccgaggtcgcatgcgccgccgccggctgccggacctcctccctacccgccagcggccctgcagagaggagagaaatgagagggagagatgaggaagggagagaagaggagggagagatgacctgtcattctgatatatggggtccacgtgggttttacgctaactcagccgccaccttagataaaatcgggtcaaaatcaccggagtatctaaattgaactgtttcgttagttgagagatgtcggtatctggttttgcggttagggaacgattttataactcgataacaagttgagggaccttcggtgtactttttccaaaacgaagctcaggtaagccttcgagtccatgtcccatgggtttcatcctctgctgtccaaattccagtatgctggatgctgcacgcctgaaccgagctgtacttacgtagtgtttggatccatgaacttagctttaatccctgtattttgagtattaaatatatactacttacaaaactaattacataaataaaagctaattcgcgagacaaattttttaagcataattaatccataattagataatgtttactgtagcatcacataggctaatcatagattaattaggctcaataaattcgtctcgcgaattagtccaagattatgaatgagttttattaatagtctacgtttaatatttataattagtgtctaaacatccgatgtgatagggaattaaaagttttagtcctatctaaacatggtcttattcgttgatgattggtcaccaataaaacaacataaactgcccaatacactacaaactgccctgtatacagtacacattccaatcggagcacactctttcgttggaagaaatagaaaaaaaaaacgttctaggcttcatgttaccgctgcatccagccattcagatgggcagaactagttgttgttcggcttgcacggaagatgatgtgccgtatagagagatctcctgactcactcaccggcatttaataccttaccttcgcgactgcgacccagttttacctgggacccttggatcttctcgtgaggttactgcaacgagccgttggtggcgtacgggacgcacagtttgggacgagcagctcgcgcaggcggcacccgcggtttttaccccgacacggccagcgccactcacgtacaacacgacgagccctcccatcacgtgcgcgccactgacacgcacgcaccgctagcaacggctcgctcgctgctgccgccatctcgtccagtagccaaatccaagtagccgagtggtttcacggttttcacctcgcgagccaagccaaagccggttgtgcacttgtgctttgtgctcgcgcgcgcgaccgcgtcaaaacctgcctcatctatcgctaaaaatcacggcgtctcgcggctctctctcggcgtacgtgcgtctcgctcgctctcgcgggcggaatccgtgacgccgactcggcaactgttcccccccggtgaaaaggggtggagaagttgggagaagaatctgatgctgctttgcgcgtgcaggcgatcgatcgcgagaggccggccactgtgtctgtggctgtgcgcgcgcacacacagatactcctcgctttaggccacatttacaatcatacatgcatggtacatacagctgctgaattctttcttattaccagagacaagaaggtactaccatgatttgtgtacatctgtggtagactctagccatgcaaaatgatgattcatggattcaaacgagaacaacaagtacagtaacttgcaaacattgcgctgcaaccgtctcactctccatgtcctcctgatttccgttcgaattattgtgaaaggaaaactgttgactcttcatcattaagaaattcggcatgcctttgttctgtctaccaatacgctggtttcttgacaggttttgatactcctggccatggattgctatcggatagctagctttcgtccaaggctttatttttcttttggacgtgtagacattccttgaattattcggagttgtaccgtttcagccaccttagcaatcctgcctcatcctttgtcgaggaaaagaaatggagaatccttctacacttttagaagctgttcatgaaagagcaaggaggatatatctagaagaaagattggaacaatccatgtttcttcaacttgaaccactagcttaactgaggatcagataacctgtttgatgctacgattagtactataaaatctgaacctgtttgacgattcggtgttctgtccagattcgttatcctagaatgtgtcaaatcccattaaactagattcattaggtagcaacattttaaaacgacggaggaagtaatccattagtgcttgttacatcaatctcaactactatattaatttcttgacagggctttctgtggtggaaacacaagagtcatcatgcagctagagataagcaactgaagaagtgaaccatacgacaacgtggctgaaaccaggaaagcctgaacacgccaggaccatcacggtaatctggcaacttagcagtaaagctaaaaacgagccgtttctctgaagccaacatgtgtaccaactcttctttttttttttcttgtgatataaaaaatcgtacacaccctagctattatgcctaactttttttttaaaccgcattatgcctaactttgcccagaaaccgcattcatgacttcttgtttgttttaacctccatatgtttttgtttctcttggtagcaagggtgtgtttagtttcacaccaacattagaaatttaactaaaattggaagtttgaagaaaaaaaagttgaaagtttatgtgtataggaaagttttgatgtgatggaaaagtttgaagaaaaagttattatttcctccgtttcacaatgtaagactttttagcatcgctcatatttatattaatgttaatgaatctagacacatatatgcgtctatattcattcacatatatatatgaatatgaataatgctagaaagttttacattgtgaaacggagggagtagtaactaaacaagcgctaaatgggaaaataaggggaaatttaactatttgccactcttgtgacatggcaattaacgatttgccaccccctgtcaatgatatgtgggccctcatgtgtctgtgacatgtgggtctagtgccaaatcgttaagcattatttgtaagagtggcaaatggttaaaagccccgaaaataagagcattttttagcagttagcacagcttctaccctaccgtagtgctaaccatggatagcaaagttgtcttctcctatataagctaagatactcttccactcttccttgctccatcagtattacaccacccaacacaagctcagccagtttaccactcacactagctgagctagaactcaccactcactgcagttgcagcatggcgcctttgctgttcaaggacatgaagagcctctcgtgctcgtcgccggcgtccacggcgatatgcccgagcttggagcggcagccgatggtccggccacacaagggcggcgccattgctgcgagccctctctgccaggtccccggtgagccaagaacggttcacaggcaagactgcaggagagggcagcagcatcagcacaaggcggctgccgcgaatggcggcgagctcgtcagccccgccggctcatccaggtacctgctcagcagccgcgccgccgccgccgaggagatccaggaggtggaggcttcggctgctccggccgtcgatgccaaggtggtcagggaagagcaagctggtagtgatgtgaagaacactctgacgcaggagcaggtgagtaat

SEQ ID NO: 69300 - DNA, 34477 bp, Oryza sativa
  unsure (1)..(34477): unsure at all n locations
tcaagattttcatgttcccttcatttggtagtaatttttcccttcttcaactatttcagttgggcacaatatgttttattttaaaatcgtaaattaggaagtgctacacaagttacaacgagaacatgtcaaaataccggacaggcagttaaccagtagaaattatgtatagcctaaatgaaagtattgcaagatatggtttgtatgcatcaaactgctgaaaaatatcaattataacaaaaaagtacctgttggcgagcggaaatcatattctggaacggtaaaagcaggatcagaaccaagaccaatctctgaaacaacagacgctatcactgcactgagtatcaccataggtgttgagttggaaagggatgaaagtcaacagaagtaggccacaaaacagattccacggcgaaaaagcacccggcaacagcagcattaaaacctacaatacaagcaatcacctgaaatataagtacaatgcaatcagaaaacagaatgcatggggaaaaggattacttggccagtttgaattgtaggactgtgtggagtatccacaaaaggagaatatcatactttatgctgtgtcaacttaggtgatctattgaccaaggaacattacacaaagttccataaatagattctttgcgtttggatgctacatagcaaaaagttccaaaaaacagacgcttgcgttcagatgcgtagcttctgatacaaaaatatattccatgtgtgtaattaattaaaacatgacagaccaacttaaaagttgaagataaaatatagagaaatattctgcagtgaatggaattttgaaaaataagaaatatgagaagcaagattcacctgatgcgattccagctgctgatccagctgccacaagagaaagttttttccctccttccaatttaaacacatttccaaatcctttggctatagatgaaccaatctccacacttggaccctcaggccccaaagaatttccagttccaagagtaaaagatgctgccatggctttcaaaaatggcctaaaggcaccttttatcttagacatagtgtcatttgagttggttgctatagaacttcttaatgtgttaaacactccaactataatgcctccactgactggaacaagtatcactctctgccagatttcaccgatggactcctcccttagccatgaagcgcctctcaatggtatgccgtcccaaaagagatcacgtatttcatgaacctatgccaaaataatacaaagttcttatctcaatctgcaacatgtgtaatagtgattactttgaggacttgtatgcaatcaagatgctcaaattcttgaaatacattatttatgcctggcagctgcaacgccaacctccattttcatcaaacatctatgggcttagagatcgagattatacacactatccactatattatcagtagggaagaatcaggaaatggcatcttgtgaggatgggtgaggactggacgcgctaattggacaaacacaattcgaaccaagctaaaacaggcacacagcagacaaggagtaataaaactagtaaattttgaatgggaactaaactaatgcatggatgcatggaattangcacccagcattagcttaatgggatccggcaatgctaacatggtgagaagcggtttagaaagggaatttggaagccaaatggtagcttaaaaacattggttatggtaagttcggtggtccaattgcatcgcatattcacatccaagtcggggaactagacgtgagatgtgtcgtcgtatgggtaccgagaggttgaagaggacgacggagacgccactgaggagcccgacgaggcaggcggcgagcgtgacgaggtcacggccgggcgccgccacctcctcctcccaggccgcctccacccgctcaccccgccggtccccgtcctcctcctcggtcgccgcgccgcatcggatggtccggaggcgcgcgcccccgtccccgccaccgcagcggcgacctgccgggcggcggcgggagagagaaggcggggatggggtcgagacgaggaggacacgcgcgggacagggtgccacggacggcggcgccatgaattgggagaggcatctcatattctcatccctagcatactactgcgagtctgcgagagaggagggagtgccgcgaggccacggcaattcggcaaagcgtctcctggcggatttccagcctatccaattccagatggaggctggagcgagctgttctttttttttttttcattcctctcgttttatgtggtaggctggtagccaagaaccgcgatcgtctgtttcatatcatcatcggcctctctctacttctctagtctcttggagaagtaagcaggattgggctttgggaaatgataatgcgtttttgggttttagggccttgcttgatttcgagtgaaacgggcctaacaatttcctgttaattactccgcttaaggaaggccatttcctaatcatgtcgaatatgtgtttatacgttatcagtgtccttaccaaaaggtctctatttgactagattgctttgctccaaacacatgttatcgcaactatacgatattggtggagaaatactttttactcctggttggtaatccctatagtcccggttttctaaccgggagtaaaaatacgggactaaaggttttttttctttttttttctattttgtatatctcacgcacattatctcacatcattcacaataatatagttcatcctaaatcattcacagcaacataattcattctaaatcattcacagcaacatatttcattctcaaaatcattcacaacagcatagttcattctcaacacagatcgaatcacacattcaacacaaatcgaatcaacacagatcgaataattcagcacaaatcgaatcaacacagatcaaatcacacattaagaaaaaagaaaaaaaatacgtgcagccacgccgccctccaccgcctatcgccgcaccgccctccgcgccggccgccgccgcccggctgcctcccctcccggatccgccgtgcgaggccgcctgtgccgccgcctgggcgcatgagaagtggggaggagaggggagggggcggatccggagaaggaagaggaagagatgcggtgagtgaggagaggagaggagaaagagataaaggtgagagaggaggagatagaatttattaactgatcccatgcgcctcctcctcctcgatctcgcgcgcgtgcacgcctcgttctctccgcgcatgccaatcttttttcccggttgtttaacaaccaagactagaaatagatctttagtcacactaaccgggattaaagataacagagggtctgacaccgcttgcctttttttatccgggactaaaaatgatctttaaggttggtgttaccaaccgagactaaagatcaaaaggtagctctaaccttttgaaccgagtctaaagatatctttagtcccggtttttattgtaaccgggactattgtggaatttggtcgaccgaccaaagatggtttctccagtagtgtgattagtgtgctaggatctttctgacatggaccaataactccttcgcatggaataagttcaagactttgcggggaggtccgtgtatccgttggcgatccatttgtgtaattaagagcaaggctaataatatagccgacttgttaactataaggttctttgtagccttctctcagcccacccatataatagttagctctttacgattaatataggacccacttatctctctcacagagttttttggtttttgtgtccaaaccggctataagtttacagctcgcttctcctctctcttctctcttctcttctacacctcagcatttagtcggattatagcctccttattatacttgctctaaggataggccaacgtgagactttggtggatagccttgaagatgctcgaaggtggccacgtgtcctctgcacgggtgcacatggctatctagctaattgcccgggaaccatgtcgtggcaccattcgaagataggaccccacaacccaagtttgcatggaaactgccaagtatgtttacccaagacacggtcaactggagttggtatgttcactcaagaagaaggtcgatcttcgcacatcctagggtgtgtttgtataatggaaaatgaggaatgtaattaggaatgagaaatgaatgaatggttatgattaaatagaagaggaagaatggatggttagaatttagagatgttttggtgggtgggaaattatttccctatcccattagccaaacagggctagatgtctcgtttcaggaatcacttgtcagctcggtaaaggctaacgtggcgtttcttgaagaacggtggaggcacatcctacggacatcacacatccatcatatacgggtggaggcacatcctacctctactaaaaaatgatttttcatggcgtcaccctataattttcgctggcagttatacgtgaaaaccgctactaaaaatgtaactaggggtgaagggttacggacagccagcgaaaatcggtttttgcttttcgttggcgcccccactaagaggtccgccattaaaaataactctattttcgctggcggctacgctaagagacccactataaaaaattgggttttcgctgacggccgattttcgctggcggcagctaacttacaccgactatgaaaaaaatattccctttattaaaatcttttccaattttatcccttcccattcaccttttccattccttcttttcctcctgcagccttttcacctcctgtcctccttcagcctttcctcctcctttttcttcaccttctccttcttcttcttctgtgtggagtaggaaacccgcgcggattaacgaccgtgacccgcggcgcccggaagggcgcctgtgtatccgcgcccggaaaggcgcacgcgcgcgggcacggctgtggggtatccggccaccgcagagccgcgggcggcggatccggccgccggagggccgcggggagcggatcggggcgcgggcggcggcgcgcggctgatccgggcaagggcggccgctttcggacgccggcggcagtgcgcggcggatccaggcgcgggcggcggctttcaggcgctggcagggaggctagatccgccgccgctagatcggtggcgcctggccggtggtcaccggggagctgcatgctagctgcagagaggaggcacgaccgcacgagaggatcctctcttcagttcatgcgtttggttctgatctgtttgcacgtggtggggttcaactgctcattatgtttgacgtttctggatcatcattttcttctgttcatgtgctcattttcttccttcgaattccagaaaccatttctgcagcggggctctgtgcagcggcggaggccggcggggctcggcagcggcctcgtcgaggcggaggcagtggaggcttgaatgcttgaatttttttgatgcttgaatgcttgggggaatagaaatttttgactgtaaatttaaattgtgcttgtgtgaattgaattttttgactaatttttgcttgggtgaatggaaatttctgtggatttttgaatggtggagcgttgattttttttttaaacttggccaggattaacactggcggctgacacagtgttacccgccaacgaaaaaatattttcgctggcggccatcttaagccagccgccagtgaaaatggatctttgctggcggttgggcttaagacaaccgccagcgaaaatgaattatcgctggcggccaaaaaccgctagcgaagattgtgattttcactggcttttgctttgtggcggctcaaaattccaccagcgaaaatctaaaatggctgccacgaaagatggtttttttagtagggtacggacatcacacatccatcatatacggtgtgtcagttgctaagtttgtccattgcattagggtattgtccttcagaaacctgaacatgtatacttctttctttgctcccgagcacttatggggtagaccgtaccaaggtcaccgagaacccaggtcgatcacagttccatggtttcctttgtttgttggaacacagtacacgcttatgtaaacacgcgtacatcacatatataaacacacatcttataatacgaattcaatgcaaacaatcgagaggagaaacatgccacgtggcaactccagtttcgcataagaggctcgacgaaacgatgtcgcgtccgcgagtggaggcatcgatgaaacgctcttgtgcgcatgcagcaggcctccagaaatttctccgtaatcaggtcccaatgggccattgctcggtagcccatgcgaattatgccgtgtgatgattctagaaagaaccggcgccattactatgcatacatgtagtgcaaacacccggtgtatgctgattaatgaactgtaccggctgctgacgttgatttctcacattgcgccgtacgactggcaaagcccaggcaagcaggcagctattgcttcctttcaccaccaaatcttgaggatcaaaggagtaaggccctctttatttaggtttataagctaatttataagtcgaaaagtctaagcctaaacaaacaagcagcttttcgtttggcttttttaaagccataagccactctaacactattaagctaaaagctaggttggagaagcttttttggcttatgtgaggtagatgtatgactcaactactaaacttaggacattaaatccaccggcttataaatcatataagccaataagctgacttaaaaatctaggccaataagcctaagcctaaacaaagagggcctaataatactacctactttagttagggttaaaataggattagccggatgtaattaaatcatccactaaaaaaatcctcaaacatcagtctttttaaactttctatgtttttcatttatatgttttacacatgtatttatgcgttttatattccaaatgttttctttcatatatattgttttcctgagttccaaacatgtcttaggctatgtctgagaggagaggaaaaaaataagacacgtaaaaagaagtatgccattatcgcttcatcaggtgatttaggactgtttaaaaagccaaggactgtttcaaacatgaaaaatagaaatatgattattttaaaaagtaacttttctacatatagttttatgtaaaaacactctgacatacgggtgaaaaatgatggatgtttcctttgtttgtcctttgtcgaatgcagccttagaacaagtacaataaaaagcaataagctagctatagaacaacgaaggagagtgaagaaaaatggactagttagttgcagcacgagctccaatatagtatgtgagaagtaaccaccccttgtgaaaggggtaatctcttcacgaactccagtaaaggaatggtgtgaattggatgaaaattggagccagtatgttagagacaatttattacatatgctacatcttaattaattagttgatgatgtgaataaattggtggtctcaatcacctctactataaaacttactcataaaatttgctcttagagcaaaaataatagtggtctataaacttacgtatatgatagagattaaaatatatatatagagagagaggattggctttcgataaaatctagctctacacatgttttaaggtaaatacattaaattcttgtaagtaagataaagagaggaaaaagaaatatagagacaatcttatagccaacttataagctctaatataagtttagttatctctactattaatctggctcttctatatatgtgtattaatttgttacctattcactaggcctaatgagccaggctcactgtaccacacgtggcaaagccgcacgctttttctagtgtatacattaatcatatgagcatcttagtttatatttggttaaagggatatccctggataggagatgatccagttttttggtatgtttggttggtggacaaaggtggatagggtggtccaaagaggaaataactcacacatatgttggatgagcgtatctgaccaaattggtcggatgagaatatccacctttttgttaatcttaatcattagtaattgattaacaataattaatgtaatttattgataataattaataattaacttgtcaaaatcaagggtaattagacagaattagtctattttgtttttaattagtatagactatggctacattaatgataataacatattttagtattaattaatataacattgttttccttctcatccatccaaccaaacaagatccacccaaccaaataaaaaataggatcaccatcagtggcgaagccacgttgaagctagcgggtgcacatgaacccactaaatttagaatttctcacttgaaaacactaaaatgcacagtattacattgaaattttctagatcttcaatggtagtgtccccttgttttgatgctagcttcgcccctaatcaccatatccttacaaatatgaatgaccatatcatatctaacattctaaccttagaccacaagccaaacgcacccttaagaaaactagatcacattgacaaaatcctcacatatatctcaccattgatattgattaaccgcaccaaagttgtctttataaaatgtcatgtaactacgccattggaccataaatattttatgtttataataggttaaacttttatttttttattatcaattttagattaaaatgtgttcataaatttaatgagttcatcatgatgatatatagtacttttttaaaagcaaacacaccttttttttataaacacacataattgtcgttgtaacatgtaagagcacccgcaatgctaaagtaagatgctctctataaaatatgtacatctcagcaataaactagattaatagtaaaccacctcaatagtatgtttagagcacccgcaatggtaaagtaaggtgttatctataaaacatgtacatctcagcaatagactagattaatagtaaaccatctcaacagtatgtctacatgggtatctatagctctctaatacattgtctcgtttttctctatagactatctccaggttagtagatagctttgctctctctcttcatttaatctcttccaagtaggaaaatatgctgacatggatatcttatagagagcctatagataaccattgtgggtgcccttatatgggtatctataactctttaatccattgcctcgtttttctctatagactatctccatgttagtagatagctttgttctctctcttcatttaatctctttcaagtaggaaaatatgctgacatagatctcttatagagagactatagataaatatctatactaatataaaaaggaggagttgtcccccaccaatgcttcaggccaaatcatcccccaatcatctttgtcctcagccgtccgatctgttgatccaacggcgaaatcaccgattccgccatcccaccaccacacaaatccacgcccgcactactgccaccgcgctatctacgcccccacgctctccccgcgcgatgactccgccgccgcgcctcctcgcgctgctcagatgcgcgctgcgcctcccgacgcttcctcgctccaggccgccgtcgtcatcgcacggtcccgacccctccagtatcccccccatcccgcctcctcctccaccgcgtcgccgatggctccatgtcgtcgtcgtcgtcgcgcggtcccggctggctgtccaccgcgccatcacagatccagccatccctcataccggactcccccatcctgacggccccatcccagcggcgaggaggcgtcgtcgcgcgggagatgactggtggggagagtgaagagggagaggcggatggcaaccctccctctgtcacgctcgctctccaatcccccttcacagtcgagccctgcgtcgtcgccttcccccgccgatgccaccacatcaaggcacctcacgcatggagctctttccccgaagccggacgtaatggccggtccctcgctaaggcgcccagcagatccggccagttgcctcagcaacagagagtccacggacttctccactgctctgtaagaggatctggactcttctgccaacgaggccactgtctgatccaccatcgtaggggattctttccgttccctaaatgcaccacatatcttcccctccggaattttttttttcgaatgaaattgatagaataccaatggctgttgcaacaaggtaatttgccctcaacctttagcttttcaaattagaatcaatttaattacttctttgtttacgcacatcattttaccctaaagactgatgcttgcactgatgtaccatgttgtcatgggggatgatctagacgtgaggactggcaagccatctcttgatatgtttcttgctgagatgaggaggttcgaggtattgccatgtaagtgctcttacctataatgttctttatactaaacacaatattataattttacctggcacaagtgcattgcatgttgttcgggtcaatttggaaccagtatttcaagctccttcttctgtagcagcagttaaaaattgctggaatgtgacttcgctcctcctcgctcgctcgctcctcctcgctcctgtgtactgccaccgcgccgccgcatcctcgccggagccactatcttctccatccgccgccggagccgaggtccatcttacagtttaattcctcactgaatgttgactatccctgccaatcaatcacacgattccctctgaatgctaatccattcaattaatttcctggactggtaatatctctcccatagtggggaatcatgtgtcttttgtacaaattacacaggttattaaactggattctccatttcactttagaagttgattttcttgctttcttggctatatttcctgtcatcacatcttacatttacaagtaggaatgaaatgatggccgactaccttcttgatcactgcgatgtgccccttcgcttcaaggatatgcataaatccaaggtgattctcatcttccaaatctttatctcgatatttcccctaggaataaaagattccaaacccatattcacactatttacagtgagcattaggatcattttatagaaaaagatatcgaggtgatctagaagttattatacgttaggtctgctgcttcattataatagatcatatgtgtatttctgaatatatcttctttgtttggtttttcccagtccggcactctgctagtattctaggtaccggactgcaacctgtaatattattttgcggtgtactgattgggtggttagatttcaaaagcaatttcaaattatctgtcctgtccaactattgccagattacccaggtgccatgtacaatactatttttttttaaaaaaaaagtggcactcaggaagtttgagaaccagtatgtactcctaccaatgaatatcacatcatggtgtttcaggttttgtttaagtttggaaagaaaatatacataatttgtggcaaataatgttcagatttgcagattaacatgctaccaaggtcaaaactgtatgtaatacatgcaagtgtcagattttttttgttcccctactttactaaaactgtaaattaggtttacaacgtgtttctgatatataacaataagagaaatcatgatatcgaaaagtatctgttaatgctataaggcatctgaatatattggcttacttctattgtttataatacaggttgacattgtggccaactggagattttggtaaaatcctatcatgtttcaccatggcatttcactgtttggcgcacggtatttaggagctatttgtatagtaaatgctggaatattgaagtaaattatatgttcagcttattaactgcattgcgataagctttgatctagatccggtttcaattttcatttgtgtggtcgcatcctttaatttatatagcttcataagagtatactccgaagtacatgccgttttatgtatttttatgccttcatattctgattgtctaatggctctaaaacaacagacgtaaactacgatgtctgaagttttccatgttttcttccttatgaaaatgatatggagctgtggcaagctgctttggcaatccctgttgctgtccagagtaaagattttcatgtggcttgcgctaaagggcagatgcctcatggctgacaatctacagaaaagaggtggcctcatcaggcgaattgttccctatgcaacctgacatttcaagatgacacccaacctttttgttcaatgtgctttcacaaacaggatttggagattgctcaggagctaggtgaatgttggctttccgcttcccagtgacctcaatgtagacttggctgattggcggatggcttcaaggagaagcttcagagattatctcagaaaagttttcggtacactcttcttcagagattgtctcagcaagttgtatggttgtgcagctctttggtgacatcaaagaaatcacaatctggagggaggcaggcttcatggtaggcgaaaaacgattggcattattccttttgcagttttttctctcccactctttgtaaccggtttcgacaacttcgtgtggacgcttagtttgtaacaccatctcataatcttaatgaatttgcttagcctactcttgggccagtctggctaaaataaatgtaatcagagttatacttcatttgttggaaacataacttgtaaaataaaactaatcatttttatccttacaaaaggctgctcaatgctgcaataatttatgttgaaaaaggaagtggcaaaacagcatgtcttttgctactttgttctgtctgtttttcttgaagaattctctaattttattgtgattagtcttttgaaaagactatattaaagaaatttcttattttgttttggttatttctatatgcaaaaattaatagctctataaattcaatagttgaagagaagcaatgttcagaaaagttgaatatgcacttgatatatatgtgttaataaattacctttcaaagtatgtgtactttctaatttttaaatgtgactatatattttttatatatattatgacaaacgtgttttacatgtgcacgataactagcaatctctaaagtaaacgtatattgactaagaatctacgctgaatggctctattttgaaacgtggatatatgactatatgttacataggagttacaaggaaaacgaaagaaaaaaaaagacgcagcgttctagaaaagtgtcatcgagcccattggttttgtcgcaaaatcgtaaatgttattgccaaatgccaatcacatcgtggtccaaagcaaaacacacatttctgcgagtactttaatcggtgagcccttgagacgttaactacacgaaacacacatttctgccgcccgacacttgccatggaccagatgaccaaaaaaatgaagcggttagtgtggtgcaaacaaaacaagccgctttacatgtgtttcaagactaaaagaagaatagttttgtgcaagactgtttacgctttcaaataaagacagaagcagtgaaagtgctttgcttgcagagaattgaagaatgccctagcgcgaagcagcgcatgcggcatgcccccaccagaaaccggaggaagaagactagcaaagccggatcgagatcaactgcagtggtaatagcgactgcaactttaaccgttgttgcgtgactgtcagatcaaagaaaatggctcagattcggtcagggtacacagtcgtgtactgtaaagctgacagcctggttgtgtcgtggcgcagctctctatcgttcatcagcttaatttgatggttgtggatgatatgactgtttaacgtgcacccgacctggccgcgagcacacagctttcgctgcagtttccgtccgacctggccgagaccggccatcgaccgctcaggcttggataaaaaagggccggacttgagcatcagcggcggcagagcggcaaagcgcccacggaaacgatcagcccgtacgtgcaaattgtgcaaaatataaatcggtcatcgtccactcgtcctatcgagacggccggtccagggtggcgccctggcgggcggtcatgcctccatcaaataagcacagatgcctatcttgacagaccgtattagtatcgcgaaccatatgtgatcctcatactaccgcatatctgtatgcgtgcactggatcagtgagtggctctgtgtttataacttagggttgggaacccatctcatccgcacggaaaacggaacagttcattagggcgtgattaattaagcgttagtttttttaaaataaattaatttgatttttttgagcaacttttgtatataaattttttttaaaaaacatatcgtttagtagtttaaaaagagtgtgcacgaaaaacgagaaatttgagttaggagcaccgaacacacctagtaagttccacgccaaaaccggaggaacattcgtaccacgcgtatgatgctgaatcctcacgagataattttgccgtacgttttactcgcaagtgcagtgcttctagaacaaagtggtggctctcgtcttcccgacagcgacgcgcacagtgataggatcgtcaagcacacaatcaggcggccgcttgtactgaaaaccggacgctttgctgcgttagcatcgccattattcggaccccgcgcgccaaccatgtggtgtcgttcgatcaccggccactgtctccgcccacacggccggagagaatccctcgccgcttgaaaaaaatatctctattccccccggtattgatagctcgcgagccgcgactcgcaagtcgcaactgaccacaggaggagacaaacaagacgcagaccttatggaccttatgggtgatgatcttatctgattcgactagtcgactagtcgcactgattagactccccttctctggtcccatcgtcgcgttgtttggcggcatcagcagttacccgaaactaattattgcgaacacgacattattgtttttctaaaacaaaatcgagatcgcaagttcgcgacgaacgctgatagcttcagttcaggcgcgccggtgcaacgcgcaaggaaggataacccttgccgtcgcggtcgtgtgatcgtgtcgtgcgctgcactgcactgcactgatcaggtcgcgcagccgctgacgtttcgttgtgtcggctccacccgtttgggtggatcccttccgaattccgatcccattggtcattgaccaccgggctggttgcccgcactggtcttgcccttttaagcgccggcgcttccgtggttggctcgccattccagagctcgaggtggagatcgcggggagaggaagcgaaacaacgataggaggaagcgagacaacgagaggtggtttctcggttgcgggtgagtcgtgttgaagtgagctatggtggcgttggagatgtgtgcgggagtgggagttcggggtcacgagttgaagcatgggcggcagcggcacgaggaggtggggagtgaggtcgcgggagacggcgtggcgtcgctcggggagatggacctgtacggcgacgtgctcgagtcggtggtggagcgcgtgccggcggccgatctcgccgcatcggcgcgggtgtcgcgggagtggctccgcgcggtgcgcgccgcgctgcggcggcggccccggcggctgccctggctcgtggtccacctccatggccggcggcgccgcaccgcggcgtacgacccgcactcgggcgcgtgggtcaccgtgccagcagcgcgccacgacacgccgtcgcacgtccgcctggtgcggggcgcgggcggggaccgcgtctgcgcgctctccctctccgggctcgccgtgtccggggaccccctcgggaaggacgtgtgcgtcgcgctgaaggcccccggcgtgtggcgcgtcgacccggtgttcgccgcggtgggtgaccgcgtcgtcgccctcggcggcgcgtgccagttggcgctgggcgagggcgaggacgcctcggtggtggaggtacacgaaagcggcagctggacggcctgcggtccgatgccagccgagctgcgggagtccgcggcggcgacgtggctctcggtggccgcgacggatcagcgagtgtacctcacagacagatccaccgggtgggcaagctggttcgatccggcgaagcagcagtggggacccacctgccgcctccgccctgacgccaccgtctccacatggggcctcgcccccggccgcggcggcgccgagcggctcgtcctgttcggagcgaagcgctgcggtagagccgagcaagcgaagagcagagtcgtcatccaagcgtgggaagtggacggcgacggcctcgcgctgtcccgtggcgcggcgcacgacacgatgccgggggagatgtccgagaggctgttcccccgtgacgaggacggcgatgaggaggacgaagaggagatgtcgccgtcgatcggggtgtgcggcaacgccgccggagggtacgtgtacaatgcggccgacccgacaatcggagccgtgctctacgagctacgtgacggggtgggcagcgccgtggagcgatgggaatgggtgccgtgcgcgccctcggtcgaggccgagccgttgggacgcttcatcctcgcgtgttcgccggtggggctggacgagctcgcgcgtggtcaaccagccgcatgtacaaccgcacagtgaactcatgactgccgacgcccgtccaaagcaagttaacctcaaaggttgcttttgtaaataaagtcccgcgcagtagcacggctactcgctagcgtacataaaaaattatgttaaattttctttacacatgattttcttagaagttattaatagttatcccgttggcttataacattataaaaagtcaaatattggtttccaagtcaaaccagccaccatcttttactcttcttctcatgttacccttttatttactcgtgcgatttgtcacaacttttattgacttttcatgagaccattaaaaaccgtaccttataacttttaccgttcattgtatcgttaacgttaagttcccttttattgtttcgagaagtcccatcaaacgattacattatactcatttatggataacccgttatcttttttttattattatcattcagtttttaaaagttgaacatgttccttactttactttctagaagttctgctaaccatcatgaccctactatttatgtcatatctatctcattttttcttaatatcattgggataaaaaaaaataggcctaactatcttttttttttggagggggggtttatagtttttatatttccattattcgtcacgatactacttttacggcttgcccgctatcctctcccttactgacattttcccaccgttgtgttatatagatgaactactttgaatgttccttgttttcctttatttctacatgtatttctactttgaactctgaatttttttttctatttctagtttaggaatttattttttttatttaaaattttggttaatcatgtgttgtgttctatatggtatttttttcattatttattatttttatttcgaaattcagttatttgtaaattataattatacttgatgcttaattttattttttaaattttgaatttatcttattttctatttgaaattttaattaatcttgtgtcgtttctagatgatctctccttttaatgtttcctttttttatttctcattttagttatttataaagtgtatttttacttgaactcttattttttatttttctaatttcataatgtattttttttctgttttttaaattttagttaatctcgtgttgtgttctaaatggaatgttttttttcaatatttcttatttttatttataatttcagttatttttacattgcattcctatttaaactcttcctttttttccctaattttggaatttatttaatttttaattaatctcctattgggttttgtatgaattgttatttcaatatttcttatatttagattcgaatttcagttatttctgatttgtggttgtattggaacactctttttttctaaatttggattttattttatttttattttgaattttaattaaagttgtcgtgtgttcttgatggacagttctttcaatagtcctttttttttatttcaaattgtatcttacttgaactctcttcttttttttaaatttcagaatttattttattttttatttcaaatttaattaatcttatattggttctatatgtactctttttccaatatcacttatttctaattctaaattttagttttttctaattatatttctacttaaacactcttttttctgcaattaatgtgataatttatagcgttcatggtgaacatggtgaaaatgtattttaataatataatagatgtcgttccattgtgaaaatgtattgctttgctgaaagttgctgcagtgttttgcatagtttcctcgaactcgaacctctctgccatttttttcctctcgttttttttttcatgttgaacattcgtatagtgacaaaggtgagggtgttcctttctgtaactttatttaagcaggaggtaaagcagtgaagtgacatatgcattatcttacacattattgctttcatgtgttgggcactaaaatctcggcttcaaagttaaagtcttggcaatagtgactaggggggaaacaatataatgataaagtttggaagactcgattaagacatatactaactcctcttttactgttatttcacagtggcatcgggacagatcgggtgcatagatccgatctttgaccagtgttttgtataggaagacaagtccattttaacaaaccacccacccaacccccaaatattactgttgtctaaaacactttcccaaactttaaaattggtcatccaatcttaactatcaaaatcattcaatttaacccatcttattccaaatcagccggttttcgcttgcgtagcatttgacatggcattcccacgatgataatggtctctgcaacaacgatgacttatgccatgtgggattggtgattttgggtttttttttcccatgaatgtggatttaggattttggggagattttgcaaatgaaaatacaaatttgggtgatgaaaatccttatcatatgcggtcaccttaatcaccctgctagtgaatttttttcattggtggacgtcataagctagccgcatgtgaagaatatatttcccaggcacagaggcatccgtcagcgagaagtttgtatttttcattgacctttggttatcggcggcaccgcggtcgctaacgaaaactcattttggacgtcagtgtaaacacattttgtagtagtgggaggcagaagaagaggtgtttgtcaccgatatatgggcctgtgattattatttttatttcttgactaggcagttacatcagctcacgtaggcaaaaatcggtgaaaaccgttttgagggtaaagtaaatggcattaaaagtttaggatgtcaaataaccggtttcaaagtttaggagagtaaaataccctatcgaaaaagaaattgcaatagccattgaaccggtatcaattccacatgtggtgctcgatgtccatgcaaagtgaaggctgttttatcgcgaatattagtgaatgacctaatatcacataattagaaggggtgaggcttcgaacccaggtcgtctagcccaccaccttgtggagctagccggaagacccctgtgcgtttctctaaaggttgttttatcattctcctgagtacctgtgtaacaaccacttacctgtagtgtttaattatttacagacttcacagcgcgtgttgtactgcacactggactctaaatttctcgcgcgcgcacagacagtatatataggatattcatatgggactccatggtgcccgggctccaaggtataaaacacacaaattctctcaaatttttaaaaattttcatatatatatatatatatatataatatgtgaactatcacactatcacactatgtgaactatcaatatgcctgcacattatcttattcgaatgtgtgtgtatatacactacgactaatggtaaataatactccgtatgcgactagctagagttggcgaaacaaaagatatattagaagcaagttactaccaactatctgacgagaaaagactgttggaacagacaacacaccatccttattctaaagagcaaaaattaagccaagcggttgctaacgattgactaatcggtcattatatctgcgacagtgccaccaggtcgtggcgtggaataagttcattacaggtcccttgacttgaaagcaagttcgattttcgtcttcgaaccataataccgaatacaacagatctttcatttgcaaagattggtgcaatattggtctcaaagagacggtttatatggcggtttcaactaacctagcgcccacgcaaacaatttaacttggtctttatctgatgtggcacatgaagcaaaatttaacaattcaaacattaaaacaaaaattgtaggcccatgtgccagtcaaacaataagattaaaaattaatattacccacatattagtgggcccatttcctccacctaatcccttcctcgacatgtatggccacgcctctgcgctccccattacctgacgcctaccgcgatgccaagtcctccctctatgcctccgcctcccctggcgacaacttcaagcacatggaggccaacacctagggcgccgctgccgacaaccattgaaaggagtcgtccgactactgtaccgccgtaccgaacccttcccccacgtcgacgacttcctctcctccccttgtcgacgcaccattagcagcgggcgcttccaatgtgtcgaaggactcaactaagaaatggtatggacttgtggtcggtgtggtaatcgttgcatcgcagcagggtggcgatctaccgtgccatcacttagctcctcaccggtcaagaaaggaagcggatcgagcgcttcaggatcgagctctgcgttccagatccaggccctatcaaactacgctcctccacttgctcggcctccgcctggccgctgggaacgatatccacaccctcatcactgatatggatgctgacgacaacgggaccatcgagttcgatgagcttgcctcctcccgccgcgggcttgtgctacacccaccactgcaatcgccgccgccacctcactcccactggttatgttgccgccaccgcaacagtcgtagccgatgcgctgctccccatgccgccacgcatcgaccgcgccacacggcaccctagggcgccgcttccgtgtcgtgtgccggaagcacacaaggacgccatggctgcctcctccgtcgctttggaggaggaggggagaagtagaaggggtggatatagagaagagagaggattatggtgagggagtgggcccactgacatgtggtctcactattttttaatcttattgtttcactaacacatattgttaggtccacaatttttgttttaatgtttaaatttttaaattttacttcatgtaccacgtcagatgaatgaagaccaagtcaaattagtcacatggacgacacgttagctgaaatcgcttgggacaaatatttcatttgttttgacggttaaaggacccgttgtatctgatattatggttctaggatgaaaattgaactccttgtcaagttaagagacctgaaacgaacttattccttatggcgctgccattgtgggtaataggcccagactaagccctttgtgtagtggggtgtgggccagtgcggcccattaacgttgaggacagggcccagcaaaagcaacttgcatttccttctttttttcaggcaagttgccgagttgggcgctgcccagggccaacctgcggacctgcttggaaccctagcgccgcaatgcaaagagcaaccgttgcctcagcctccctatataagcagagcacaagccgggggtcttcaccacatcccctctgcttggtcattttcagctatgggtggtagcattcatcttggtatcgtcctgcagttcttagtgagaaacaggtcaaagctctagatttgtggctcctggcttctattttacttgagtttgctctcctttcttgtggctcttctgttttgtttttcttttgatttttattaagctagatttatcatgatttttgctgtttcacggtgagatcttgttgtgcttgtgtattctggtgcaaaatcttccaatccggctgcgacaaatctcctttgggcagcccggccaccttttgcacagaaggatgggctacgtgtgttaaaacattagtggcaagtgctttgcctcatttccatcgtggaggattggagttcatctgtttccagtcctcccaatggagcaagcgcacatcttgtcttgcatcccttcaatttctgtctttcataggagtatcacttctgagatctgatgaaaaaagaaacctttctgccatcttttgagttttccctgcttttctcgtgaaggatggtttatctctactccttccgtccaaaaaaaaaaagtacttatctttatatctgaaattcagtcagaggtcaggaaaactggatctgaggtaatgttcgtacatcagtggaagtaaaactgtggcacagtgcagctttgacaaatgacatggtccctcgtctggaactattcaatcattcaaatactagtactaataaaaaaggaacatgtaattttgcgtgatactactaacttgctaataacatgtagcaagggtttgatgaccaaacttcataaggaaaaaaatttcatacgcttgcaaggagatattgatttgcataaactgctgttccgcagttgtcaatagggaagccagcatagcagccacatatttccaaatcgctttataagttacatacaactaatgaaaatcttgcttgcgtctaggctaattagatctatacaaagggtaccaaatccccgagtcccagagcaatagagcatattcgcgcagaatatgccttttcaatctctgtcccaagatccaaatcttcaatgaacctcccccactcgataaactaaaaacgtttgactctgtcagaataagcaaattgtgacaaaaaggcggctgcaccttggccgtgtttacatttaaattttcttcaaactttcaacttttccatcacatcgaatatttgaatacatacgtggagcattaaatatgaaaaaaaaattgcacagtttacatgtaaatcgcgagacgaatcttttgagcctaattacgtcatgatttgacaatgcaatgttacaataaatatttgctaatgacagattaattaggcttaatagattcgtctcgcagtttacaggcggaatctgtaatttattttgttattagtctacgtttaatacttcaaaaatatgtgtccatgtaattaaaaaaaattgacgcacgcaactaaacacagccgtaatcgagggctgtaaagtttacataaacaggaagttctccaaagagaaaggacagcaggaaaaggctacaacatgctgactgagcctatacttttctatttgcaccatttgctctgcacgtcctttggtggagcataaatgcattttcacaaaccaggccctatttagggcgtgtttagtttgggaaaagaaaatttttaaatgtcacatcagacgtttgaccggatgttggaagggattttcggacacgaataaaagaactaattttcagaactcgccggaaaactgcgagacgattcttttgagcctaattatgccatcattagcacatgtgggttactttagcacttatggctaatcatggactaattaggctcaaaagattcgtctcgctatttcctccataactatgcaattagtttttctttttatttatatttaatactcgatgcatgtgtctaaagattcgatgtgatgtttttgggaaaaacttattgggaactaaacgggcccttagattctaactttttttcttcaaatttctaacttttccaccacatccaactttcctacaaacacaaacttacaacttttccatcatatcgttctaatttcttcaaacttctaattttgacgtagaagtatacacagcctcaatctagtactcaaggtttaccaactggcttgtggaatcccagaatttgatccacaagaacacgttaacacgctagccctacgcccctacttgtacagtgcgggcagttcatctctcttgcagtttagtttcactgtagttcctaccagttagtttcactgtagttccccaaatgacgatgcacacggtttaatccctagaccaacagtaaactttgcagacattatcaactgggcaactggctccaggtaaattgatttacaatatggagactgtacacataattttaagtgctacctcagctgatagaagttaagggtctggaatgtctgaagagggaagaaacctcattaggaaactcgatagagaccatacgcagataaccccaagaatctggaggacagtcaataatgctcctaaggagttcatgatagccaaggtttggtttgttgcctctgttcctctaacagaaaaggtgagtgctgtcaccagctgagctgccctgttcagttggtgaagcctgtagatctgcaaagacgaggaaaagagtaaatgacatatgcttagaaatggagcagttcacgagacaaataacatcaacagatatctaattgttcattatctgcttttactgtgcctcttaagcgattcactcaggcatcttcaagacgctcgtgagacaaacaatatcaactgatatttaattaaccgtatagtgagcttcgttccagaaataatcacaaaaaatttctttaaaaattgtgaagcaacctcctggttcgtttgaatgaacaagagcaaaatagatggtctgcaactctgcatctggagatacaatggacaaaaaataaagctgatacaaataaaagagtgtcaattgtaacgtgtaaaaagatctgatgcctgcttctatatatgcctatgtaatcggattttttgtgatttaacacactgcaacatatagtttgggcagactgaaatcacaccagtgcacacttgattataaggaaagcacaatggattaagcttttgtttcaggatccaatagcaccaggataaatataagcaccaggttaccttaaagatgatagggataactggccaagaaggtgatttccgatgccgtgcatactgctcgaatgcgaattgtacaacaagaccaaccagataaggggcaagagtagctgaagctgctggtccagtccagggccagaccattcccatggtcaaaagcggtatcatcaagctcaaaaccatcgttgttactgaagaaatacggaaaaatctggattttgaccagatataactcttaggagctacttgctgcaaaggcctccagactttatcaatcaacaggacaaaaattgcgactcctccataaaatagagcctcggtaaagaatagtataagaaaatctgtaagcaattatgaaaaaccatcaggttatgctgccatgcttaggcttcatccaaatgtggaatgggaatcagggacatctagtgtcttaagatttaagagtattagtatatacataaaaatctttaactaaagaatgctgcacatagggttcagtttaaacaaaaaatggaactgttatgagatatgtttgaatagaaaaatataaatttaatgtagaataacctattgtcaatcaagcactaattagtcatattccttctctagagtagtgcaaatacagacacatgggatatgctagtgctaaccaacacaattatcttgtttccgtcaactattgaagtatcaaagaaagcatacctgtcaacaaggaatcctcaaacacagctgagagtactttgcgcaagtaaagcgatggaagaaccaagaaggccacaaggatagttggaccaacaaaccaaactaatctagacgcttccttgccaggatgtggcacactctccacacttttcatctgataactactgccttgaaatgagatgaaccctgattttccattacccctctcagtaaaataggaggagctaccagacgcaggggaatcctcagtgctattatcggtctcttctaccggcaacgcatctgtggtaggtgaagtaattgactcctgtttgtccatagcagcgaaggaagtaattcgcttgatatgaaaccttccatcgtggttgccgtatcttcttaaagcatgccctgtttagcatgtagaaaaactaagcacaaacacagcagctcaaattcaatagagttttatggaaagtagatggtccaaggggggaaaaccttttagggcgtccaagtgctgcattctacccccatttactctctgaattggcaatgaccttgcaaactgagagataatccgtgttactgctatgttactaaagctacatcagacaattcaccatctcttagtggtcacagcatacagaatagcagacgtatatggagtgatagtgatctttcaaaaccaaaagtatatggagtaggcactagttactgtgaccattcttagcaatttcaagtgcagtactgcagtatccctgaaattatctgccattaatgtattatgtatcccctctgtgggcgactcggatgacacagcctcactgcatgatgccaccacacgcagggtagatttttattatgcctttcttttcgaccgggatatacacaaccactcacgggaaattctaccggcggccaattaaaaccctgcctaatccccaacccaacccaggcaagcaagacaaccaccgcgtgaaattctataaattggctaggggacctacttgccttggaatacgagtaagcggaggagctgaggcggcagcgaggaggcgacggcgcggcggtccgggggcggggcctgagccggagggcggggctcgcgacggcggccatgggcgcgggctgtctctcccggcgtggcgttatctgtagcagcggccagtggccgggcgggcgggcggctggtgtggggagtcggggagggaggggaggccgggagggcagcgatggtggcctggggaggcggacgggcgcaacgcaacgcaggcacgggacaagtgcggtgtggccggttggtgcgcgaacgtcgtcgcggactcgactcgcggtttgctcgcctcgcttcgcttcccacacttgcgctcaccgcctcacacgcacacggcaggcacggcacacgcgcacggtggcatcgtgctcggtgtttctgggccaagtttgcaccgcgcgatggggtaggccgtgtggaacgcaaatggtggctgcgctacacttgggctgctattccatggtttggtgggctctgattatcggtctttcgcgtgtgtatgggccgtatggcagcttagaagagaccttcgtctctctctcaaaaatgagagagtgtgcgtactggagttttacaaattactccgtactgtactacaatagactgaaatacaaagaagaaaaataattgagtattggttgacggacatactatcctactaatctactattcccttgcacgttcatgtgaggtctatttgcacacgggtttgttttgataatgctcatattttgaaactggcacagatccgtagattctaaactttgtgtatatattcaaactttaccatggatttcatagatattcaaattttgtacgcggttttttgagcgacaacagttgcagggtgttgactgactactgagtagggcatgctatgtacgtcgagtgtgaggagggggattgtccgtcgccaaaatatcacctcaactatgccgcgagaatgaagtcgcgctagttattttatactactcaactaaatcaaatgcctctctaatggtcatttagatgacgttttgtccaatactttaatttggtataatgatagtcctattttgaccgaacaaaagctgaagcttgacactgttcttcagacttcgaaagaatctgcagctcataaagccggagcactttcacatttcgagccactgttcccagcgaatcaacgactttagcaatagaaacactgataccaacatatcacatcaaaaagttttgactgtttgagtatgagtatgattaccatcacaaaaaccacagggagcaaaccaccaacaagcgccgatccacagaagtaaatcaaacccgtatatatctggagtactagcgtatagtgcccccccaatcccaaggccaccgaggtgaccgcgcgcgccacgacacacgtacacccctcactgtactccactaagcccacgaggccacgacccacactgtgcgcgcgcgcggtcaaacgacacgtaccatcaatttgtacagttgtactacaaccgcgaccttattgtccgtggcattcttcacaccccggccggcgacgcgtcgacggggacggtgtgcctgggctgtccgccattcgccgacgacctcccgccctcgcgcacgctgttctccgcgaaccgcacgctggccgcgttgaaacccttctcgcgctcgtgatccgaccactcccggctgtagtactcctccgccgtggcccccttcctcgggcctacgagcatgccgccccactgcgggaagtagatgagcatgacgggcagcgtgcacgcgatgatcatgagccccatgtacttgatcccggtctccgtcttgtactttgtgccgtggaagaagatgtactgcgtcagcacggcgcccacgttgcccccgccgccggtcatcccggagatgagccccagcgacctccgcgacacgaacggcacgatgccgaaggtgagcccgcacgcggcctggacgaagaaggagaagagcaccatcacggcgacggacgcggcgaaggagaagtcgacgattccgagcaccacgcagaggacgccgccgatggtctgcacagtccacagcccccacagcctgccgcgcatgccgtaccggctggagagccagtcggagagtagcccgccgccggggcgggagatgatgttggccatcccgaagctggcggcgatgagcccggcggtctggaggttgacgtcgaagcggtcgtagaagtactggtgcacgacgttgtcgatggtgagctcgacgccgaagctgtagccgtaggtgagcgccaggatccagccgcggtagttggtgagggcgtggcgcagcacgttgccgaagctgtccttgtgcatgtcgccagtcttgtggagcttcccgtagttgccgccgggcatgtcctgcccgaacgccagcacggcgatggccgagaacgtctgcatcaggcccgggatgaagaaggcgatgcgccacgccgtgaacggcgtgctaccgatcttgtggatggcctcgtacacgagcggcatgagcagctggacggcgccgccgccgaggttgccccagccgccggccacgccgttggccagccccactttgggggccgagaacatggagctcatccagaactgcgccgacacgaacgacgccagcgagatgcccgtgaagaagcgcacgaggaggtaccccgacggggactggatgatggaggagcagtacaccgccggtgtggtgaggaggatcagagacgcggaggccagcctgggcccgaccaggtcgcacgccgtgcccatggccagacgcgcgaacacggcgcccgacacggacgcgatcccggcgttgccgatgtccgtggccgtgagcccgagggtgtcgcggatgagcggcagcagcggcggcgcggcgaacgtggacacgaagcagcagaagaaggagaaccacgccatgtggaaggaggccatgtgtggcctcgcgaaggagaagagccagaactccgtcgccttgaggtcggagtccaccggcatcctgaaccgcggcttgccccccgccgcctcgaccccctccacctccatcgccaccggcttagcctccatctccaacacgtggtagcaaggctagcagcttagctagtgactgtgtgtacgtacatccgctgtgccctgcgcgtcagctcttatagcatagcggaaagcgcggctccggcagcgcggcgcggcgtggcgcgatggttgggtgcggcgagagggcaaccggtggagagaaaatgaataaagatttcgggcgtgatcttacgcgaccggtgggaggccggcgctgccgtctccgcgctcgcgtcgcgggtttttgttggcgagcgggtgacttggcggcgcagtagggtcaccaagccgcaagggtggtgggccatggctggaacgaagggagattccgacctctgactttggaggtcacgtaagttccttggcctgtggaactgcctccctcctcggcacacacgaatactgtattggcggagaggaattcgtcgcggatttggattgggttcccccggaatgccaccaagtctccaactattatggcaagttttatggcagagatgactatcacatctaatattgtccatatcatcaactaatttattaaggacagctcatataatagtctcaatgcaacataaatatttattttattcactctcatccaatcaacctcactcttttctccttcctccttaaagtttgtaaagaggttgtcccttgtatgagggatggctcatcctctctctcatctactctcttctccacatcatcatttaaaattagatggcatctaggagattgtgcttaaataactatagtacttgccgttagctcttctccttctccagtctagttgacaatagtgctacgacatgataacctctgattggcgagtactgtacggataactaaactatgcaacactaacatgttggtgactttgtggtcattttaattttggaacggtgagatcagctcacgtttaacacaattatactttgagacgagctgttttatgtgttcttgtatgcctagtgcagtgaacggcctgtatcttttcatatctatattaacagtatgcctagttgcctacttcctccatcccataaaaagaacactcctaacatctcaagataatttgagtgagaagtaaaaataatcaaaatccttattattattgaaaaagtagtaacggtgataagtaagtaaaaggtatttaagaaataaaacttctcgttttatgtgttgagagtaggtgggatggtagaagttggtttttttttacaaaatttaaactgcaaaagttgattttttttacatagggagtactgctcagtatttttttttataaaaaataggatacagtgtactacttgtccttgtttttctgaatgtcaaccagttatagccgctggtttgctagaaaacagctttgcgcatgcataggacatgttaaaaaagggatcagttgtgcaagtggaaggagaaggacatcacgatcgcaaacgatttgcatgccaatatattactgcatttgaaagcatcaaatctcacggtatatttgcaaacgaaaaataatttgtagataaaatttttacatatgtgtttttaatgatctaaaagtaaagactgaaaaataaacttcgatgaaaaaactccaaatcaactttaaatttaaagttgaaaattttaattttggcttataaatataagtataagcgaaaagatgaggctgaaagtgtggcatcatgcacatacctcagctaggattgcgcagccaaaggacacaatcatatgatttggaagagagaacagaataactaatattcctcaggaatttgttccacgcgaaaaatattcctctgtaatggctggagatcctgctttagtacggataggaaacaacgtttgtggttggaagaaacggccaacaactagaaacattcagaatttagctttcaaaactacttatgattatgctagtaggtaccaaggtgcaaccagacaagtaggtgatgaaaataaccagaaattgaacgctgcatttgtacacttgcgaaatgtttttcccctaccttaaccatggcttctcatgctctgaaaagggcaagattaatttcatcagagttgatgacaaattgaagatacatatgcatatttattttgagacaaattcatttttgaataagtatgaacatttcaatttggacgaaaagtttccttgagctggccggccggcctggccccaagcaattcctggcaacagagcgacacgataacatgtcaaaacttgtgcactctataaaatggtgaagatatagacacgaagcataagatgtatagtaagtagctagcaagaggatcgaaatgtaagagctaaccccagctagtgttttctttttctttttcttttttggaacccttgctcaatcactgttaattagtggacatctaccaaaaagcccaaacttaaattccgggttaccaagttaaccaaaattcttgtgacggcctataaagtttgcattctctggatgtggatggcattgacttgagcaatggagtttgctctggatatatgtgtgacgtctcagcttgaaagctgaattactgtaataaactttggtcggaagctcttgagctaaaggctgggaaacaagttgatcccacaaaacacgatatcatgtggctcttttaatcttctgtacgtgtagcaactaacaataaccaccattataatatacagatgcttgtgcaacccctccgcggactgcggctgttccgcagatcgttgcaagattcttcctctgactttggtatctcgcgtcatctcctcggctttttgctgctaccaaaagtctctgcatagttaaatgtgagatacatttggggtacttatatatttagagcacatccggatccatggtttgtacggaacacagacgatgcaagggattttctgaaatttgaaaacctgacaattagatcattcatgaagatgaaggacatggatgtcaggggcgatcgattcaatatccgggccagtatatgcatcttgtactagtagactactagtttcaacatttcacgctgatatgattaggatttgtgcaagaattgcagataagacggatatcccttcagttacgtttcgtgactagtatacattggactgaaattattggttccggccggacatttcctgcagctcgtatgaacttgctaagcaagatgccaacttgctatcccccaaattgtcaacctcgccgtaggttggcatccaattggcagttactttattgacctgatagggatggccgtgtccttcaactccagcttagcggtgaccccagcaggtgaatgtggcaactcggatatcccagccgcagctagagctcctctcaccaatcactagctctctgttgcatcatcattaagtcatggtgattagttaagataaaaatgacgtattgtgattagtttagcctgcgatctcatgctgtcccagcttgctctgaccaacaaagattcaagataccgtttctgcactattgaactaccagccatcggttgagacgacttagatttgatattattgattcatggcttggcttgagtttacttgggtatccaatgggcgcctctggcttgctggttcctgtaacttcgatatcttaaatatatataggtggctgtttacttacttaagtagcacatgtacgcctgtaatctcctcatcaaactttgaatgcgcagtgatagtcaggatcaattttgagctaaacaaaagtttgcattgccttggttaaattggtcgatggttaattggattgagtttggatgtagtggggacatacttctcgcaaatgtctgcgctacagtgctacctgttcattctccggtagccatttgtccgtagcacataaataaacaagataataccgaaattaattagggacataacttttttaggagaaaactgtaatgcttagcacaccactaaacacgccgaggccattttaaggccgtagagatccctacgatcatggctagccatccacgaccaaaccgcaaaaatttacgccatttttggatcgacggccgtcaagtcccgtacgtcttcttttaccaccaccatttgatctgtttccttctcagacaccaaaggaacttgttttttgtatttttcttttcggtagctactttctacatctctcttatttggatcacgtattatcctttttcattccacgaccgacgaccaatgttccgacacctcgccgccctgatcctgtccgccgtcgtcttggcggcgtccacaagctccggcgtcgtcgatgcccgtcctgtccacaccggcccgtaccacgtcgtcatcagaaccgccgccaagcccagccgtcgcctgatcgggctcggcggcaatgccgcccatatgccaagaggtatagc

SEQ ID NO: 69301 - DNA, 8802 bp, Oryza sativa
ctactcaatagatgatgcaaataattagtactaatatcaggatttgtatgctatgattttctattagatactgtggaacttccacctaaagaaaggcaaatatcatgatgacgaattgacatacatgctaccttcttgatttcagtgagatttgtacgtatattaaaattgctggataactgactcgtaggctcgtaactaagcatgagagattcagaccaatccatagaaaaaagaggagattcagcacgtatcccttaaacaaagagagattcagaacatgacagtattttaagactacaacatgacaacttgctacaaacatgacagcactgcacatctgcatcgtttctgttttaaatttcaaaaagccaacacatagttgctttgaattaattaaccaccggcatttgcattgggtatctttttcaggtggttgtactgaaggtatcactgcactgcaaagcgtgcgcgggcaaagtgaagaagcacctcgccaagatggaaggtgagcctatctatctatctgctagtatctcggagcaaccaaacacagaaatcaagatctgacgctttctcttcagaaacactgaagataaattaaagatgcccattgtaatatgtatgcatgaacagagaaacccctagagtttttccgactagctctacaatgggatgggctagacgacctggattcgaagcctcaccctttataattactctctccgtcacataatataagatattttggttgaatgtgacacatcctattactccgaatctagatatagagtactaatatctgcgtcttttatatgtatgcatgaataggagtgacatctttcaacatagacttcgcggcgaagaaggtgacggtggtcggcgacgtgacgccgctgggggtgctgaacagcgtgtccaaggtgaagaacgcccagttctgggcggcgccgccggcgatagccgcctgatgagagatgaaaacgcataggatcctctctggttaattaggtgcggaagcatgtgggtcactgatgctggaccagctcgctctgctgtctgtgtgatggtggtggtggtgtctcctagatcgatgagagcatgcgtgtgtgtgcgcgtcgtcctgactgatcctgaagcaagcatgcagatgcagctttgcttcttactgtgatccttttggtttcttgtggttggcaccatgctgagctacatgcccgtcactgtgcttcttcttccgtagactgatgagagtgtttgtgactatatatctgctctaagtgtaagtggtggtgttgttcttttgcatgctcttactgtaatataaacgtttcactgcaagtctgcaatactgcattattgttgtgtcgtactgcaactgtaggtggtgatcgcgtaggttgaggtgggatcgagatcctctgccttcaaaacaccatacttttattcgttgaaaggtgaacctatgattcatcaagttcatatgtcagtgataaagacatgtacatttgaaggtagaggaacatgatccgttgtggtggtgagtaaacagcagcatcagcctaatttgcttgcaaggtcaataacattttttagatcaataacatgtagtagcagaactctcaaatggaaaataatgatttatccctagtacaataaaatgcttgtatgtgtactgctggaagaaactttgagccaaccgggagatgatgaacacatatgccgaagtaacagccttctgaactctgaagatcgatgccgtcggagaggactccaacggcacatctgacttgggagatgcggcccatttaaatgaggtctgaacgggatagtgacttgcatatagcccatttgagttggcccttaaacatgatagtggtaggagagtgttttcgcgaactgattttggatgagcctcaacgatcttgccactaaactgtgccaccctcaagctcccaacaaccgtagaattcaattcgctaatggatccttcgctccggcatatacaggcagtggtggtgacctccttaggccgcctcctgtcgtcggcgtgctgcccgcggctgcagacgaagctaagcctgaatgatgtaatggggttcacggagctaaagctcgacgcgggccgggagcccgggacgatgtagctgtgttgtcagggccggttctataattttgagggctctagggcaaacttgacagcatgagccttaacgcgctctcccctacagagagacgtgttatatacatactcacactttttagggttgttcagattgatgtcatttcaaaccataccaatttttagtaaaattgtcaaagatgtatattcatttagtttttttacaaaactttagtaaatatataagaaatcctgctaaaacttggcaatatgactaaattgtcaaaattttgacattgtcaaaatttggtaaaatttattttggttacaatctgaacaaccccttttatttttaaagtgtgttttcaaatctaatcatgaaagaaatgaacatatataacatttcatatatatgttgttagaaatagaaaaaaaaatcgacacttaaactgaccttatttatttttcccctttacttagcgaaaaaaagcttctagagtaaaattacaacttttcagtacctaaaaattttagaggaaatatatattatcaacaagaatctatctatacatacaattttgattgttgaatctacaatctttattaattcactaatcagtactccctccgttccaaatttatctacatatttcataggtacaccaagatcaataaaagctaatagctctctcatactatatttactctaacaacaaactcaatgcatataccatccccactatttcctagccaatagtaaatcaagatattgtatgtgggttataaatacttgtatgcatggatgcatgcatcaatgtccatttactctaatgcacaaataacgaatagaattaatgaataaacacaaatatgtagatcatttaggaagaataaatatgtagatactagtagataagccaggagtagtagatagtacggaattattcactagtcttaaataccactttagctcatacagtactcatacatatttaggcatggcccctagccaggacgggccctaggccatcgtcctctttgccctgcctcagagccgggcctgcagttgttgatagtatctttttctcatattttatttccatttcagaaacaggttacatgatttatcgtacaattttctgaactaaaatggcttttcatatcttcataactcctaatactagaataagttagatgagaaaatatcctgacaatcgtaggctggagtactcagttgtttgggctctcacggctaattgttggttttggcaagaatgtccacacgcatgcatcgtctaaggatggatgtgattagttaggtgcatgaggctggatgagtttggtttgtgggaaataagagttcgatgattggattcggcggatttaaccggatatagccattcacatgtggcctattctgattgcttatggtgggtttaattttctgttagcaagctcaaaatgttttttctcctaaaccttttttctaatttgtgatccattacaccattatatttattacaattatctttaaaataagatctcgtatggttatatttcgatgaatatatatatatatatatggtaaatggacacttaatcccatcatgctatagcacttcaaccaaacaagaaaccggaggcaaactgcagtgcaatttagtttgcttatcacttccacttgcgcccaaacttcttgtgcttgccgtacttgccatgcttgaactttcctttcttgaatttgccaccatggtggccgaacatcccgtggccgccaccgccgccgggtcgtaccatgtgagctcccaccgcagcagccgccaccgcggcgcctccggcgagcagcgctccatagccagatgcgcctgcaccatgcccacctcctaacataccaccacctattacaatatggaacttggaagtgggataaattcaattgcatatactcgctccgtctaaaaaaaactcaacctagaagagggatgtgatctctcctaggacaacgaatttggacaaataatagtccagattcgtaaggttgagtttttttgaatggaggaagtagtgctttgcatcattcaccaagttacatgatagttacacaggaaatgcaagagagagcataccttgcatgggtggaccatggccatgacctgggtaaccagctggcgggtagcctggttgttgtggatatcctgatggtggatacgctcctggagggtacccaccttgtgatggagggtaaccgcttggtggatattgtgcaccagggtacccaccggctggtgggtattgtcccggtggtgcactagggtatccaccgggagtcggatattgtccaggtgaattagggtatccttgcattaggggatatgcaccagggtaaccgcttggatacgctccatggaaccctttgtcggcatttgaggagtcatgattgtcctttctgcctcccatttttgtgacctttttagcacttgactgaaacatagggaaatcaagattacaccatgaccattttgtcgtgcaaaatatatataagatttgcagagacagagagtacctggatatcttaggtgaacatgcagatcataaacttctcaagaaggtggcaccaacagtgacctacctaagacttgaaaagaatttttgaacaagattcaagttgacctatggcttctcctctcatgccatgggcttgtatacatacacacatgaggtggacactaaagcaagcctcctaccaaaaccagattaccacgagctgctatgtttagaagtgctaagctatttgtttggtgtggttgtacatgaagataggaaaggcttcttcccggcccccgcacccttcggttctttgcatggtcatttgtaattttgggctaaataagctccataacacacagcaaaatataatcaataaatgtctaagaatatagctagcaaaatccgttgtagtctagctggttgggatactcggctctcacccgagagacccgggttcgagtcccggcaacggaagttttttttcctagcactttcatttttacacatagatgtacacagaaaattgcattgggaaggcacaacaactcataggaccaggaaattttgatgcgcagtcacaattcacaattgtataccgtcaggacacagttttgagctcccagtttttcccagggttactccagagagcgataatttatgaaactactagtgagcaacaagtcgataaacatcaaatgttcttcctactttaggttcagcaatatataggatatataaaaggataggtttcggcttagccatgcttcgagaggatgctctctgcgacgctacgagcgatgggatgatagaattcatgcgcctctgagaagatcctatgggcaagcatcttctcctccccggagcatcgagccagcgagctgtagagcgggcgaaggtacttcatcctccccacttgcttcaagcatttctcaacctcgttgaagtagcatctgcagccggtgggaattgcaagctggagaaacgcgactttgacctcgtagtcacagctttctgatagcttgtaccgctcatcgagagcagtgacctgtataaggaacaatgaatggccatggaagcagttaagttaaagacatacaaatgtgttacacaccaagctcccacagtataccatgtaataacaaaaatggcaaatactgaccaccaacagtgttgattgaaaactacaaatgatcggctaatagccctgaacaactcccaagcataaatagctacagatttcctttcaacatcttatagtcagtagacagctttcaactttcatttgtactccaaagatgacagccacaaatgatagcccatctttcattgtagatgctcaatcaggaaaagcagcgatgtgttactaattagtgattaactgattattgagtccaaagatgattttcatgtatgtcaccatctcttctgacaaggcccatggttatcatatgaacactgaaatattgggttgcaaagtacactgaaatgtactagggctgtaaatgcaatactgatctgtacctgcagataggagaatgtccaaactactgctagtctgccccacccttctatgatggcaaaaagtgtccaccatgtccatataatgtccccctccgaacaagtgatgtttgagctagagactgattgactatgcgataaatccattcaatccatttcaaatccaactaataagcagaacctggttctagtatcgttcatgagtgaagcataatgcacttaagattatgactgcacacttttgccactttgtacagtgtaatttacatctgattcagggtccactttcctcggtaaacaaaagtctccagatttaatttttttttgtggccagcatttcttaaaaagcatgactatgacatgtaggggaattcataatttgacaatggatacaccatcattggtctcaggccagatgcacctaaccaaacttcatgcaacagaactaagatcatataaagactggtaaattaaacatggattatatgtccgtagaagtattgcttaatactattggcctgatccatatatgtaatagtataataataatataaagacaaaatcacagcagaatgtaaggatagtccttattttacaaacacatggaagcagaaaacccaaccatctaaactgatcagcacgggtgatgcaacattctgctatgcttgagatttgtgattgggtgaaatagcaaattgcaacctacaaatcactggtgctgaactaaaccatcaaagggaacagagaaaattcaatgtataagtctacatgacaggcaaccaatttcagtttcagcttagctgatctagaaaccacaaaaccagaactaaacagtgggtaagtaaaaatatgcagtaagcttatacgaacatggaacaaatcaacaattatagactggaggtatgaaaaagaagtgtgagaactgagaatagacgagaattcatacctgtgaagcttcaacatctgtgggtaagttttccaagtaaagttcccattcctgtccactccagtctgctacctcatcttcacttggaagttttccagacttaaactctgcagctagggagcaaatctttttataaatagctgactctggttccatggcatccggagggataccagtcccctcgatccacagttgaaggtcaatttggttttctattccaggtacattggttttcaggaattcaaggaatgtctctgtgtctatcgacttgaacttaaatgtggatatgtaattcttcaggaattcatcaaatgcaggtcgaccaatctaacaggggaaaaagaatgaaacatcacgacaagtcatgaaaaactcattgattttgattaaagaacgttgcaaaacagttgaaacaaatagtcgcaattttgcactcacctgacgctcaatgcgccaaaggaattggaagcctttctcatagggaacttctgagtacacatcatcagggtcaatccctgccatctttggcttcagcttagtatactccatgttatctttaaacctctccatcattctgttcaaaccccgccatccaattcccatgtttaaggctgcccgctcctccccttgcaccacctcaacaatcctccgctccgcatatgttgtgaaaccctgtgcgcgaaaacaatagtatggttacatgacagcaagagagttttagttgaacgcgtgtgcctcatttctaacagttgggacaaagaggatgtcaaactattataaaacacttttagctgaatgaaattgcaagtgaggtaatctgatgtaactgaaagttatatcgcttaaggcattcaccctaagtaatagttggcattgtagcttggtgccttttttttttctaattgatgttttatactaatccttgagacctttgaccatgcaaagtgtacccccagggtttatgcacaggttaacaggtagtagtgacagagttcgttccaaatcatttgttctaccctattgttaaattggcatgtgaatgcaaagtacatagacacaatttcaaatttcaccggctttaacaatcatctaagtacctaaaagcacatctagacgacaactagaacaaatggagggttcatcacttcacctcatttagccagaaatcttcattggtcttgttagtgatcaggttgccagtccagctgtgcgcgagctcatgcgccaccacttgcgccccagcagcgtcccccttgatcaccgtgggcgtgaggaacaccattctagggttctccatgccaccgtaggggaaactgggcggcaacaccagcagatcaaacctctcccactcatacggcccaaacagcgactccccaaccttgaccatctcctcgacgccggcgaactccctcgccgcctcgtcgagaaccttgtcccctccctcggcatacacccgcgtcctcgggccgaggtccctgaacccgatcccgcctgcggcgaacgcgaagaggtagggcggcacggactgctccatctggaactcctccacgatgcggcccggcgcgcaccacagcgcgtcgtcgcaggcgccccggtggtcggagggcaaggggtcgcggcgggaaacgtggcgcgcggcggcgaccgcggaaaactgggtggggacgtt

SEQ ID NO: 69302 - DNA, 21408 bp, Oryza sativa
  unsure (1)..(21408): unsure at all n locations
ctctcccaggtacttaactcctctgacactgttgcattgtttgatctaacgattaaccggtgtttaagtgggaaattttctaaatacttcaggttccttctgggcttcttgacgagatgaacaggccgatcaacaagggaaagatgtacatatcaagcacgagccccctggccgtgccagtggcctacctgaggcagtttcagagagacttcagcctgttcctcaagtcgcgcgcggcggaggtcttctccggcggccggatggtcctcgccatgctcggcaggcaggccgacggctatatcgacaggcgtaccaccttcctctgggagctcctctcggagtcgttcgcctccctggtcgcacaggtgagcagatagcctgatactcatcagtattcagaactctgaactgataatctgaacctgacggcaatgcaatgggtgggtgcaggggctggtcgaggaggacaaggtggacgcgtacaacgtgccgttctacgcgccgtcgataggggagatcgaggaggaggtgaggcgggagggatcgttcaggatggactacgtgcagacgtacgagatcaacctgagcagcagcggcgacgcgaggagggacggcaggacggtgtcgatggcgatcagggccatccaggagtccatgctcagccaccacttcggcccggagatcgtcgacgcgctcttcgccaagtacaccgagctcgtcaccgcgtccatggagagggaggaggtgaagagcgtccagattggggtcgtcctcaccaggttgtgacacaaaccacaaagctgtgacgactgaccagagcgatttgtaccagtttatagtttgaccccatgtttctgaattctaatgtgtgaccatgtggtgtttagttgttgtattgagtaactgatgatattaacaaattccatgtgtacttaactggtaggatggaaagaaattaatggaaagtggattaacaagtgtgttgaaatgccataaatcgtccgctactcccctttatcatcagtaattcaatatccagcaatactactgattttgtggtttatagctagctacacattcatacgaacgctaataaagttttgcgacttttttttggtttcgtaaaaagaaaaaacatttttttctcgcaaattttttaacgctttttatactttccctcaaaattaatgtcacaaatgtgaaaacaactgaacatgaggccttgtaatgggctggcaagagcaaacaagggcaacaaatttcgaccatcgtgggatgagatgggcttaaggaggcattagggcttgttcagtttgttgctaaaatcaaccatactaaattttggcattgtcaaattttggccaaattttggtaaggcaataaactaaatgacactttaccatcacaaccttgccaatccctaccaacatttgggattctagaaacttctactcatataactatatcaaaaattgttgaggtgtcaaactaaaggcctgttcactttgatgccaaaaaaaaccctatcaaaatttgtcattaccaaaattttggtaactatgccaaaattttggcatgatttcttatatagttaccaaaatttggtagcaaactaaatgtagccacttttttagcaactttatcaaaatttggtaaggttgaaaatgacatcaaagtgaacaggccctaaactccatcttcacagcttgatctttgctaaaattttagcatcaccaaattttgccttttcaacaaatggtaaggtcttttttgcaatgaactgaacaaaccctttgtttttgtatgtgaggcccattaaggaataagtccatttatatccctcactttttgttgagttggaaatcttaacccctaacttacaaaaccgggttaaattaggtcctatagcagtattgagggctggtttcactggcatgacatactagtcagcgaaagaaagtcagtgaaaagaaaataaaaaaacatatagggcccacatgtaagtgagcttgcacctcttccccaactaccctctcttctcatccctcgacctcaacctctctctcccccaagagctcgccggtgaggagaggggcggtgggcggtggctggcgagagaggagcaagatggcggtggctcatatccttaccgacgagccctacgtgggaggttggaggaggagatggcgcagtggagaggggatggagcgagggggcgaccgccgtcaagggtggagctcggggagccgccatcggtgtggagagggtcactgcggctagaatatgtgtaacaaccctccctccagaaccgcgtagccagtccatccgacgggcgggcccacttacacataccactccacttatactttcgtcttcgttttgtgtaaaaaggttaacccgggagtgagatatggttggagggaagatgccttataagttggtttcacccttactaaactagcaaggtggtactaaacatgcacacacagctctcatgggtcatacatgcctcatcctaattgggccaggatgtcacaatatggctgacgctgtccttactcgcaaccgctgccgagggcgatggtggcagtgaacctgtggttgccgaagcaagagctgacgatcacatcatggcagtaggaggagcacaatcagtggactccatggtttcaccatgggcagggtgattgggaggcttcgggtggccttggcctctagctcgatcgtatcagtagtgagtgatgctttggcctcctgtttgggtggctttgctatagcgcctccctcatggccatcgtcgctgagatccatcaaggtatgagaatgggtcaccgcgccttccccatggcttggtgatcgcgttgcatcgtggagcacgaaatgaagcgctacgagagcggtgatccacaatgagtaagtgctctgtgtgttaggatagttgctcgcgcttcactggggaggcatggttgtgatgctgaagcaagcgtgccggtttaagaagctcgtgatcattgccaccacgattgttgccttgctctgaacctagcatggttgtcaccttctctctccacctacggtagctgcgtatcttgagctcgagctcgtgggggaggggcgcctcggccttcccctccctactctcgagtcggtcacggcctgcgcttgctcattccccgccgcccaccgccaagaggagatgtggagagatatgggaagagaggagagaagcatgttagaggaagaaggcaagagcctgacatgtgggtcccatgttgactgcagttaattcatcacgtcagtgaaaccggccatctatagtttcatactgccatgagacctaatttaaccaggttttgtaagttggggatcaagattttccgtattgcagttcataaatatgatttaaatccgtcagaaagatgcgtaaagtggacttattccccattaaacgtagctggtcgtatgcctatattgggcttcggactggtggaacaattctaggccgcgatggtgaggtagacatgcacggtgacatgaattcacctgacatccaagtgaataattgatattctcttcattctaaaattggtaatttataatattagaatatgtcatatttaattatagatggttatatttaggacaaaagtagtaactaatagttctgatgtgcctacgcatggtgcctcttgatggcctgaagcttgacgccatacttgaagtcacagatgatcgcgaactagaactcgagaggggactccatgctaggcgagtgccggaacacgtaatggcggtagaggtggatcattgacagtttgatctcctggatggagaacttctggccgatgcacacccttggtcctatcccgaacgggatgaacgcgtacgggtgcctcctcctctcctcctcgccattggggtcgaaccgttccggccggaatatttctggctccgggaagttcttaggatccttcgctagcactcctggtgccaaccacacccacgttccctgaaaaacaaatgcatttgtaatccattatattcctacatagactttgctctttaatgaatgaatcccactacagtgctatctactggtagtagaaaataatttgaatcattaattttatttgatcgaatggcttatatctatttatattaccacccaattaacaacagtataaacatggaggggtattattataaaaaaaataggtgagaaggggcataattgtcatttagcagtgattaaacctttttttttctttttttagcttttatcgatggaatataaacaatgccagtgcaattgatgaccatagatcaatctagtcaagcataaataacaaagttacctccaatcattatattagtaaatcattactaatttactattaataacgaaccgttgaaatcatttctacagatagtataatattattagtaggaagcaccggagcatctccttgatgtacttatatatagatcgttggatctagtacctttgggaggacatatcctccaatttcgacttgttcaagtgtttccctggctagcaatggcgacataatgtagaatctcatcgattccttcacaacctgcattcataaccaggtgaaaagtgcagtggttagaaaaaaaaaaattggtctcacgaacccatgaacacacaagaaaatatacgcaacacatacctgatcaaggtacgggaacttggtctgcagatcgtcggccatcggcacgcagtagcgggggccgaacgcgtcaatctccttgagcaacttctcctccacctccgggtgcttcgcgacgaggtagagcaccgtggagagggtgaacgccgtcgtggtcgacccggcgaggaggtgctcgtaggtgagcgcgctgatgtagtccggcgtgagcagctccctcgatgacttgttagactccctcgccgtgagcacgacggacaggaagtccttgcgctgctgcgacgccgcaagatcgtgctccattgccgcctccctctcggcgacgatgctgtccatatgtgttttcagcgcgcggttgacccggtcgatcttgtagtcccccatgccgggaatcctcttgagcacttgccggaacggctcttggaggaacggtaggagcataccgacgagtatggagagcgatccggacaggtccatcttgagagatgtggtcgcgtgcatgtgcatcttgatgaactccgacgatgccttagcctccacgctggtatcagcggcgatcttgtctatgttgctgtcgtcaggtgtgactggcagctttgacaggccgaagtccgtgccgaacgccgcgaggccgatcacgtcggtggcgaggctgagagagagatcggagaaggtgatctccttctggccgtcgaggttcttggacgcacgctgaatgcacgactccatggtggggatcaggctggccaggtgcgacggctggtagatggagatgatcatatttctcatcgacgtccacctcggtcccctgcggtgcagcagccatgatgttgtttcctttaatttaacccaaatcaattttttcgacacaactagcataatattcaatgaaattcggccaaattttatgggaaatagctagtctctgctgctagccagctagttgatacttgatattacctgggaaactctaaactatggaggagacaatcctttattgtttacatgttatctaaataattatgaaaaacttagaaaaaaatcaataagatagattaatatgtgataaatcactttacaaacatgcaagatcacatttaacttatacaagatgtaatgaaaaaataaatttaactgcgaatatacgttaactagaaagtttaatttgctttttctgctgcaactcgtagaaattgaattttaacttgcatgtgttgtgcaatgatctatcttcttaaatcttttcaattttttcataactatttggatgacatgtaaaccacggagtaatgtcccctcttagagtttagaatccactctcgatgctaccttatgaagaacaaccctttcttatggataggagaattggcaatgggggagggcatgcttcgatttggaatgctcttgaatttcttcacgcccacttccttgcacagctccgcatccgccacaatgatcagtggttgccttcccatgtgaaatctgcaagtaaattgaataattgtgctatgtgtatgaactttgatctaggttcacactgggtgtgttgttttaatctaggtttgcacagactagataagtttttcaccgaagagtactttgcaatttattacacatatttgcatccacatcataaatttatgcatcatgaatgtagtttactctaaattgaattccagttaactggttggtactgttatcctaagctatgctctccacgcaaaacaaattagaagaactgaatctgcgagcagaggaggcagtcacctgaagacaggaccgtgcttcctagcgagaacggagaacacatccggcccgtgcatggcgagcaggtggaggtggccgatgagcggcagaggcacgggacccggcacgtgccaaaccttccggtacggctcgtacaagtaggccaccaccaggagacccacagccatggccaccaaggtgaccgcccactccgccgttgcgcccagcacctcgctgatgtccatctcagcgatctcactctcaccctgccttgcctccctcttgccttgctatcatttatcgcactgttgacgttctgtgacaactgcgaagcatggttggttaagtaggcttgtgaaacggtccgttcccgcaggattcgatggagaggcatcgttttggttggattagtttgtcctgcttggctgatgtatttgttgttagtcactggttccgaccaaccaattttatttgagcgagatttctgagtctacgtgtgatgatggacgtgccggtcgaggaagaagtttgctaaaaacatgcttaattaaatatcgctgggccggaaaatgcataatcaaatgacgtgcagccagtgagtgcagtgtgacaaaaaaaataaataaataaggaaggtagctgccaaacgtgttgatgccttagatattactcttccatttcagattataagtttggtcaaagtcaaacaactttaaatttaattaagtttataaataaatatagtaatatttataatattaaattattttcattaaatcaataattgaatatattttcataataaatttgtaggttaaaaatgttaatatttttttctacaaacttagttaaatttgaagcagtttgacttgattgaccaaagttaaaacgtcttataacttgaaaaggaggtagtatttttttaaaaaaaataaactttatatgctaatggtggagcaggcgagattctactcagtaggtttcttgtcctcgtgtatataataaggtgtactaatcgacaatcaatatgatcgatgtaatactcttaacggatgtgccgctagctgattggtggatttattccgcaccaaattactgacacttgtccctttttctatttggtatgcagtaccatgcgactatgcgagtatgactatgagacgatacttggctaggctccgtgaagttcttatgggcctcaagaaaacaatcttagctgtttttcttaacccgttttaaaaatggtatgttaagtaaactaagatacataatgacacaatcctatataggcttacaattattgtatttcacgaagaaaaagtactgttgaaaaaaacaatttatgtatgtgaagatatatacagtgattaatatgaaacatggcgaaaaataatttaatagtgttacttccacatagtaaaggatgtcaatatcgcacataataattgttcacgtaagattaacaaatctataaaatataaagaaagaaacaaatcaatttaagggtaaaactttccatatctctaataagttcaaaagaccaccaaggctaaaaaaaatttaagaagaaagaacacaaaattaactttaatattttattaaaattaaattttgtttgtggcttataaaacaataaataggctatgatggtactaacaagttttcaacttccttagtccttaccaaagtcttgaatcctacaagttacttcaaggtatactgtcacaagtcgaattcctttgatcgtcgacgcgctcttcgccaagtacaccgagctcgtcaccgcgtccagattggggtcgtcctcaccatgttgtgaaacaaaccacaaagctgtgacgactgtccagagtgatttgtaccagtttatagtttgacccctgtttctgaattctaatgtgtggcgatgtggtgtttagttgttgtatcgagtaactgataatattaacaaattccatgtgtacttaactggtaggatggagagaaattaatggaaactggattaacaagtgcgttgaaatgccataaatcatccgctacttcctttcatcaccagtaattctgtatccagcaatactactgatttgtggtttatagctccacactcctacgaacgctaataaatgtttgcgatttttttttttggtttcataaaaaaacattttttctcaattttcttgaacgcctttatactttcccttcaaaatcaatgttcacaaatatgaaaacaactgaacaagaggccttgtaatgggctggcaagagcaaacaagggcaacctttcggccatcgtggaatgagatgggctgaaagaggccttagggcttgttcggcctgttgctaaaatcaaccataccaaattttagccaaattttgataagacaataaactaaatgacactttaccgtcacaaccttgtcaatccgtaccaacgtctggtaatctagaaacttctactcatagaattataccaaaaattagtaaggtgttagactaaacaccatcttcacatcttgatcttgctaaaattttagcattaccaaattttggttaaatggtaaggcttttttttggcaatgaacaagccctttgttccattttatatccgtcatcttttcgttgagtttaaattgtatgcttaatactgaaaatcttaacccctaacttacaaaaccaggttaaattaggtcccataatagtattgagaactgatttcactagcgtgacatactatttagcaaaaagaaaaaacatatagtgcccacatgtaagtgagcttgcacctctccccacctaccctctcttctcatccctccacctctcccctctctcttccccaagagctcaccaatgagaagaggggtgttgggcggcggctggtaggagaggagcaagatggtggcgactcatatcctcaccgacgagccctacatgggaggttgaaggaggagaccacgtggtggagaggggatggagcgagccggtgaccatcattaggggtagagctcggggagccaccgtcggtgtggagagggtcactatggtcagaatatgacggacgctatccttgcttgcatccgctgtcaaggccgatggtggctgtgaacccgtggtcgccaaagcaagagctcaatcgtccagattgtggcagtagaaggagcacaatcagtggactctacagttttgccatgggctgcggtgattgggaggcttcgggtggcctcggtctctggctcgatcggattggtgagtgatgcttcggcctcctgtttgggtggctcggccaccgcgcctctctcattgccatcgccgccgagatggatcaaagtaggggaatgtgtttgcgttgaggtgcacacgatgaggcgcaatgagagctgtgatccacaatgagtaactgctccgtgtgttgagacagttgctcacgctttaccaggaggatgacaggtgggtcccacatgtcagtgggtctcacaatacttttttttttgaatgacataagggtcccacatatttttttatttttgtttttattctaataccacgtaagcgtcacgtaggataaaaacttggtcaataccgccacgtcagccaaaaccaccttcaaaaccatcgagggacattgtttgcaccggtattgatagttggaggagtcgatatacccggttttgtggttggaggatatgaatcatactcaggcgatagttatgggagccaaagtatactttttccaaattttttacaagagaccccattaaacgtagctgggctatgtgcctgtgttggacttcggactggtagaacaatactagtaggagtaccattttagcagtggcgaagtgaaccgttgacagttcttttgttttgacacagtattaaatgcagacgcttagctcgaactgataaatatacagttctgctgatgatgtgcctatgcagtgtgcctcttgatgacccgaagcttgacgccgtacttgaagttgcaaacgatcgagtactgaaactcgagaggtgactccatgctgggcgagtgccgaaacacgtagttacggtacagatggatcactgacagtttgatctcctggatggagaacttctggccgatgcacgcccttggcccgatcccaaacggaatgaacgcgtatgggtgcctcctcttctcctcctcgccgttggggtcgaaccgctccggccggaatacctctggctccgggaagttcttgggatccttcgctaggactcctggtgccagccacacccatgttccctgaaaaaaacaagggtatactagtacggaaacaacgaagcagagtctgtctggaactctggattattggccggatctagtacctttggaagggcatatcctccaatttcaacctgttcgcacgtttcccttgctatcaatggcgataaaaagtagaatctcatcgattccttcacgacctgcatagtacgcacatgataagtgcaatgctcggtcagaaattcaggtcttactattcacgactccacaatcgaagaccataaatacgaccaatgtcgaagaagggcatgcatgcctgatcaaggtaggggaacttggtctgcaaatcctcggccgtcggcgcatggtcgtgtggtccgaacccgtcaatctccctgagcaacttctcctccacctccgggtgcttggagacgaggtagagcaccgtggagagagtgaacgccgtcgtggccgacccggcgaggaggtgctcgtaagtgagcgcgctgatgtagtccggcgtaagaagctcccgccaggatttgttcgactctctcgccgcgaggacgacggacaggaagtccttgcgctgctgcgcatgcggcgctgcctggtcgcgctccattgccgccgctctctcggcaacgattttgtccatctgtcccccgagcgcgaggttcacatggtcgatctcgtggtccgccgtccagggaatcctcttgagcacctgccggaacggctcttggaggaatggcaggagttggccgatgatgatggacagtgagccggacaggtccatcttgagagacgtggtcgcgtgcacgtgcatcctgatgaactccgatgatgccttggcctccgcgctggtatcagtggcgatcttgtcgatgtcgtcgtcattcgaagatgctgatatttttgacaggccaaagtccgttccgaacgccgcctggccgatgacatcggtggcgaagccgagagcgagatcggagaatgttatgtcctcttggccatcaaggttcttggacacgcactcaatgcacgactgcatggtggggatcaggctagccaggtgagacggctggtagatggagatgatcatgtttcgcaacgccgtccacctcgaacccctgcatgtgcagcactacagccatttttctacgtttgcaacggaaaaaagaaagtacaccaaatattaaataactttaaaatgacaatttttttcataacctagtgtaatatatgttttctttccgtgtagaagaactatatatatgctttttccacatatttataaattattttattacagtaataaaggaatatttgttcacatgtgtggcttagaaatcaacacattaattgaaacaaaaatatacaccgttgattatagtagatctagaaaaagttttgatacatgtttaaatataatgatgtagatttatcaaatatatgctctatctttataattagatttaatccaaatcatgatcccataccggctaacaaaacaaattgttttctttctaccaacacacatgggataaagctaggtctgggaacacgaacacaaaataaacgaaagattatttcagcaattatttaattagaaaatggaatcaaaatcctcacttttaggtttgggccgaatatgaaaaagtccagattctttcccttttgtctcttttttgtttctagcctgtttccctgtttcctttctccgttaaagtccagtttgcgttctcctagatcgcctaggaaaataagtctaattaatttaacttcctgtcgctacattagcttcttcaagctccagccgagccaccccaatcccgcatccgattcaactaaacccgtggagataatcttaaattagttgaaggcttttgatctatatctcatactctatcttttccctcaagaaattgaaggaaatcccatggaaaatcgctcccgtatcaagctcgaacttgagtttatcgaaccctagtttttatctttctggtgaactcgagtccgattcaaccaaattagcacattgacgggcaaaaatgcagacaaaaaagagatgatgaacggaaagttaacaatttgtaattagttaaaatatttatgaactgtaaaaaacggtcagcaaattttcatattgatgaatttaaatatttagtgccaactccaatgtggcactgacagaaattagaaaagtaaattttagaatcgataaatttattattattattattattattattattattattattattattattattattattattattattattattattattattattattattattattattattatatgttagctttgcaaaaaatgtatcagtatggatgggaaatttccataccattttcacccgtagctcgctctgtcccaaaatatagcaaccaggattggatgtgactcatgctactgatacaaatctggacagaggtaatataccgtgtcccatccaatcttggcttggtatattttgggacgagtgacttataatatgaaaaaagagagtatcagatagcaaatgtgagttcaaatactaggaatgataccaagttataaaccatatatgccaggctgtggagattgttcgatctggttaacgaaactagaggattttcctgtgcaatttgcacggagctagatttaaaaattgagttgaatttgtatacaactttgattctgtttctatacgggtcgatttatgctaccatatttaacattgtactttgtatacaattatatcaataaatctccaccgatgtattctagaccaacacaatttaacggttaacatatttctccttttgtccgattaaatgtggtaatttttaggcctccagagtaaacgcggtgaaactcattttagagctatcttaataataatatgctccccctgtctcaacatataactattttgagttccgaatctacataagtgcatgtcgagatctatagttaaaagttaatatattttaggacggatgtagtaatatataaatacatttatatttatgcaagaaagtaagagttatatatcaaatataattatacttttttatttaggtttgctgcaaagcagcagagaaaaaacactacttatattattaagcaaggatgaaaaggaagtatggaactatcatgtttctctctcgaggcctaaatagtaccatgttatttgaagaaaaatagaatcatatgcaccatcttgaaaaaggaaaagcacccgatgtgtagtgatggagttgtgaaaatttatggacatgcatgacatagaaataagggttgtatattatatatacttttacttttacttcatagaaaaatgcacgtgcattgcaactggtgaatgttattttaatcttattattgttatacggtttagctagggtaaaattcactgtaggaattcgcttgtttttctttagaaaatcatgagttgcaattagtagtccgacttttatctcaagttagcatacagagttttttaaaagagactttttatacgactctttatttctaaaagcaaacgagcttaaaatccaactctaacacggactgtatttccaaaagcgaacgatcttaaataccgactcaaacacggatgacgtatcaaaataccggcaaaaacatctttaatttttataatagtagatatttgtagtttatcaatgtactaaataaaataatagactcatgttttcacttatgtttatatttattcgaacaacttattagcaacttataaaacttttatacttgtatccttaatgattaaaaaaatattgtaataataaattacgatgaaaaaactatgtaaatacttaagtatttttgttaaataaacgatacacaattttgttaaatagtggttttgttaattttgtgaaataaactacaatgaaaaaactatgtaagttttagaaggagttattaattaaaataaatatttatgtagtgttacatatgtgatatccttatcttcatatttgaatataattctatatgatattaatatcataggagtaatattaatggtcaaaattatctattgaagactgtcaaaaacttgcgtcttatatattttttttggttgaagatatataaattgcagaaaaaaaaactccactctttacaggaaccaatctgagttgctacctaccttgtgaagcacaggcctttctgattaataagagaattggcaatggctgagggcatgcttcggttaggaatgctcttgaatttctttacgcccacttccttgcacagctcggcatccgccaccatgaccaatggttgtcttcccatgtgaaatctacgagcaaattaaactagatccagttaaccgggtagtagaccctggtattcccagttctgagctctgcgttcgagacagagaagcaccagtaagcagaggtgccagtcacctgaagacaggaccgtacttccttgcgagcacggtgaacacgtccggcccgtgcatggcgagcaggtggaggtggccgatgaacggcaggggcacggggcccggcacgtgccgcactttccagtatggctcgtacaagtagcccaacagcaggagccccacagccatggccaccaaggtgaccgcgtactccgccgttgagcccagcactgtgctgatgatctccatctcacccttgcgtctctgccttcccctctttgcctcactgtcgcagttcgtggtgtgccaagcgttgctggttaaataggcttgcgattttgtgaacagtccaacggagcagatggagaatcaatgaggcatccttgagagaggcatatggttttggctgtattagtttctccttaatgaagtaataaaacaagcataattaaatcgcgtgcaaccaattagtacatcgtgacaaattttttgttttcttcgggagggtagctgtcagatgctaatggtggttgtcctgacgtgttacgtgtatgcaccagatgaccagaaaccccatcgttgcatgagttcatcgccgtcagatggtgaaatgagtgcctgtgtcttcgttggcactcgtaaaatattgagccaacgacttcagagaatagaacggcgatggcccaccatcccacgaaaggtaccaaaaggtgctggactgcaaattcgaaattaacaattttcttaaacaaatgcataacgtagtacgatatttcgtattgagagagcataaaaattataaatgtacagttctaagagaatatagcgaaaaaaaaaacaccccataacagtggctaggggtggacgttcggtcagacagaaaaatttggtctcggtttttggtttttcggtcatttcggtctttgcaaactcaggatcgaatttcatccaaaaaatctcaggaccggcaaactcggtctcggtttcggtctgaccgaattatgcactagattcgaatcagaggagtagatcaaacaataagcataatacttacagtacatcgcaagaagccaaaatccacagatgtagccgctcgctgccttcccgtcgtccccgatggagacgaatgcggccggtaggatggaggcggaggcggcgccggcaatggaggcggagggcggaggcggcgcggaggctatcaggcggagccacggaggcggcgcgatggatgcccacggcggcggtggcgccggcgcgatggaggcggagggaggaggcggtgccggtgagctggaggcggagagtgggggtggcaccggcgcaatgcaggcggaggcggagtcgtgacgggctgacggcgtgatgcggcgaggattggataagattggaggcggcgcgggcgtgactccctccctgatgccctctagggttttgtttttaccgggcttattgggcctcgtaggtctattgggccacaatttggttaaccgaaagccaataaccgaattgcccggaaaaagtcggtcttttgatggctgagactgaattactaaaagtcggtctcggtcttttcgatttggttcttcggttcggtcttattctgcccacccctaacagtgacgtagctaggatttaaagtaaaggtggtccatcctattaactaacacatctctatctctactacttaaaaggttgaatatgtttccgtcgttcgtccgtgataaaataaagggcgaaaaaaaattgaatccgattatatgcgatgcaggaaaaaaaacgtccatcgacaatccaatttggttagcaaaatgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaataaatagaggacttatttaccttaacttaggttgcagctcaggcagcccgagaatacaaccgacgacacggacgaggcgaacaccaacaacaacagcggcagcagaaccaacggtctaacacccaacaccacaggcgacggctgggaaccaggacgaaaccctaatcttcacttcactttgtcttctcttcacggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttggggcgaaaagagacttgcgtctcgattcgactttaagagatgtttttcaacagctcatttagtaatgtaccgacctcccgggtcagatcattacttctcggctcccagagccatttcacttgattaatcggctcccagagtccagctgcccagcagcacaacaatccgcttccactcgggaagcctagtctatgatgcccgcagacatcccgaatcacacagattcgtttctgaccactcagttcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattagcatgcgaggtttccctgaacagactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagagcacaaataccgaggtaccacgagggtggagcgacaaggaatcagggtagtacgacctacggaaattagtgcgactactgggtaggtccgtcgatttggcacgcaaaccgaggccaagcaagttaagtgtgtgattctaataatgcaagttgcaaacaaaataataatgacttttcaattataggggcaatttgatcaaagggtgacttgccttgctcaaggtcttcacgaagcttcacgaatcttcgagaaaacccgcgatcgacgaaaatccgataaccgcaactatacgcaaaaaatcgaaaacctaaacaaaggaccaaaagaaggatcctatttagactaattagtagtgccattaaatagatctcaattttacggaattactggaagtataacggagtcaatcggagttacggatcgggagatatgaatttgaagtttatttggaatttctggaataagaggaatggtttatggaatttatagaaataatattctcaagaatattattgacagtcacagacacgcgggaccaaaggaaatgatttgtggaattttgggaataaggaattgatttatgaaaaagggaaaaggatttattaatcctttggataagaaaaggaaggagggatgggatttagacttctttgggcggctcgggtacggcccaagggataagcacggcgcggccgagccaatgggccgggcgcgggcgcgaggaggcggcccatggccgggcaaggcgcggcccaagcgggcggggcgcgcgggaggagagagggggatgggtccgggtggaccggatccatcgtgctgggtctcgggacaggcccacgagttagcgactcggcgcatgggggaagggttcatgcggcgcagggcgctagggttttgcggacgcggctcacggcgcggcgcgcgggtggaccaagaggtggagggcccacgcgcagccagttggcgcaccgtggaccgcgcgcgcgagggtgggggagggagaaggcggctgaccggctcggcgcggtcaaagccgaggtggcgccgacgtggtgccttcgtggctgccacgctggctggcggagggaagaagaaggaggccggccgagaggaggaagaagggggcgcggccgaatggacggcggacggcggccgagttcaccggagcaagcgtgacggatttggtcttcggggagcacaccggagtgacgagggcatcgagaaggagcgagccaacggctcggattcgccggaggaagttcgacggcggtggaattcgacagcggctgccggcggcgagagaaaggggaaatcaccgaggggcgacgaggactcaattaaaggcggcgggagcatctccggtgttcaaggaactcatttccggggtcggatgggtctgagcggcgccgtggaggtccggcgacgagaggcggcctccgggggtgggcggcaatggcggtggggccatgccgggtggcggcggtccttggggcggcgtctacgcgcgttcggcagggttaccgagctaccacgcaagctagaggggacgagggtgagcagggaaggggaactggagggaggcactaccgagccgggacggcgcggtgacgagcagccaacggcgcggaagcgagttctccgtcgtcgggccggggaaggggaagaagatgggcgcccagagtcccgcgtcacgcgtccacgcacgcaccggctcccccggtgctcggcgacggacgacggtggcgcgagcagggcggaggcgacattggcgcggtggcggcgagagcgaaaacgagagagattgggagatggggcgcctcgggttttatagaggtgggggatgtcggttttgggagggaggaaaccgacctcgtgggcggtcaaggaggggcggtcaaggaggacctggcggcagggcgcccgtggtccaggcagtggcaggcggtgacgccgatggtggtcgggcaaaaggaaaaaggaggggggagaaagggagctctgctccttgctgtttcgggaaaagttgaaggagggagagggagtgagagagaggctgcctctctcggctttggaagctagcggcgtggagcggcagcgcacgacgcaggcgacgctagggcttgacgtggcggcaaccgggcggctgcgcggcgcaggcgcggcagggttgacggcggcaatgaccggccggtcggcacgcgcgagcgcgggaaagagcgaagacggtggcgggttttgggcggcgacggcgggaatggtgccggtcggggaaaaagcaaaaggggagggaggaaaagggggccctgcccatgccatcagggagaaaggaggagggacagagggctctgcctcgggagttggacgcacgcggcttggagtggccgggcacgcgtcgcagggggggtgtcggaacccgaacggcgcaagncggcgcaggcgcggcaggccggcatggcggcctgcgtggcgcagcctgccagggctgacgcgggggcgaccaggcagtcggccacgcacgggcgagtgcgcgcgcgacgcagggagtgcggctggatttcgaaggcggcggcgagagttttggcgtcggggggagttcgtcgggagagagagagaaacagagagggagagagggagaagaaaggtgctgcctctctctcccggcgcatgcagcgcgcgtgcggggaggaggaggaccgcccgagagaagagaaccgggctgagaggagatgggccgaaggagggaatcggcccacaaaaatccgagggacgcaaaatagactttgacagagagattgaatttggagagaattggggcttggaaatggaatttggatatctttgaagtcgggcgaatatttggcaaggttttgagatttggaatttgaatttcgaatttgattacttggactcagggaaacagggaggagtcaccaacgggattcaaaaagggaatttgataattctaggacggggacaattatttggcggggatt

SEQ ID NO: 69303 - DNA, 598 bp, Oryza sativa
cccccattgtgaatccgcccctgctggtgagaatggcttctagttcattttccagattcggagaagctgcagttaatggaagctcccccaaataggctcttagaccatggctaaaaaatgcttgaatgttagacttggctaaaaatttcatgactattaaccttgggatatcatgaatatatgttaatcgttcacctgatattccgtgattataaacctttggcctaaatattcatgaatttcgaatttggtacagatcagccacaaggcctgaaaaagcgcctgcatagtattagtatattgtgtccagattttccacaaggcatagtctattgtggtactgttttatactccattggaagtgtgtgctgtattgcctgaagccttcgtcagtggaaagaaaagcccgttaacaacgcacattgaatagcccattaacagctcacctaaagaaatcgtttgctgatgaacggcccggagcgtaagaaaagtttccaaaattctaacagcccatccacagagagttactggcaagcgcagcccactaaaggcccagcaaaagaaatattccacgcacagacgacctcaggtcaaaatg

SEQ ID NO: 69304 - DNA, 545 bp, Oryza sativa
ataagcaccgatagaccgaacattgcatgcgctgttgcttcattttctttcgataatcatgagctcggtgttactctcagcttctcatggtggtgataatataggtcaagggaagaggcgcagcggtttagatcgccaaagcggactcattgccattgcgcttgcgttgctatggtcaccggtgaggaggacttgtttgtttctggtaccagtatcgaagggaaaaagaagctgcagctgttggatgatgatggacggataggattggagctaattccaccctctgcattagcttctccaatgcagaggatctggatccctacgagaacacctctgatcgatacggattggtacaaagtagtagtgtgcagcctgggcttgatcaccaagccaagtggtaattcggtggacagcactgcatgcacacttacgtctggagccagttcgtccaaatcaccggtcgtgctacccggtatagctcattttggtgccagcaatgcaggctttgacattgagctgaccataagagacttggggctgcagga

SEQ ID NO: 69305 - DNA, 555 bp, Oryza sativa
tgttgctcggtttgatgcgattggattaggttgacctggccaggaaggatcgatatgttttaatttgctgctgctccgcgtggcacagatcccgtgctatggtcgtgcatctttttagatgttcaggattatctgaagcaatcaagcaactgtaattaaaaaccacatgattcacatcgctggaggggccttgatttaaggcggccgatgtgatcaattcccatgttctgatgacagaaatcagtccaaaaaacagcaccgcgtagcaatcaaaagcaaaagtcgtcattccaatcagtgaacccagtcctgatgataagcatatcctccctggcctcatcgtgccagcgaagtgattgtgccctcgatcgcatcaatacaatcattcccagcccttaaaattccggctgatacaaatacagaatactctctccgtcctaaaatataaatatttttagctatatgtatccagattcatagctaaaaatacttacattttaagacggagtgagtagtacatatccaaactcatccgcaatagtagtaactgctact

SEQ ID NO: 69306 - DNA, 800 bp, Oryza sativa
aggacatgctttgcaaaagaaccggtttatgttgtgtactttcttctcactattaatttgtcgatgctctgggcacaaattattctatctctatcgcttgtgttagtcatgcatggttacgcttgcattgcgcggatttattttagagaaacaaatatgaggtcatactccactggatgcatggacattgacttttgcaccacattctctggtaattcaacactcacactgccacatcgatcgcctcctaatggtccattattcgcatgaggataatgcttacttcatcctatcaatggcctatcatatttgcaccataatcatattatgtcgatggagaagataaacttatcgctacattcttgatgcctcctaagcctagctacagtgttgagaacatctaagaaaaatattttgtagtttcagctgccggcagagagtggtgctcagcttgtggacttgtggctgatggcaaggttgaatttcagtgcgagctacagggaaagcttttgattcactcatgatggtttgttggctgatttcgaaggagcgtaaagcccgtatctttgagcagtgatcgcgcacagcaggttagctatttgagacatcagagaggttatcatagtatggaaggaggctagaacttttaggcaatgtgattagctgttagtctttttttttctttggggctgcagccaattgaattgttgcctgactcgacggcctaatgtcgaactcgtaaaccttgtaaccctctcttcttcttaataaaatttggttggccgaccaggggctgcagg

SEQ ID NO: 69307 - DNA, 5666 bp, Oryza sativa
catgaatcaacaacttcaggatagatttcggttgcatttatcacagcatgcctagctatgatgaatttctggttatgaaagacatggttaatgaattatatttgtcccaagataatgaccaatgtagttatatacgcggaggcatgaaatacacttctcagaaattctatgccctcaatttcagaacagtacgcggaggcatgaaatacacttctcataaattctatgccctcaatttcagaacagtcaaccaccacaacaccttatatggataaggaagagtaagtgtaacttaaaattgaaggtttttttatgactccttttgatggatagactgaaccccagcccatgtcatgttggatcataagaactttgctccaccagattgtgatttggcatgtgttttctgtagtcatcaagctctagagacactaatttttggttgttcttccaataccctttttcagttgcttgctggaatattgtggaaataataacttaggacacatccttaagtatggagaaattattgttggttgcgtggaacatttggaagctaaggccctgtttggttctatgggctaattattagccctcaccttttagccctgaattagccctcaaggatccaaacaggagggctaatttgaggttaaagtgaattagccctcctcaaaacattaacccctctatggggtgctaatggggataattttgtgtagggaccatcaaaaagcagctctttctcttcctctctcctctctttctactctctctccaccttttagccttgaattagccaatggatccaaacataccaccctagactaatatttagcctaacaatttatgactaaacattaattagtctcaaaattagccctgggctaatctttcaaacagtgcctaagtaatggttcgatcttcaatcataattcacctacgttgctttcttggacacaccttttcaagtgagacctcttgctgcttcttttcagacttaatgagagagattagaatgtagtacagagactgaattatactggcggtaattgttttttgtttttttcttattaacaagagttcttaacagcaagggagcccttgctgttttctgatcggctgttgatcaagaaatttcaactttgaactccaaatgtcaatgccaactacttttagagccagtgaatatactagatataaaactgtgcgataatctaattcggctcattgcaagtatgactaacacatactagaagaagcatttcaaattattcaggccggtatataaaaaccatccatctcttcccccatgagcccatcgggcaaacacttttcctgctaggccatagctcacatattcttccagtgtgattgtctatatctaccttgactttgacgagacgacaacgaacaccaatttgcagtaccatcctcttatcatttctctcttcaccatattacacaacactctggtctctgagtgtgtgtgagaatatcaattctagcacgcatcgtcagacagtactgtaccctcttcagaatcactagaacaactatatagcaatttgatacttgaatgtggtcatgctatgaagcctgtattcccattgcctcctaagcctactgcacttcatgcatgcacccagggaacaacttgggcaggaggactgcacaaaaattctaataggcttagagcaagaccaattagatgtgtagatgactgtgtgagcaatggcacatgccttatatgtagggcaaagcagaggaagaaaataaatggtttcaatagatgcaattgacacctctgtctattccatacacctagcgccgttttccactccgttccctagtgccaggatttattgccgccgtcactgcctgctaaactgtggcatcatgtagtgacaaattaatccactgccctacaatgggtgaattccttgttcctgttgcatcctaaacctactaggatttgcactagctagttaaccaactaaggcagaggtagatgaaatggaacaatagagaattaagagcaggatcgagagataagataagataagatgactgtacctaagcaatgtgagcagatgagcaaggtcatgatgattttatcattgccgaaacaaaaggaaggaaataaatagtttctatcattgccattaacaatgtcttttttgggggattacatgatttacgcttcggtatacaaatattagagcatacatagtgcatggatgcacagtagaggtaattatgtgaatctcatgaaaatcatgttgaaaattaaatctaccccgtgcaagaacacatggaacactccatgtgctacccatcaatataatggttgtgaggcgcagaagtaggagctccgggaggccgtcgaacactccatgccgctgccgctgactgacagggtagaggccatggcggcaaggctataggcttgtctgtgcaccgcgtcgccggatctggctccccttcgctagatacggcaaacccccctaatggatcaggcttcttaggcgagggacgccgactcccctgcaatggctccctgtgacagggaggcggtggcatgcggtgaaggggcaggcggtggaggtgccccacggcgatggtgtcacacgcgtgtggatgagagttgacgagttggctagtgaggcccgtcttgatggtagcgagtggtgccggaggcagcgagaagaaggatgcgtggaggtggccgatgatgccatgggtgggctgaggctgactgacgaggggcatccggcggggaacgaagggaggctagcacgacgcaggtggcgtcagtggttcaggaaggctgatgctggttgctccaggaggttggttcgggcgatggcagggaggccgccccggtcgatggcgcggagggccgacgaaagagaggtcggtgaggctatctggtggagggcgtcagtacagtggtgaccatgtaccgatagaggatggtaggtggtggagctttggagctttttcttcaggtcttcatggaccgagcgacatagtaaagcccagcttggtcttgccaggtcgacaacaatggtgttttaggcattgttttccatctttggggcattgtcgagccacccctcttcctcaggtgggctaccaggagaaaacctattgtcttggttctccttgagatctcgacggatggcgatgtcggtgttcatcatcgtttttctcactggagatgtcgtcaaggaagcctcactgcgaaaacctctctcgggggctaggccaaaccctttgcccccgcgtcactcccagggtaggggcgacacgggaggcgacccagccgccaccaccgcaccacccccaccgccctccttccacctcgccgctgcccgagcgggccgccggaaaccacgcggccgcaaggacggcggcggtggggccttctccccccccaaggtcacagtgttcggagcccacgaccccgacctagctctggggcagcgacttcggcggctgcgacgtcgagctcgacggttgcgcatggcgtcggcgaggtggcggtgccgacgacggttgaagaggtgggcggccgggccgacgacgacgaggcggcggtgttggctcctatgctctcctgcgtggatctagtgcggggggatggatcctgagttgccggcggcggtgatgagcgtggaggcggcggggtggccggatccggccccctcttgtctggatccggcacgggaggccgagctccgaccccaggcagcgaggcgaagggggcgcgcagcgctgggcggcagtggctgaaggcggcggggacggagctggccgagggcgctgaggcggcggcggttgtcccgtggctgtgacggcgcggtgcctggcggcggcgttggcggtgctccacagatccgcgcctctcgaccggatcttgagggtggcggcagttggtgacagcggtggtggtgtggcgacggtggtggcggcagttggccggcagcagttggcaccggcggtctcggccggatctggacgccggcagcagttggcgatgacagccgtggtgtggtgatggcggcagcggcgacagttggcaacggcggcggcggtcctggctgtggtggctgccgtgtcaactggcggcggtggcgaaagacatggcgtcgggcagctagctgctcggtggtgaaggacgacggcgcagcggcagtttgcggaggcagcggcgacggcggcagcggcgacggcggctgcgactctgaggtggtggctacgtcggcggcagggaaggagtcgggtgcgaggtgaggatgacgacggcgaggtggttgggtgttaggcagcggcggctgtggtggtggtgaccatgtttgcggtcaccggaggcatggcggcctcggttgactagccgaggacgtgggagacagctgcatctggccggcgcggcatcgttcggtggaggggtcggagaccagcttggcgcagagaagcgcagccgatggcagcagaggccggctcggcgcgagaggcgcgggcggtagagatggaggccggcttggcacgagaggcgcggccgatggagggaggccggattggcgcgagaggcgcgtccggtgaaggaggccggcttggtgcagagaggcgcggccggcggtggaggaggcgatctaggtgtgaggaggtgctgtcggtgagtgtggcgcggtcttcggcgcactaaggctgttcggcgggggacgtcggtgcaggggtctcacatgtcggcaaagcttgtgtggtggtggagcatcggtgcatcagccgtggtttcgggatctcatctgtgcccctttgttggcctattagcggtcggtcacgcttagcggcggccgagccggtgctagccttctcctgggcgtgtgtgttggcgatgtcggcatgtgggtggtggtatattttttcctttttctagttacgactctctaaggttgtaatcttataatttttttcccgctctatcaatagaacttcgcaccgtctagtgcgagtcgttcaaaaaaaacctctctcagaaacctagtgtgtgctctctgctggcatatgtcctcttgtgatggcgacatagtcaaatgcaagctggccatgttggtgagccttgtaggggagagtggttccatcttctctctcatcttctcccctaaaacctcaagggcgtggatagagttgagcacagtgcccattgttagggtttggctttggtgcccgggtgttgtttctttgttggcctagcagcgactggtcatgcttagcggtggctggtccgatgctagccttcccctagatcctgtataggtgatgtcgatgcgtagtgtgtggtggtggtggttcttttcctttccttgctaccgccttccagggtgctagccttgtaattttttcctgttctattcaatgaatcatcgcaccgtctggtgttgttagttctaaaaaacattatttctgatgacttgtagctagagtagctgtaagggaatgaatgagacatatttgaagcgcttctgaattaacaaaattctgaaatgcctctacagggaggtcattggtttcaggttttgtccccaatttcagagttttgtctacctctttagcttcttggaaaaatggttgcagcacgttctgcctggagtttgtcgcag

SEQ ID NO: 69308 - DNA, 1126 bp, Oryza sativa
acagttagaacttagacgccacagcttacctagttacctgctgtggcttgcttgttcatccggattgctcttgggattaatcggtggggggaactggcaacactctcttgtctccgaccaataaaggaatcggacctcgcagtttcgtgcaggtggatgcctgcatattttttgggagaggtcggcggccaaatgggccagagggccagaccgacctggcatgcagcaacgcgctgcgctgcgctgcactgccctgcactgcagtgcactagcagttggggtatgcgtcagatcggatgcatcatccccttccattccgcttccattccgcacagcgagcacgagatgcctggccgcaatgccgccttgtccgctcgcttttgcatcgtacgttcacggttcattccctcttgcggtctcgtgcccccccaacatacaaggtggtggtggcctggtgggcctcctcgtcgtcggagagcgcagcacgccgcgcccgcgcgcgcgtgcgtcccagcgccgctcgaactggcaaaaactcgtcacgcatcccgcctcgccgccaaaccggcgggcggcacgcgcgcctgctcggtatgattgatgcgcggtcgcgaacgcacaggagccagacgagagacaacaacagaagctaaaagctcgccgacgaacgcgaacccggtcgagccggacgccgggtttgattcggcgagcgcgcgactgcatgagccgatctcgggttggccccaaaccacacccgtcggtgcggcacaacgtcgtagatcctgcctgcctgcacgttgcaaacgcgttgaagggaggcagggagctgcgtttttcaaggcggcttgtgcaatgtgcacatgaaccgaactaccgaacgtctggagatctgcgagagagagagagagagagacagaggggctcgatcgctttgctgcgacgccgaactcgacgttcgattcaatggtccacggcccaagtcaacacataccagcaatgcgagcaagtcaaatgtttggtacggactacacttgaggtactactagtaattgagtagcctcaccaccctatgattacattaactgggcatgattacaataacccgttcttccagagctccgattcg

SEQ ID NO: 69309 - DNA, 16534 bp, Oryza sativa
ttgaaggagagaagccgatgcatgaatcttggcataggtccaatggtctaaaaatctgtaagattccattcccaaattttattcgaatgacatatagcaattctggatcacgttcgttttattgtatgttcttattattttccctgatacagtttagtagaagtatatatatagtagtaggttcatatgcatgaaatcatgggcagaagacgactcggtagttgctgttgccgttgcaggagcgcagcttggaatcgtcggaggggtactggtacgcgtccgggcagctcctctccctgcacgtcagcgtcacgccggagctgcaggagaagctcatggcgacgttgtacccgtcgatcaccgacaggttgtagaagtcccggttgccgccggacgtccccagcgtgaactccgccagcgtcagcggcggctgcccggacagcctgcacgacagcgcgccgccgcagtcgccggtggcgcacctgccgcggccggcgccgtcgaagctgcacccggtccggccccacaccctgccggagctggtcccggcgggcacgttgatggtccacgtctgccccgggttcagctgcgtgccgccgcccaccggcgtcgccgccggccacaccgtgaacgagcaacggttggtgatggtgaaggtcgccgcgttggcgccgccggcggcgaggctcgccaccaggaccacgacgaggagcactgcggaagaggcggccggagctgacgccattgttgcttgctttcttctaatctttgtgttaatttgtatagcttgttaattaagagagctaggaatcgatcatgcgtatttatagatgggcatggtgttgaaaaatctacgattttgtctgaatattgtactgtgttgcaaaatctagatgtggagagaaacttcaaacaagcacgactgatcgagtcgccgatcgatctatttattttatttttgcacaagaaagatgaactacatctccagcacacgtactagctaccattattgccataattaaatctcattggctgagattttgccatgcaatatgcttggatatccaatattgttgaatcatacaaacacgtacaactcaagtcatcagttatatgtttgctgaattttcagatcgatcgggtgcttgaaagatgaaagtcaatgcttatatgcgtgattctcgccggcagaactactgatgtgagggttaaaaatattgaatagctctacaaatgctgtagagaaatcaattttatcaggcctgcagttgattgatgaataattctaaatgcatgcatgtaatatatttatcatttatttgatttaattagctcctgcatctgctatatattggactctacaacttagtaaaagttatgtggctttttacaaaatcgcatctaaatttcatgagctttttagagcaaaatatttgctccggttttacgtataaccacaaaggtacgatgaagacaacaaattcatgcatactgcatgccgtaacctagagttatggttatacagactttcgctaactatgaatgaatatttacaaatatatagacttcaataattgttgggtttatatcttgtgttggtggtactttagtcatgcgtgcatcgttgtttctgttttgttctctgaggatagtttgtgccctttgttgagcgaattttttaaattaaaaattggctgtagctactttttagcaaaggccgggatttattccattattaaaaaaacttaattagttttgttatttgtcagtatatatattgttggtcaccacacatattatttttctttttttagtcaataacctatacgtaccttggaacaactcaagtagcacgtacttctgcatgcgaagagatagtagtaagctactagtacgtacaagcgtacaacaaaaatatgagttaaccttatttaattagctttgacgctgattattattttttcttttatattgtcagggacccaaaagttaatttttattttaagttaaatcacttatttttcacattgattaagatcaattaataattaaccatgcatgtataagccgtacattctgagctagcagctagttgtaactaaaaaaaatatgtacgagaaagaatttattttactgtagaaattagagaaggttggtcaatagtgtatatatggcggcgttgtgcatgagaaaatttcaattctgtagaatatatttatgggctcggcctaacagctggcagattatttttttccaacacgcaaaagattttatgtgttatatattaacatctagctgactgagaacggcaccatctctaatgcatatcgtcaagtacaataatgtgtatgcgatcgatcgatatgatctctcatctttatgcatacatgtgttgacgtcaaatatttttagttccagcaatatgatctgtccatattgtatatggttttgtttggatgatgtaggggatcggttgatatgagaatacaaacaggtaatagctctatctccattgaccggagtcaaggtagccattatatatcaatatctaacaagtacaatagtgaggaaaacttaatctagtctactaggctatcagtgttgtttacacccaaatttaacacctaggatcgaaataggaaaaattgccaaagtttgaagttatgccggtttcctccagagtgggctggttagaccgccggttgagggccggtcagaccggcggtgtgtggccggtcagaccggcagagtctgagtccgggtctgtttttgttggacctcgagttttcttactcgggaagacatgtttcgggtttcctttagattctatcccgagttggacgtagaggagggcctgtagagggcaagaccaacccctatataagggggtaaggccggctcattgtaacaactaatctacaatcaatcaatcgaatcgttattttacttttgcttctaattctagtttagtttatccatctttgtcgatttgcgccttaaatcgtctgccgccgctacgagagtgcgacacctttttgtaggtttgtcctaaaaaccttctgttttgcccacgagacgggtagttatttagaatcggctccgctagccggtttagttaccaaaacccatcttggtttagcttttgctagatttaggtggttggcaactctaggatcactgcaaggcgtttaggtgctgcgatcatgcttatcaacttgtcacaaaaagttgctaacaagtgtaaagctcgagcatatggtcgaaggatagctattgtctgcttcctcgagaagtaactcagcgagaatgaaggtagctctaggttccttttgacttctagcgggcttgggttgtcttgtcccctcttcttctacaagatcttgtatgtatacctctttgccctttgtccaagtatatattaactagggatgcgtcgtcgaacttagtacaatgtataaggtaacccatatatatttataactctaacatagacacacatatataattagtaatatatattggttcctacaggtgggtggattgaggataaactattggttcctacaggtttcgcacacacgaaaggagcacttacaatgttgggatggctagaactagccatccaatggtattaagataggagaacccaaatattttttttcaacccttcatttaatctaggtgaaatataagcaggttgagaggtcgaaactgggtctgctgggtgaaagcaatcaacccataccaaccgagttaggcacggttctcaaaggagcgcttactgtgagagaggtagggaagaaggacgattgtgcttttaagtactagagaaattcctccattctaaatagtgtttaattacaaattgtctgtcatccctgtctgaatttggggaagctggattcaaattcatacgtgtgaatatacctaggacctagttcaaatttgaaataaaacgcttcactgatgagaacatgattaatttgcaagagggaaatacagtacatacgcgtatatggatctgcaaaattagatagaaatgaaaagcccagcccacaaaggaagcgagatcacaatttctgggccgtcccagaaaggcaagtgtatcggccgataaacgaggcccatcaatcaatctgaccaattcagtcaagtcccaattcccaaataaattttcattcgacagtgtgatacgtataggagtatagaagatcgaatacatgaccgtatatatatactcctacgtaggaaccaagcgtatacgtacatgcatggccttcttccaaatgcagcaaccgtacgtggaaaatcgtctagtcgtggaaaccatggccgtcgatcgtccctcctcctataaataccttagccatggcgccacccattgccacattgcaagcagcagctagctagcagaagaagcaaccatggccaatactcgcgtcttcgtcctcctcctcctcgccgtcgccgtcgccgtcgtctacagcgccgacgcggcgaccatcacggtggtgaaccgctgccgctacacggtgtggccgggcgcgctgcccggcggcggcgtgcggctcgacccaggcaagtcgtggacgctcaacgtcgccgccggcaccaaggccgccaggatctggccccgcaccggctgcgacttcgacggcgccggccgcggccgctgcctcaccggcgactgccgcaacgcgctctcctgcgccgtctccggcgcgccgccgaccacgctggccgagtacacgctcggcaccccgggcgccgccggcggcgacgccaccgactacttcgacctgtcactgatcgacgggttcaacgtgccgatgagcttccagccgacgagcaacgcggcgcggtgcggcgcccggcggcgcgggccgagctgcggcgtggacatcacggcgcagtgcctccccgagctgaaggtggccggaggctgcgacagcgcgtgcggcaagttcggcggcgacgcctactgctgccgggggaagtacgagcacgagtgcccgccgacgaaatactccaagttcttcaaggacaagtgccccgacgcgtacagctacgccaaggatgatcggagcagcactttcacctgccctgccggaacaaattaccagatcgtcatgtgcccttaattaataattaagctaatataagatgtgataataaggggtagtgatcttgtgtgttgatcactaccattaccatgcatgcgtgcatgcgtacgtgttgttcaatatataataaatgaataaaaactcttatcttcaattctgatgaaaaaaaaaaagtgagtcgggttgccattagaaaaccagctccatgcatgcatgcctgcgtcgtactacgtccatatttatgtacgacgccgttaacttttttgtctaatatttgaccattcgtcttattcaaaatatttatgtaattattatttattttattatcatttattttattatgacttgattcgtcatcaaatgttctttaagtatggcataaatatttttatatttgcacaaaaattttgaataaaacgaatggtcaagcgttggtcgaaaagtcaacggcgtcatacattaaaatacaaagagagtatttgttttctgcgaagaaatcacaccaaaatatgtttctatgattttcttgggtgatgtggactttgaagctcccttttcttgcttgcaatatatataggagttgatgatgatatatcatcatatatgggattacctatagtataccatttgatagaaaattccttcacaatattttaatgtaattatattgtaattgaaatataactatcatggtgaaagggcctgacggagctcgtggcccctcaccgggagactgcgcaagcccccctttgccggttcgaccaggggcttagggtgcaatcccaagctctctctctctccctccgtgcccccggctggtggtgttggctgtagagcctttgtggcgagtcttcggaatgtccgttggccctcgtggcccctcaccgggagactgcgcaagcccccctttgccggttcgaccaggggcttagggtgcaatcccaagctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctccgccttccaaaagggccatatatttattctaaatatttagtctgagcgcttatattatttacggattgcgtctgcttaggtagggggcacagaagccgagtgcgccctctggtcatgatactcccggtcccatatcaccgacagtagcccccggcgttatgccagagcaatttcccttccccagggaagcggtcaggtgtgacgccacctctaaagcctggtgacaggtgggaccggtttccgtagttgggcaaaatacccaacggtctcaaatcacgcacattggtaatggtgactttgctgtccataatgggcggtctcttcaagactgccatatcacttgagcggcgtacgaatctgggtgagccgatttgcttcgcctggagatatggtgatggcgcttttttcggagccatcagaatagcgtatagcatcttctgggcctgagggtatcgggttttggcgtcccggagggcctcgctaacaaagtagacgggccgctgcacctttcggcggggccgatcctcttcgctagaggccgcatctccagggcgctcttcatccgagaggcagcgcggggcgcactcggcttctgtgccgacgacctcggggttagagggcgacaggcgcggccttcccgcagtggcctcggggccatcctgggggtcgggggcgcctggcaccgtcgggcaagcaagcggagggccagctccggccgtcgggggccttgggccgccgttcggctcgggggcctctcctccctgctctctcttcgggcagaatcctcggctcgcgttcgccctcaactccgacgaggaggacgatgacggcggagtgggcgacagtggcgacgaggccggcgacccgggtgcatcggagtgagcccccaggcctccgccaatcttaatagcttttccttcttcttccgaggccttcgggcccccttcttgttatagactgatttaatctgcaatcaaataaagaggaaatttttgtgtcaatttcatttgttctgtgtatgagacgaggatgtctgtgccgcgatccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagcccccgagggtaggattgagcacgagtgacctatttcaagtcaagattcttcaaaaggaaacaaaagcacagacacagcctttaggaaatcgaaaaatgcttttattgaaatacggaagagaaaaaagataagcccccggccaaccctgcacgcccggggggggtgcggagttggcccgagcccaagacctgacacccgacccccactaggggtagaagcgacgaaggtgttcgatgttccacgggttaggcagctctgtgccgtcgcccgtggccagccgtatggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcagggagcgccggcctccttctttttgtcgctcgcaggcctcccctttcgggtggccagcgaagcgccttcgacagcgaggacatgaccctcgtcgtcggaatgggctgacctcttcttcctcctcctgtcacgccgccctgtctgagcggcggatccgggggcggccgaagctgccactccggaaccggaggggttccaggtccaggcctcctccttgcgagccactcggtccgcgagctgaaaaagctctgcggtagtctggggctctttggaggcgatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgaaggagtggtagccgaatggcgtgcagcagccgccgctcgccgcgccctccgccttgatgacacagagccggaggtggcggcgccgaaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccactcacactcggagagaggtcgtgcgcctttgcttgctcggccattaggctgaacaagggaatcttggcgcacacggaagagtatgagagctcagaaaacacacgctgagccccctacctggcgcgccagatgacggagctcgtggcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctcagccttccaaaagggaaaagtcccctctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgtcgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacatgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagggcctatagcgtagtggttacaagagcctcagtagtatcttaggtcagggttccactccctatggaagcaaattttataggatttaacggctttatgctttcagtggtagacgacgtacccatcaacagcgaggcgcaatctccaagatggatttgctggctcagtcttcaaagacactcacagggtgagtgtctgcgttgtactatgtaattctaagaataaagaaaatatagacatgatggtggccgtacatgctaagctaagttacttcctccgtcccctaatatgataaagtaagtcacaaataaaataaataataattttaatttttttaataagatgagtgatcaaacaaaatgttaaaatttcttgtattatgttggggtgcatgcgcttgactcatgcgtagtacgtacgtgtgtgttaagttgtccggaagagagaggagaattccaacgtttttctccacctacacgtactaaagcttcttccagtatctagacgatcgatggaattcataccatatgcgaccgacgatccatgcataactctacaactcgacacgtacgtacgccttccaaattttcggcgaaatgcacaactacaactcgacacgtacgcacgccttccaaattttcggcgaaatgcaccagctatagctagctagctgcttggccggtccttatttttcttggtgttgtagaagataagggagaccagttgaaaatttgtaagccgaactaactaacgtgtactctccctctataccccaaaaaaataattcctaaagataaatctagataaggagttcagtgcactggtggagaaaccatctttcgtcggtcggccgatttccacaatagtcccggatgcaataaaaaccggggctaaagatgatctttagtcccggttcaaaagggtaacgggcatatttgatctttagtaccggtttgtgttaccaaccggaaagctgtcagggcctgtcaggcccctccgggatctttagtcccgattggtaacaccaaccgggactaaagatcgtaacttaccaaccgggactaaagatcccggtgatctttagccccggttggtgctaccaaccgggactaaagtcccacccctatatatatgtcttcttcctcctccagctgcccgagtaagcttcaaaatttcttcaaaaaagaggggaggtcatgccaaaatttctattgaatttattttggtgattaattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatctgaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgaacttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgtaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagatgcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccccctggctatgcatgaagaggaagtacataatgatgccgattattattcaaggccccaagcaacctggtaacgacatcgacgtgtacctaagaccactggtagaagatcttaaacagttgtggacgaagtaaggtgtccccgtgtgggacgaggacaaacaggaggagtttaacctacgagcgctgctgttcgtaaccatcaacgattggcctgcacttagcaacctatccggacaatccaacaaggggtacaaggcttgcactcactgtatggatgaaacagaaagtacgtatcttaagcactgtaggaaggttgtatacatgggtcatcgtcgattccttgcagcaaaccacccggtacagaagaaaggcaagcacttcgaacataaggccgaccaccgtatgaagcctaaacatcgcagcgggaaaacagtgtttgctatggttaaatatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatattaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttcaaccttcattttttaatataatgacgcatttgctatgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcgggctacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacaagagcccaagacatgaagagcacgaaccaaaacagcgctgttcgtgtcgatgccatgggacacgatggaacaactgccacgtattacggtgccatcgaggacatatgggaacttgactacggtcctctcaaggttcctctgttccggtgccaatgggttaggttgactggtggaggcataatgattgatgacagtgggatgacaactgttgaacttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgcattgattatccatataaatcaattgatgtatggcatatgttaattacgcacgattattagaggtttcaacaaatttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactatctttcatatgctacttatatatgactattcgaatttttaaaacgtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtgagaacaaccgggac

SEQ ID NO: 69310 - DNA, 5948 bp, Oryza sativa
tcaacaaccgggactaaagatatctttagtcccggttgttgagaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgccgccgccttcgccgccgccgcatgccaacgccacgccgccgccgccttcgccgccgcatatgcaatgccgccgccgccacgccacgccgccgccacggccccgcaacgccacgccgccgccgccgtcgccacgccgccgccgccgccgccacgccgccgcgcccaccgccgccccgatgccgccacaccgcccgttaacgaacgagaacgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaaggaacgtgaacgagctagggaacgtgaacgagcgaacgaacgaggacgaacgttaacgtgaaatgcaatatatatatatatatatatatatatatatatatatatatatgttacttcgcatttatcctaatacatatttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggtgcgacaagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatagggttgtataatatacgtcacctagacttagcttatatcacgatttataattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatagaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgtcaagaagaagtaccatcaccacttggggtcaggaggctatagcgtcgcgatgccgaagtgggagcagatggaggctagcttgattgagaggggtatcgaaccggcaacagccaattggccgaaacgatcgaagttctggtactatgctcacggtggaacgctcaacccagctgatggctcactggtcttcggcgatcagatatgagaggctgcgtgatgactaacagatgcagtggaagcctcctctcagggcacgttccgagcagacaaagatagggacgagctgacactcgccctgcagactccagagcatccaggacgaacacgagggaaaggggtgattccttggaagattgatttcaaggaggacatccacacgtataggagtcggatgaggagcaagagagataccgaggcgaagattgcagacctagagtttcgggtatcgagctacgaactcaacatgcaagaggaggtggcaaggaaggttgatgaacgcatggccgcacatcggtcccatgatccccagccgaccattcctcctacaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtatttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctgaggatcctgcaccgactcctcctcgtgctcttacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcacatgccaaggaggccattaagctatcggactatgagcgaacgctgaagaaagcatcttctggaaagtccaaaccagtccctcagcttggagagcaaccaaaccaggagatcgagccgttggtggccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacaaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacacgaaacagaggacaatctcgtccatctcctgaaggtgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcttgcaccatcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttgatacattcatatagtttattcgcatgagggataacctgaccacacacaaggaatttatcacggcggttcaagaacaactcatgggattcatcaacgaagaaatccttgatcccaagggtgaattctactacgacagaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatataatataatatatatatatatatatatatatatatatatatatatatatatatatatatatatatacatatatatatatatatatatatatatacatatatatatgtatgcatatatatgtattgaaacatatatatgcatggtttatatatatatatatatatatatatatatatatatatatatatatatatatataaacc

SEQ ID NO: 69311 - DNA, 9235 bp, Oryza sativa
ataagagtagcaactagtatcaattaaggccgagtttagtttcaaactttttcttcaaacttccagtttttctatcacatcaaaacttttctacggctgtgtttagttcagcgcaaagtttagattttggttaaaattgaagatgatgtgactgaaaagttgtgtgtgtatgacaggttgatgtgatggaaaaggattgaagtttggatccaaactttggatctaaacacagcctacacacataaactttcaacttttccgtcacatcattccaatttcaatcaaacttttaattttagcgtgaactaaacacaccctaagatagtagagatggattctgatctagctttagttatcctagctcagcgaatccaaagataaaacagaaacagggaaaaggtaaagaaaatctaaaaatttgtgtgtacgtgtgtttttgtctgatgtgtgtcctgctttggccaagaggaaacacgcggctcacaatcatccaaatgttaagatcgatacacaaacaaaattaaaataagcagaaaaatgtatgcacatcaggagctcgtgaattgattgatcaataaatcaactaaaagatgaaagtacagacagttgtaaaaaatgacaggaggacaatgacatctatcactccaaaaatcattcaaacctgacatatacattgagaagaaaaaagaacagcatacaaatagtatcgacctaagatttttgtgaattgctatatgaatgctgtcaaacttttaaatactttttataactatttcgaacaacaggaacgtctcctaaagaatcaaaacagtttccccctaaaaacacgaggatatatactccctccgtttcacaatgtaagtcattctagcatttcccacattaacatcaatatggatatgggaaatgctagaatgacctataaattgtgaaacggaggaagtaacaactagttgtggcatacgttccttgtcttctcacgtactcccttcgtccaaaaaaacccaacctagtattaaatgggacattttctagtataacgaatcgggacaagcttctgtccagatttattttattagaaagcattccattcaatcttagattggttttttttaaggagggagtactcgcgagtgtgtccgctagcaatcaccatcaccactgcactaaaggcggcatacacatcacatctaaacacatcaataatttaattttattattccctaaaaaaaatgtgggcaaactgtgacacgtagagtaatgtaccaccacaccaccaaagcttccttcctagcttcccaggtgtatatcgtgtattgtattgtgatcaaaagtaaacacttaattaattatgtcagtttcaatttcatttgacactcatataagcagatagctaggtggttattcaagtgatcggcgttaattgtacacgttgatatcgatcttgatcgataatgattgttccacctaatcaattgattaaagtctcgatcgatagttttttttggctttaagtcgacgcgcgcgtcgctatttagcttcgtacatactactgcgtccgtttttggataaataacgacagttgatcttttgaagtatagttggttatttgttttattttttttctaaaaatatgtaattctaataatttgttgtgagttgttttattgaaaacgttaaggctgagttcgcactccctcttcccaacccaactctctcattttccacgcacacgctttccaaattactaaacgacatgtttttttaaaaaaatttctatacaaaagttgctttaaaaatcatattatccattttttaaaaaaattaactaatacttaattaatcacgtgttaaaaaacctctccgttttgcgtgcagaagggatgggttcccgtcctccactcccaaacacaccctaagtatgacttttgtgagcttatgtatttgaaaaaaatgataaaattaacgatgtcatctattacaaaatgcagaatactgcttgtcgacttttgatgtcgcgattccggtatttgcatagtatggggatcgttggtactaggatatatgcgagactgaggtaaaagagatggagacaaggatttttatacaggttcaggcccctgaattgtcaggtaataaccctacatcctgttggccgaagccggtcgttgctcttattcatcataatcacaccagtacaatatttggggtagcctagctaactgttgtcgacatgacaatctaaagttctgactcatagtcgacaatagggtagtcttcctcctcgggtctgtgcccggcgagatcagatatagcgctttcgtctctcctgacagtatccggagacaccataggggactagccgtgcttatccctgaagtcgatatccggcatcttcttgacgtatattggcttgtatgttgatcttctatctcgacctattgttccgtgtatgttgattgtgggtgtccttttcctcatagggggtcttgtatttatacccatagatgtccccttgtccaagtagaactagggaaactaatatggatacaatccgagtagtccttgtcgtttctatgtagaactctattcatccttccttatgcggaactcctcctatatccgaaggttgtttccgtataagacatgatatgtggtgggtcctgccgagatttagtcgactactattaggtatgtggtattcataaccctgacactgctaatagtacatgttgagaggtgggtttgaccagttctgcttcaattcgcgtgaactcatccaatctgcatgccggtttttgcatcttttgtatggagatgcaaatataaactgtggtggtgtttgaatctcatgaagattaagattaagtgttttacgcaaaacgaggtagtaataacgtgtgattaattgagttttaattattacaaacttaaaaaatggattaatctaatattttagaacaactttcatatagaaaattttcgcacgaaatgcaccgtttagcactttgaaaagcgtgctactttaatccaaaatttcatccactcttcactcttttaagtggattcaaacggggccatgtatctaggctgtttggattagggactaaaattttagttcctgtcagatcggatatttgaatactaattaaaagtattaaatatagactaatgataaagccattctaaaaccttagattaatttgcaagacgaatctactgagcataattaatttataattagcatatgtgataatatggaaaacatgtgctaattatagattaattaggctaaaaaaatatctcgtgagttatttatacaattaactttattattaatctatatttaatatttataattaatgtttaaacatccgatattacaggaacattcagactaataatactccatgctccctccgtcctacctcttggttcaacgaatctgtacacgatacgatacattcggacggtgagggaggcgagtggagtgcgtgtcgacgtgtcctactcatccacgccacgtaaccaattccatctccggccgccgccgatggcctcgcgctcccggtggtcggcgctggcggcgagcgcgctcatccagtgcttcgcggggagctcctactgcttcgccgtctactccccggcgctcaaggcctcccagtcctacgaccagtccgccctcgacaaggtcgccttcttcaaggacgtcggcgccaacgccggcatcctctccggcctcctcgccgcatgggcccccgccggccgccgccgcccctggctcgtcctcctcgccggcgccgccctctgcgccgtcggctacctccccatctggctcgccgtcacgggggtcgccccggcgccgctccctctcctctgcctctacatgctgctcgccgcgcaggcgcagaccttcctcaacaccgccgatgtcgtcaccgccgtcgagaatttccccgatcgacgaggcaccgtcatcggcatcatgaaggtcaattatccattcccctaatccatcctctctctctctctctctccagatacaacctctctcatcatttctttaattaattcggttctttctaattaggcttataataaaaaggatcaaaataaatgaatagtactccagtaggcaaaagccaaaagcatacagattattattgaacaggctgctaccagcctaccaacaaccaacccaactgtggctcttccttgtgagatactattactctgtcctcttctcgaacactcacttgtttaagatgggtccctatgaatttcgactacatacatagtactggatgtgttgctgccttgatgcctcaaagcaacaaccacattttttttatgtgtcctgatcctggatgttgttgactttaattttggagcagagcagagcaaatagaatatcatatgggtagatcacaggaacttatagtgaaaaaggagtgctccagtttttattatcatgatgaacagcacaccagatataaggagggaaaagaaagaagagaacatcaaagactgaaaaaaaaacatgtattgtccactgtgttaattgaatcttgtgtgttttgttctttctagatgacattccagagtattgtacatcaagataataagctctaccgtcttcaaagaaaaacaaaatctttaccttttcatcccaaataatttcccttccttcttaccagttggttagcaaagcatgcgggtaaatttcaaggaactttgactcattgttgtggggggtgtcccaaatcccttttatggtaagccaaactcttggagtagtacttccttcacatagctcagtggtgtactaggccccaaaatttcaggttctggagtctggagtctgcaccaggataaattaactccatgaatgagtaatcgcaagctttaacggtttactccatttacgtgaggattaccagtttaatctgtaaattaaggagtttgtgggatataggaaatttgtgtactgtgctcagaaattattgcttccaaaaagacagcatgactgatgttagagtgctacaaacgtgtaggtaactactcctatttcagaagaacgacatctggtccctgctgagccatcagttgcaatcatcccatgcctgtctttttgttggattcatccttttcaatatttcatgattcattgacatgcttcctgtggctagtaagcttgatttacctcctgtcactaatttcccaaatattaattaatggaaacgtctgaataaagcttgtttgcatcatatatcttttggtattgccttgaggttttatctaattttatcgcggaatacaattatgtgaacttctgcacgtgcattgctctattagcctaacttgccttttatttgcttgagaacatggaaatctgaagtctcatttatttgtgtataatattttaaacctgaatccctgtacagaaaatgatttaggcctgaaactcattttatgctataagcaccatgttctgttctgttgcacaagtgtagggagatcttaaattcattttttttctgtacttttcaaacagggctttctgggattaagtggagcaatactggtccaagtataccgcaccatccacattgctcccagcactttcatactgatgttggcgatattgcccactgccatcaccctgctgcttatgtattttgtcgatgtccaccgttctgatcatcaacggtacaacaagaagttcatggatgctttctccctcattgccattactgttgctggttatctaatgatcatcataatctgtgaccaagtattgaagataataagttcagctgtgcagactgtttgctttgtgatactcctactgttggtcctgtctccagtggctattgctgtgaaggcccagaagacagaatcaatgaagcaagaagaagaaaccagggatcaagctgaaagaatcggactactccaagagcaaattagtacaaatgccagctccagtagcgatgagcgatgtcaagaactgtcgacaggcaaagaaaacatgaatctggtgcaggcaatgtgcaagctgaacttctggctgctgttcctagcaatgtcctgtgggatgggatcagggcttgcaacggtgaacaacatcagccagatcggcggctccctcgggtactcgaccaaggagacgagcacactggtgtcactctggagcatctggaacttctcagggaggtttggtgccggctacatatccgaccacttcctccgttcgcggggagtcggtcgccctttcttcatcggcgtcacgctcctggtcatgagcttgggccacgccatcatcgcctccggcatcctggcgtcgctctacgtcgggtcggtgctcgtcggtctttgctatgggtgtcagtgggcactgatgccgagcatcacgtcggagatattcgggctgaaccatttcggcaccatcttcaacgtggtggcggtggcgagccccgtgggatcttacatcctctcggtgagggtggtgggttacatctacgacatggagtcgccgccgggagctcgtgcctgctccggtaaccattgcttcgttttgtcgttcgtcatcatggcgtgtgtctgcgtggttggctctgctgtcgccttcatgctcttcgtcaggacgaggaggttttataaacgggttgtgtacgccaggttgcaatcttttctatagagagagaaacgaaccgattcttttctagcaaatgcttacctatcttttacaagcaacaggatttgatctgtacctgtacgtcagagaatggtagaaagcagaggcacactactttctgctgccatttttttcttgttgaaaagacatcattggactggtcactggtgttatatactactagtacttgtatgtatgcgtagaagtaaaaggaaaataaaacaatgtacagggaagaagctacagaaaacaaacagcatttgcttcgtcagaaaattatagcagagctgacttaacacaaagaaatcagttcgtgcaaccagctggctggggtaattttttcaagggaataggcttggagagctctgccttttatgctgattcagaaagtagagaatagttcagttctaagcacatgaaagctacattgttacagagtggatttgtcagctgacaactgtatataccagctgctttgcccctcgccggatgcggtacaggaggaaaaggcccaggccacagcgagagaaaaggcccagctacaagtatgcaggtccaaaatgggctctgtaatatgggccaaggccgggaaagtgaattcatctaaatagtcatgtcacctaaatagtcatcaaaaaatatgaaaaaaattggcaacatagattaatatgaaatatatctcttcacaaatatgcaagttttaattcaacttctacaagttgtaacaaaaataacaaatatagttgcgaatgcgtgataactattttcagtttaatttgttatttttgttgcaacttatagaagttgaatttggtcttgcatgtttgtggagtgatatatttcatattaatctatgttgtcaattttttctaaattttttgataaccatttagatgacatgcaaacaacgagaggatgtccccttgagggatgaaaattcacatctgccaaggccctgtaatagagctaggctatctggggaggccaaatccggcgacggcggcggtgggactactgatgtctggaactaccgtcgacacccaaatttataacactacagtagaattaacacaaatttagagccgagcattatgacgtctctaaccatccatgtgagatcaaagttggataaacaagtgcaatatttcaagtgccatcttcagatttaacgggccgaaggaggatattaaccctgtttgagagagcttcagaatcaaaagctcccccaaacaattcagcttttgacctagattctgaaaagctgtagttgtaaaatacaaaaaaataaactagaagccagaagctggaaaacccagcttttatatattctcagaaactggataccaaccaactgcttcttagaattttaagctcctccaaatagaccttaaggtattttttttaattcccaagggggagagaggcaaattaggagctgaacattctgatgtctctaaccactcatgtcggataagagtcggatagacaattgtaatattttaagtgccgccttcaaattcatcgggccgaaggaggacattaagattaaggtattgttcgtttaatttctaagagggattgaggaaaaacaattctatatcataataattatggaataaattatctttaaattatcctcaatccccttattgccgtatgggagggattaaccgaacaacacctaacgaaaaattttccacagctttaacaaaaaaaaagtactaacttaattgtgtggttgatttagaaacaatgatcagagcggcggcatttacacttgaaggtgtatatgccttatgcccttattattacaaagatggggaaccttattaatagaaagaaactatgacaaaaatatataaggactcaaacaattaagacataggagaagactatatattagtgaagtgccatgtcatatgcatgaagaagactgaaaaccactcctcgctctgtcctgacatatatggtcccgtcgatcgtccaggacgaacaactcctcgtgctgaaataatataaacaaacaaaatcgcaatcagtcaagacttgtgcagtaggatcagtaataaacaactttcattagtggagtagtatttgtcaccttaattaattactagctagcttgttaataaattatatggtgccattcgacttgttgttgactgtttcatccaccttcgtccctgcagcttcgtcatccttctctttctctttcgccgctttggccttcgccggctctctttcctccttcgccttggccgccgccgcctcttcttcctctttcgccttggccgactccgccgcctccaccttggccttgttcaacgcctcgatcagacttgccaggcacgcgtcggggtccctcttcttcccttggacgccttgggcatcaggttctccgccacgtccgccggcgacatgtcgatctccttcagcagccgccgtatctcgacgaacatctcgtgctgctccacgcccaggtagttcttggccagcaccttgaacgcctcgaaccggcagtaggacatctcgatgtgcacg

SEQ ID NO: 69312 - DNA, 696 bp, Oryza sativa
  unsure (1)..(696): unsure at all n locations
gaacagcattgaccgctgcctgcaccgttgtgaagttgcagcagccattgggatcgacacagaagattgaaattgccgcggtatctggcggtggaaattccggtgggaaatcatcgcataacggattatattcgtcgcgataccgatgatttccagtagaatttgtagtgccagatgttagcagatagaatggaagggaaggtgctgcaagatcaagaaggattccaaggaatgaagaaatggctggactatggagatgtgatgagagcagcacaagtgcagatatgcagcaagagagaggaacgataaatttggtgctcatttgtatgactgaattgattcactatttcttggagaatctgggatggatttggggttttaacatgctgaaatgcactttaagaagaagcttaaattgcatgccttgcaaacaaccgatctcctttcttcaagcttgagacgcagcctacaactacaacagctactaggaggctaagatgtttatntaatgcgtgcaaaaattatcaagtcaccgtcagaatcttagagatgatcttatcaggcagcaacaatttcacaatagcaaacatcacaagatcttttagttcatgtgaaatagacatcttttgaaatgtcagtgacatggtgaacaatttccagcttaaaaaaaacaacgattacgcacatcaccatcat

SEQ ID NO: 69313 - DNA, 4851 bp, Oryza sativa
ctgtctggtactatacaggaattgggatgttttcgttgattgaacaccgaaatcttatctacaataaaacacggcttcgcattcttaataatatttatctcactactaaaaatccccatgttccctaccgtttaatattttcctactagtgtgtgtggagacaaggaaaataaaaatacccatatcgtaccattctaggaacatagggaaattttttgtttcatacagttttacagtattaagagggaacaaacaactgaaacgttcaccatgctggccggtcatgtttccctgcgatatgattaaaaacaaggtgattccccgcgctttaatgcgagaattactaagtaattattaatttttttgacagcaagttaggagtaaaaagaaaaaaataataatgaaacatcagggtttatcaatcaaataataccatgcttcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagcatcctttcccccagccaccacctctttccgcatcttggacaggcggggatcgtctttgtccctaatcttcgtctgcagcacaccatccttgaatagcttcacacaaagtagcgaaagagagagataatgccagaatagattgctagtgttgcccagcagaaaaaggaaagtctgtaaattcattctcacctaagatgaacaacagaggtctgcccccaattctgtgtgtctgcaaaaatcaaccaagaaacaatgaggataatgagcagcacaaccgaattagccaaggaggaagatttcctcttgttggctaaacgaaagaaaaaaaagggcaccaattaacctgcagcagtagagtgggcgagcttccaagagagaggaaccgatgatagcagcacgagcaacagaagcaaaggtgctgctgcccttgtccgtggccgccgtcgtcgtcactaccgccgccctcgaccgctgccaccgccctcatccgtgtccgccgccgccaccgtcgagtacagccgcctcgtcctcgtccactgccgccctcgaccgctgccgcctccctcttccgcgtccgccgcagccgccctcgttcgcgtccaattccgccgcgctcgtccccgaccgccgccaccgtcgctgtcaccatcgacagagtctgtcaccgccgtagtcgctgttgctgggggaggcgatacggtacaggaggcgatgcggtggggagcgaagggaccgagggcatgctccaaaacgcaatgaggaccactgagatgtaatccaacggtcgataattaaatgatgacgtggcttcaccaaatctcagctttgggtcttaactttatgaaagaagggattatatgggactaactctaaagaatttagctccagaaaaatttgcctgtcctcattttctttaaaaaaaattgcctgtccctgctagttttatagtttccctccagtccatacatctctgtcccacctcgtccacatagaaaagccctagccgcctccaccaaaatatttcccttcttcggtgaaatcagcggccatgctctagtgtcatgccattatctaaggtcattcttgcttcccgcaactctcctgcatcgaatccctaaactttccacccaaaaaacacgctttgtggccctaaatcctctattcgtcatcccccattacctttccatccattaaatgcgcatgaccaccttttaaaaaactgacaccttttaaaaactgagcagtgagcttatgagcggataaggggaggagagtgcgcggtgacaagcggataagaccgagagtctctctctctctctctcggcctcccctccgccagattcggtgggaggagaggcatcgatgatggtggtggcaggctccggatctcacgggcggtgggctccagatctcacgggcaagggcgttcatgggcgacggcggcctctccgtccgtctcccctcccctggcctgccttggcctctcctctccatccggccagcaacggtggccaacggtgtcctgctaacttccggctccaatgagcacccatgtcgacttgaatcctctttctctctccatccatctcttcagccttcggtgagcaccaccatttctctttgccttaaccctatcttcatttctagatctagagcaagcttttctccggtggatgcagccaacagcgactttttatgatgcttgattctatgatgtgaacttatcgatgaacatttgatcgtgtgatccatgaacttgttgattgtctgatgtgtacttttatatatatatatttggatttatttttggtgactttgaagcactagcttagctcaaattgagctaagctggagtttttttttttttgcaaatcgtatacctctaatagacttcgtggtgtcagttgggaaatccggcacctatgaaagtttcccaaccaacaccaatagccttttttataatagtgatatagggtatgttcagcagtcagtcacatgctaccacaaccactttggttgaacctttttaaggtttggtggttaaaatttttgctaaggtataggagctgtttggatggggggattgatttttagcctctgtcacatcggatgtttggacactaattataagtattaaacgtaaactaatgacaaaacccattccataaccttggactaattcgcgaaatgaatctattaagcctaattaatccatgattagcctatgtgatgctacagtaaacatgtgctaattatagattaattaggcttaaaaactttgtctcgcgaattagctctcatttatacaattagttttgtaagtagtctatgtttaatacttcatattaatgtccaaacatccgatgtgacagagactatacaaagttagtaactgaattcaaacactaccttagtaacgggatccaaacaccaccttagtaagcttaagagagaatcgtgtcatatttttcttaatcacttacacccgagccctagttttttagaagtactaatcttgctacaactgtctaaatagttgatcaaatttatctaatctatgataagttatggcgcaactaaacggggcttataatatcttccgttatatttgaagaaaacacgacccagttagctcagtactaatacttatgtgcaaacagtacgttacacagtacaatgtcggtcttttgtagtactacctccgtttcaatataaatataaatatagttgtggttttccatatctaacgtttgaccatcattcttatttaaaaattttatgattttttttaaaaatagttacacataaaatattattcatgttttatcatataataataataaaaatactaattatatttttttaaataaggcagatagttaaatgttggacatgaaaactcacacttgtactgatgtagatagtaattagggtgtgtttagttcacgctaaaattagaagtttgattgaaattataacgatgtgatggaaaggttggaagtttgtgtgtaggaaagttttgatgtgatggaaaagttagaaatttgaagaaaaagttaggaagtaaaccagaacttaatttttttgtctatgaaaaagagggagagggaggtacgtacgagctagaaactgcagagtgtgaatgcattcccaatcaatcagtcactgtaatctcaaacaccatggacagatatgatatggagtagataggagtgaaaagggtcggaaacgatcggaattgatatcatctctttaaaaacggtgctcgatcagccaataattgaccatatttatcatttaaactactcagtatcgatattaatacgatgcagaaaaaattatgaaaaaaatttaaaatagcaaaaaaacgatacggtcggaaacggtaccctttatacggaaacgacactcggttgatcgggaatttccgtgaccatcttcacccctatgagtagatatgtgatcaatcctgcagtctgcgctgcgttgtttggttacatgttttccgaactactgaacggtaatattttttctaaaaacctttatatataaaagtcgctttaaaaaccatacaaatctatttattttaaatttaaaataaataatactcaactaattatatattaatagctcatctcgttttacatatcttcccaatttacttcttttctcttctctcgaactcccagctagctcaaaagcaaaccccagaaaaatccaccggctgccacaagcagccaccgtcagaccatcacatatacacatcgccattagcagtcgagctgtcgaggtcagggagccggctaatttagcccatgcatgatagctccaattcctccatcctataaaataatttcgtatcttttacctctaccattcttttcaaaatgacatcacttctttcactttatttatatctaatccataaattaattagttttattttgttgatatttcttatccacttagaacaagttttatagtaaagatgatgatcacctctaatttatcttcatattacttgccttagatatacacccgtgctaatataccataataatatattttactatattacggggattattaacggggat

SEQ ID NO: 69314 - DNA, 1882 bp, Oryza sativa
  unsure (1)..(1882): unsure at all n locations
ggaattcgctgtgcgtttgggttgatttcattagttcaacgatgattccgttggagggcaatttggggttttctgcaggcttgttcggcgcgagggcacgggacctatatgaatattcagtatgagcttctgctagctgcctccacgcgctccaaggaactgatgaatctccattctccaaataatcctccggctgcttgcccatgcaaacggcataggatataggatattgatagtcatagctagggatcacatgcaggggtatccttttttaaaaaaaatttaactttattaactttagaagcatagtaactatgttaccctgatacggagatacggatacggatacgcgttacggggatacgaggatacgtcacttttaaaaaaacaccgatacggggatacgtctatatatacttattaattaaaaaaattactaaatccctgtaaaaaaacaataacactttcttgtagctaaagagattagcctgaaataatgaactttctgattggattatattatctccaccaaagcccagataacagaggaccaagaataatgtataaattagtgtaagactgtaagcagtgccaaaataaaaccaagtgaatgtttttccctggcgggtggccaagcaagctcttaatgaacctccagccgacttaggccctaggaccgatagatgcagtactttgaacttgcaaatccaaaacccatcagacatatgaaccaagatgcattagttcttagaaaaaaataaggggggaagaacgtacacaaacaagatccatcaacggttctttcagtgggaacgaaggacccatattgctcagtgcggtggctctgtgcccggcgatgtcggccatcggcggcgctgcgcccgggcagtgaaggtggtacacgtctggcacggcggtggtccgttcgacttatggccgccgcggctctccttttgccgtcgttggcggcagcggctttgcggaggcggcgcagccgcgcgcccacgcgtagatgcggcgattgacagtactccctccgtttcagattgtaagactttctagcatttctcatattcatttaaaagttaatgaatctagatacatatatatgcctagattcattaacatctatatgaatgtcggtaatgctagaaagtcttacattgtgaaacggaggaagtattgttagggttgggacttgggactatccaggatgcgcagagccgtatccaagaagtatccgaattatctttatttatttgaaaatcagaaaaattgaggatacgtatggatatgtatcggagcgtatccgatggagtatccgatacggatacgctgactgttccccgtatcagtgcttcgtagcatagtacatcaaccaatgatacattctccataagaggagagaattccaaagcttctttaggcttttagggtgctccaccctggaccggtgttatggggcgccatggaggattntgttcgacatggaacgagcgcccgtgccaagttaggctcctcacgtccatccatactgagcgacgtagaaccttgtttgctcgagtctacgcgcggccaaaaaaacgaaaggagcctgcgctgtgggcttcggttcttcgccacaccgtgacctcgcgccgcatccagtgaagaaattcccgattcgcccagaaaaaccccatcccgcccagcgatttcccctcccaccacatccattttcctcccaccatcgagtcaagaaaaggcaagaaaatcgaagaaccgaagataagagcatgacaagcaagtatagataggagtaggatccctctgggtcttaaaacaccacaggaacaaacatcacaagaactgaatataagaacataacaagcaaagataaaaa

SEQ ID NO: 69315 - DNA, 739 bp, Oryza sativa
tgtggggttgtgtcttgtgggtacagtggtacacctctgatcagagtttaaactattcgaatagccgtacccgcggttatgggtgagttgagcaatgtttttcgtgattagtctcacactactcataatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattaattattacaactgttttactattctcttaaatattcgttaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctggttaggatgcctgtggagtggagtcgccatagctgttccgtagtttgttatagttttattttccgctgcgtagaatgttattctttgagaggaactatctacctctgtaataatttattatttgcgaatattaaatagttatttatttgtactctattatcaatttgttattgtgtgcctcagttgattctggacgagggtttaacacacatgtaagcgttcggaattttggatagattttccgggcg

SEQ ID NO: 69316 - DNA, 5058 bp, Oryza sativa
tcaaattcgacttctacaagttgtaacaaaaataacaaatcaaactctaactagtatacgtatattcacagtcaaatttgttatttttgttacaacttgtagaatttgaatttgaacttgtatgtttgtgaagtgatatattacatattaacctatcatgtcattttttttgaaaatttttcataaccatttagatgacatgcaagaaacgggtggacgtccaccctgagtgtttaaaactgttttccagtggcaagtgctttcctcatgcgtcatctgtccatccttaagttgtgcctgcttcgtcaaccgccctttaatttggtcatgttaatttcgatcttgtgcgataccttttatacgtgtaaatataattaatgtacctttaggtagttgtaacataacggtgtatttaatgaaacttttagttttggtttagaaaaaactaaaatgcaacaggtaggcttatcaatatgaaatggatggatggagtaaaaaaagagagtagatgttctgtatagctgcaggaccaccaaccaatgaaagggggggggggataccgaatacaagcggcgactggcggccagttgttttaagttttatttataacaaggtgatttataatcaatcatcaattaaaaagagagcgaatgtgattaatcaaacgacaggaattagcttagggcccatcaatggctctcctgaagagtggccgatcgactgcgatcctgatctagccctaagctgcgatcggcatggtgatgggcggacaattaaggaggacggcgactgcatgcatgcgtgaagcagctggagtacgatttatacttgtatacgatacgacgaggcagcgactgtgcatggccgaggtggcgggatctagcaggagagagctagcgcgcgcgggagaagatgcataggcggcgcacgaggccgcttaattcctgtgcgatctcgatatatatatatatatgtatatgctcgccatccgcatgcatcatcctcgatctcctcctaccccgatcttcatcttgttgttgatgacgatgacgtactatgacgacgacgatgtgtgtttcccccatgttgatgacgatcttcttcttcttctgaatgcatcaacattataagagatcaaaacataatgataacactacattataattaaggattaattagatccatcccattaaaaatttagcggttttaaaatataccattactatttatatatttgtattgatgccactatttgaaatcttagtggtgtcactgagatatgtattttccatgtattaaaaaaaataccctcatcttctacctctctctttcccatcttctacccctctctctctcctcgctgcgtcgctcgctccgccgccatcccatccgccatgccgctcattccgtccccgccgctcctaatgctgctcgcgatgccgccgcttaccaccgctgcagctcgctgctgccaccgcgtcgctgctgctgctggcgccgccgctattcaccgcgccgccacgtcacggctgccaccgccactgacacgccgttgagaaggaagagaggaggaaggagaaagaggaagaaagaagaagaagagaaaaggtgcagtttggtataatttttctagaaatacattcaagggtaaatagtggtatcttttgaatatgtgtgaaattataatggcatatttccaaatacatgaatactagtggcacattttaaaaccggtaaatttttaatggcatatatccaattaacgctatatataataatatttaataatgaggttcatttgaaacctgttaggactaaagaagttactccttgattcatcgtaattacaatatactccctccatccctaaatatttgacgccattgacttttttaaacatgtttgaccgttcgtcttattcaaaaaatttaagtaattattaattcttttcctatcatgtgattctttgttaaatatacttttatatatacatatagttttacatatttcacaaaaaattttgaataagacgaatgattaaacacgtttaaaaaaatcaacggcgtcaggagggagcattacagttcgtatcaaagattatcaaccgtctaggccgacggcaacaacaagttgctccctcacctgtattgtatgctgagtctgaatctgacacctggaaaatacaactctaagttttttctttgcaaccggccggttttctatatatattggacacaaatacgtttggcagtactattccaactccgcatgcagtactatctcggcccatatgtatatataggaatatactaggacacaaaaacaacaatctacacacaaattgatcgatggagatgacggcagcaatggagggtgcagcagccggcggtagttcggcggcggggttcagcttgtcggcggtggcgagccttctcttcctcttctctatgcttcaagagcacatccccttccaactccaggactgcctcgccgcactggccgcccgcctccacgccctcctctccccctacgtcaccgttgttggagttaatttatttctagaacataccagcctactctctaactctctctactactcatgaaataaaagtcaaggagcaagtccttcctctgtgaaatttctagagtagtgtagacaataatatgttctttgtgagttctagtattttcatgcatgtaccagtactagttgtgttcaaaaaagttcctagccatcctataaataggcagctatgtcctagatgtgatgctgctgtccaacaatcaatgtaacgtgcaatacttgagcaaagcataaccagtttgtgaaacaaacacagagcttctctcctctgttctccttctctgttccattgctagcaaaataatcaacaacaacaactggtatcagagcgctcaggttcgagtagggcgtgacggagtagcacggcgtatcggtattgtcaattgaagctacaagtatggcttcaagttcgggcgccacaatggcgcagtctatggttcctgtatttgcaggagaaaattatgatatatggagcatcaagatgcggacgctgctgctatctcaaggattgtgggatattgttgagaatggctatcaagagtattccgctggagaaactcttacggcggaacagaaaaagtctttggcagaggatcggatgtcggacgccaaggccttgttcttgatccaacaaggagttgcggaaagtctatttccgcgtattattggcgccaagaaatccaaggaagcatgggacaagttgaaggaggagtttcaaggatctcagaaggtacttgcggtgaagcttcaaaccttgagaagacaatttcagaattttctaatgaaggagtgagagaaggtaaaagactatttctcaagagttattgagatcgttaatcagatgcgcctctatggtgaagatataaacgaccagaaggttgtggagaaaattttaatcagtctgcctgaaaaatacgagtacattgttgctgctattgaggagtcgaaagacatgttgactctcacaattcagcaactaatgagctcgttggaatctcacgaagaaagaaagcttcagcgcgaagggagctctattgaaaatgcatttcagtcaaagttgagcttcaggcctcaaaactcaaggtttcgcggaaattttcaaaaaaatgaatttccaatgcgagaccgtggttattttcagaaaaatggcttttcaaggcagaaggaagatggtcaagagagaagagaaaaaggtacgtccagttcaaatttgtggtgtgacatttgccaaaaatctagtcatactacagatatgtgctggaagaaaatgacctgcaacaagtgcaaaagaaagggccatattgcaaaatattgcagaactcgagaaattaatcgggctaatttttcacaagaaaaggaaaaatctgaagaaatggttttctcttgccatactgctcaagaagaaaaagatgatgtttgggttattgacagtggttgtacaaaccatatggccgctgatccaaatttatttcgagaaatggattcatcgtatcatgcaaagatccacatgggaaatggctctatagcccaaagtgaaggcaaaggtacggttgctgttcaaacagcagacggtccaaaatttataaaagatgttttgttggtacccgatttaaagcaaaatttgctaagtattgggcagcttctagaacacgggtacgcggtttattttgaagatttttcttgcaaaatattggaccgtaaaaataatcgtctggttgccaaaataaatatggagaagaacataaattttctattaaggatgaatcatccaactcaaatggctctcaggagtgaaattgatatttccgatttatggcacaaaagaatgggtcatcttaattacagagcattgaagctactcaggacaaaaggtatggttcaaggccttccatttattactctcaagtctgacccatgtgaaggatgtgtatttggaaaacaaattcgggcttcttttccccacagtggagcttggagagcaagtgcaccattggaactagtgcacactgatatagttggtaaagtgccaacaatttcagaaggaggaaattggtactttatcacatttatcgatgattatacaagaatgatctgggtatattttctaaaagaaaaatctgcagccttggagatattcaaaaaattcaaggccatggtggaaaatcagagtaatcgaaaaattaaagtattgcgcagcgatcaaggaggagaatatatctcaaaagaatttgagaaatattgtgaaaatgctggcatcagaagacagctaacggcaggctatagtgctcaacaaaatggagttgcagaacggaaaaatcggacgatcaatgatatggccaattctatgctccaagacaaaggtatgcctaaatctttctgggctgaagcagttaatactgcaatttatattttaaatagaagtcctaccaaggcagtaccaagcactacaccttttgaagcttgactattttata

SEQ ID NO: 69317 - DNA, 7642 bp, Oryza sativa
actggccgtcttagttatatcatgtttattcggagacgactcccggtcgatcgagcgcccgatcaggagggggtaaaatcaggcgcgacgtcagcgctcgattcatgtgcaaaactactttaaactgatttttctcttaaattacttatacaaatcatgatccgattgcaccattaaattcattgtaattaaatcttcaaaacaagaccatacatggatatattccgatgaaaaaaaatttagcttattatataattatttttaaatgttgcacgatgttccaccaggtatatcgaaattgtttcactaaggtggtgtttggttggagggactaaagtggggctaaactttagtccctctcacagaaacataagtccctaccatagggacttgtacttttgtgagagggactaaatttagtctctaattcccaaacaccccctaagtagattgaaaatgtttcactcatttaaatcgggtgttgtttcacttatataaaaacaatgtttcagcaaatagcgaaagaatgtttcagttcactgcaacattagatctatacatagtgaaacattgtgtgtacactaggtgaaacatttttcggtggatcaaaaaataaaccaaattcccttaataaggggtttccaaaatatgtgggttttttgttgcaatggaatgtttcgttcactgtaacattagatctatacatagtgaaacattgtgagtacactaggtgaaatatttttggtggaacaaaaaataaaccaaatttccttaatagagagttttcaaaatatgtgggttttttttgttgcaaaagagtattttaattcactgcaacattatatctataaatagtaaaacattgtaagtatactaggtgaaacatcttttatgaaaaaaaggagagagagaagtaggtgggcccaacagtacgcacgtggagggaggggcatgtaggggagctagcgcccgatccgcctccccccgcgccgggcgaccaaggtaaagtacttttgcgtttattcgtacgtgtaacatgaatatgcctactgaccatcagctattatatgtttgttaagacggtcagcaagcttataattacctataattatacattaaaatacggttgtactccttcagctactataggtaattacgtagtactcctttcgtattctaatatataacgccgttgatttttatcaacgtttgcccatacgaattataggtaattaagacccacacactattatgtccaccatataggcttctctttggaagagtacactgcaggccataaaaataaatttttaatttttacatttttattaaaatattttaaaattatatattttatttcgaaaatttataaacctagacgcctcacgcgtgctcactacgcgttctaggagtacgttttttaaaaatcaacaaacattaggggacctaaatatttcaataaaaaaaaagtaaaaataaaaaacacccgcaggagcagcatcgatgccggtgcggcaagagttgcagtcgtcgccgcaattgtatggatggtgaacgcgtaggttgtgggaagattaatggccgagctagcttgtcccgcgggtataatcattgaggctcactcagcttgctacattagctaaagtcatgcataatactgtttaggatctcggatgattcggttatataaattgaaaaacccgttatatctgatattttagttcaaggaagaatttgagacttggtctcctctcccctactacactagactcaaggaagaataacgaaaggagattccagcgaggaatacggagccgcatgagacgagagtctctcaaattaaggaacctaaagttaacttattactaccatcaacagtttgggtttcgctgcagcagatatacatgccggcccataaggctaagtaattcggatagtatttgggctgttttcgcaggcagatcaaattgtccccaacttcgtctcttctcgttcaagttcgctgtgcctgattaagcaaacaattgagcactaatggcagacacactcgaaattcatttttcttttctaaaaatgacaacgttttagagacctttaattcttcttggcctagcaattaaaagatgcagaaattatgttaatagtcagccatatttcaaggcccacccatgcatggatcatatagtaattaagctaaaggggtacgtatagcacatactacaaattagaagatgcacacaaaattatgtatacatgttcgagtacagatatatatccatggacgattattatcttattatttccacgtaacaagtatatattacacatgcatgcatacgtcacggacatatatatcaatatctatagcagccagctaatgcgtgcacgcatgctgcaatattagccatagatcatccatgaccatgatcaagttaatttaattaggtgagaagatctatgggcagaagacgacttggtagttgctgtttcccctgcacgcgtgcgtcttgctgttgtcgctggggaacaggtaagcgtcggggcatctgctgtccctgcaggtcagccccacgccggagctgcaggagaagctcatggcgacgttgtacccgtcgatcaccgacaggtcgtagaagtcctggctgccgccgagggtgaactccgccagcgtcatcggcggccgcccggagaggctgcacgacagcgcgccgccgcagtcgccggtggcgcagccgcccctgccggcgccgtcgaagttgcagcctgtccggccccacaccctgccggagctggtcccggcgggcacgttgatggtccacgtctgccccgggctcagctgcgtgccgccgcccaccggcgtcgccgccggccacaccgtgaacgagcaccggttggtgatggtgaaggtcgccgcgttggcgccgccggcggcgagggtcgccaccaggaccacgacgacgagcactgcgggagaggcggccggagctgacgccattgttgaatatatcgatctctcgaagtcgtagctagctagcttaaactgcctcttaggatatatcgatcgatgtgtgtggattgactaggaaggggcatgcgtatttatagataagatgcaaaatggcacatgccatgctgctgaaaaagtctagattatttcttaataactgttgagaaatctagatgaagagagaatatactggaacttcatacatgaatagcattgcagcagtaactaatattatttttacatttgaaagagttgctatacggattcagtaagctagatgcacacaactaaattgaataatgtactattatttagctcagcttcccctgaataatcagattgggtgcatgaaagacaaatataactaaaaattaatataagatatcctttatttcaagtaaaatcaacatttgaaaatttcaactagtaattgaactaaaagtactttagtatatttagtatatcatgcacatgtgattattagatttctatatatttgaaagtatttttatatgatattgattttatagtcatttataatatattataaaacaaattaatgtttaaagtatatgtaaaataatacttatcttattttaggatgaagggaatatactttatatgcacgagtgtttgaccttgaaaagtacgtatacacataatattgaccaagtttcagaaatataatgcaaatgttctgatgaccaaaaagatcagtagaacagatttgaccgagttatgttttcgtttggtgtgcccaactacatatatttttaatgtgctgcagaaatataatgcaatataactaggaaggaagcccgcgcagatgcgcgggcatcttatttattgttttatgatttatgaaataatgctaaaagatgtcatgtctcatcttttttatgctgtaagataaactgattttaatatacttagtaaatgataagaatgtctccaagattaaaagaaaatcagtctgtcccgattacttataaattctcctatcgtcaccagaacttattattactattttaaaagttgtgtatctataaatagataaaactggatatgtaccaataaaataagcctaatacatcattgatacactaaaatatctacttatctaagtgttcatgtttcacttattccgaatccatatataaatattttaaaaataccacttataccaattaatgaaataacaccgttaaagataaacatgaatgccctctaacgggtgaagccgatcatagccaccaagactttttttctctgttgagttgaaagatgagtccctcgtcgattttagtctaatttactatcacaacctcatggagaattgtattcgtatattggggtcacctcaactcagccattttagtgggaggtatgctcaaaggagagtgttgtagcatttgcatttttggcagttaagtttgataccctactatacttatgacattgtagcaaactctattgttaatgcttgataccctttagaaaaggacacataaagtgaaggtgatcaaaataatagttgtttttaagctttgaatagatgtgtggcacacgatagacacaattttatggtgttaatcatcactaaaattttcatagtatacatagagtactctattttgaaaaaaaaatgatgaggttcattattcgatgctactatactaaaaaaaggtataccaccacaacaatctctatatcaccatattattggttatattgataaatatctatagtttagcacctgatttattttcaataactattaagaatgtatttattttttcaaaattctttacaataactaataatttgtgggagtatacttatagtcacgtggtgggggtgtttgacatacatacatcaattatacctaacatgttgaaattccttggaaatatatcatgtgtagttcactgcgcatgacacttgattgttcatttgttgttaaaactatttggtaaaggaaaaaacatacatatatgactgatttatgatggatgaaggggttatattatagcaaagatcattggtaggaaatatttttatttttatcacatctatgtatcgtatgttgatcatcacttaaataccaatcaagcggttctaaaaaattgaaaataaaatttttgataaattaatccaaaaattaaaattaaatcggatttacttaaaaaaatagactaaattgttttttttatcattttttacatttgtagatttaaattggtgttgtatatttatcaagtgatattagaaatcctaaaatataatgtgaaactatttaaaaattaccacaacattaataattatatgttggtcccatgtgtcatgatgtatttaggaccataatataccttttataagacataaatatttcatttaattaaagcatgaaactaatcacaaattgaatataaatataaattaaaaagatgaatgtttaaagacattgatttgatatttatattatagatctagttctatttgcttatatttgtgaagtaatatattttattttatattatagaaacatctgttttaaaaaccgttgatacttttcccattggtactacgtacgtttttttttgcctttatcttttttatcccaagtacgtgcgtatatttttcttagtaagctctaacttttttttgaatcatacttacactacttatcttttttgcaacagttaagtatgtacatgtagatttgatctaatgtcctaagataacaggcctaccaatttaaataaaaattaatgatgagattagacaaagtcacatggtggcctacaagagttggtagaaatggcacataagatataatatgacatagtagtaaaaatatagctaatatagctctggaattggtgatttaattaaaaaaatctgcagctgctaaagtgtatgcgtagatcgtatataaaaataattgtttatttacaacaccagatcacttctattgtaaattcctagcgtttgcgcattcacactcagattactctctatgaaaaactgtgataataaattatgatgtacatgtatcatgtaatttggaaaaaagaaaaaaaaaggagaattaggatctggatggcatctatcgagctcgccgaggcagatcagtctccatgaaaatgataacaaatgcacatgtattgtgtaattagaaaaaaagaagagagggagaatccagagttggatggcatcgagctaacagaagcataagtacgtacgtatgtacttgtgggttcggagagaaagggtgagaagagatttagttttgatctaacggttaatattattgggtccaccattttaaatgaaaacttacggtcagatatttttctttttctcagaattttatttaaattattagagggccatgtggcgacttaggagcgatgtggcgacttaggagcgtttataggagtctcacgtggtggcttgagagcgtttgtggaagtttaatggacttttagtatataacaataatagaatagaatagatagatagatgagagaacaattagacagaaatttattacagctagttgttttagtgaaaatttggtttttatctaatttattagaacgtcacgtggcgttataggaacatttatatatgcgtcgcatggtatttagtgatgtttataggaaatttgatgtactttttactgtataatagatatataatagatagattggatgtcgtggatataatttagtgacacctgtttgtagaattatttaaagtaaaataatatatgctgttaacttttttatagttaaaaagtatttccttgttatatttggttgccatataaagcatatggcgcatagaatagcatagatcttaaattacttatttagttaaaaataaaataacaataaaaaataagatatgtggcttaaattggagattaggaaaggaaaaaagagatgaggggagaaggagttacgtacgtgatgaggggagaagtagttacgtacgtacgtagcaacaggaggggagatcggtatatgtggagaggggaattttgtttttttattagatctaattgctgataatattggacccaccaatttaaagtaaaatcaacgattagattttgtagtgccacttggcggtttaggagcgattgtaggagcgacacatggcggcttagaagcgtttgtaggaagttttatggacttttagtatataataatagatagatgttgaaatcaaacttttataactttgactatcgataactttaaaaatatttagtttgacaacacatataaatttatcttaccaagtattataataaaagtaaaaatatatttatttattatatatattaaaataaataaatatagtcaaaaatataatttagagtaaaaaaacattaagaattatagacccgtcgggagtatgcatatttctatgacgaacaaaatagtctttaatttcgacctgtccgcgtctatcgatcttaattttgaagtcttgtgccataagttgccgcaggatgtgatcggtcggtcgtcggaggaggaacttgagatcaattgatctagaattctagctacacttttctaatggaaagaataaaatggtccatatatatgtgctacagat

SEQ ID NO: 69318 - DNA, 525 bp, Oryza sativa
ggcgaattcgagctcggtaccccaatcctttttgtgtggcagtgggtccatttgaggaatccatagtggataagcaggtatgttatgtgtgccatggtgtcatggtaaggtggatgaacacacatagatgctcactcaaaagggagcatttgtgattagataaaaaaactcaccattgtggggaggtggaaaaggagattttgacatgccaaaaaaatccccattttttcacatacacactcatgtgttcttgcttcaattgattgctattgacattagttagttaggtccagaaccacatcaggccactaattctctgttaaacatagataagcaacacggttcgccacatatggaaaaaagttggctagtttgttaatcttgatgatgactgactgacctctaaacaaggttactattaatctattatatatgaatacaggagctaattgcatgcccaaattaatgcagtgtttttgtggatgctgacaaggcatgttgtacaagtgatgaagtggtgagaag

SEQ ID NO: 69319 - DNA, 750 bp, Oryza sativa
  unsure (1)..(750): unsure at all n locations
tacagtacttcatgacgaagtccgctcgggagagccagagaggatcactgcggtgacctcccaaccagcgtggggctgcgcgtcgtcaccctcctgatccggaagcggncctgggcctggtagtccactccatgtgnggataccccaggggccacgcacatgccccgcagctccaagacgaagccagtcatgtccaaaccacgacgggtgacgctgccggccatctacaaacaaaaacaaaaagaaaacaacattttaaaggtcagattttggcgataaatgaagcagcaagacagagagagactagacagtttttacaaataacaaaggatttttatttttgaaaatattgctaaggcttgggatctacggctcgtcctagggtcaagggtagctctgatgccacttgtcacgaccggaaataacccaacgggcgtccctgacgtgcgtgcattaatccttgtcccaggaggcaaggtacaccaaaacttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatg

SEQ ID NO: 69320 - DNA, 531 bp, Oryza sativa
agtggacattctactcatggtaccactagtttaattttaggtagatgcttcgcaatttaattaggtaacattaggtggtttttcaactatagactttgggaaatattcatatcacctggatactttagaatggtttggttcttgtggaattggcttcacaccgctccttctattcaaaatccccaaaatggttttaggctgggctcggggtgcatggttttgatagtagcacctcggccatataaggaccggtcttcgggtctctgttgcaaagcactaccgtacttccacatgtctagtgggtaaggcttagtttgtggctcagtctggttataaacaaaagtacacggattggggatggatgaagtcgggggtcgatggacattctccagggcaaatgaaggctacacgagctgcggcccggtagtcgagatgtcgtggcagagggttggtgccctgctgcttggggctcagtcctgcctgcctgtcccggaggttccggccgaggcgggattgggtcggtactcttgt

SEQ ID NO: 69321 - DNA, 2027 bp, Oryza sativa
gggtggagctcgtcggcggcggctcgcgacgacctctacggcggatctagaggggggcagcagcggagctcagggcggagctcggcggtgtcggtgacggttctgaccgcgcgacgacggggcggcggtggccaaccgtggcgacgacggggcggcggggctggccgcggcgacgacggggaggcgggggccggccgcgcgacgacggggcgacggtggccggccgcggcgacgacgaggtgacgacgccctcgtcacatgtgcatgccgcactgctgcatggagagagagagagggggaaacaggcgtgggtcccacatatggctagccggttttggctggccaactttagctagtctggtggggaatttagacagccggatggcttggagaggcatttggctagtctgttggagtagattttttttgtgtaagttagccaaattttaacttagagagccatttggctaggctcttggagatgctctaaggcctataactacaagatcattcagaacgatttgatctccattgtttgcacttaagtttaccagtacgtcgttagaaattgaatttttaagttgctcaaagtatatgtatataaaatttacacattattttttcgctattaagcgttgctgcttatccaaacattagcattgtttagataggtgttgtattcgctcggtcttatctctattctaggtttcggcaataaacctactaaatatactttaattaaacgtatagagaaaacacctctagaactatgtatttacggttaaagacttttgtcctacttgctagcgactcaattacatttataaccttcctagccactttcctcattttcccctttttcaacatttcctcttcctctcccctgagggtgcgccaccctaacccgatcttccctatctccagcgtcacctccatctccctaccctacgatgccactcaagctatcctgttaacatagaaccatctcgaaattgcttcgtagtcatcacgcgacgtgtgattcgttagaatcgctctttgcagatctacctctcagtgtccaaatccgatctgtttattggtgtcaaattttattgtccactgcaacatgcagccttgactggccggtggtgggggcggttgacatcgttcggccacatcgtcgtcataccgagcaatcttcgctgaccataccaccgtttttctcgtgatgtcatatcttcaggttccacttacctattctcatcttctcttttaagactatcctattgtgcttgtctcttggacctcctagtctcttcccgagacaacgttttctctgtaggacatgctgataccgagacacctcatccctttcaccgcggtatcaaacccatgtaaaaataaaaagcctatataggagttatattgccggggaaactttttttcttaaagaactacacgagttgtggaatgtaattattatagggtcacattgctggagatgcgagtttttttttttttacttttagaactttattacgagttgtgaatgtaatttagttcaagtcacatggtcttttcaccattgacacggcacccaagcgaaccggagcgcgtggaagatgggaatcgcccctccgcggcacgagtccacgacggcaagaaaaagcgcccacccggcccacgcaaaaaaaaaaacaaaaaaggtagcactccatctgggcccacctgtcggcaccgggcgcgtagcgcgttcacgcctcatcacagtagtatcagtagagagaaagaaagaaaagaaagaaaaaaaaaaaggaaaaaagccgacgtaatcaatgggggacagcgcgatcggtccaagttaccgtcgttaaacgatcgcgagctccgcctccgcctccgcctccgcgatccgcctccgcctcgagcccaaacccacccaccaacccaacccaatcccatcgagaggaggggacgcggcggcggcggcggatcggcggcgggggaaggaaggggatgggcggcggaggcggggagtatgacgg

SEQ ID NO: 69322 - DNA, 615 bp, Oryza sativa
acaccccgtagaacgcgaaccgctccgggatcttcaacgcggcagatccccctttaatccatgacaaagtcaccaccacacaactcgtacgcatcgatgattctcagatctggcctgccaatctagcgcactacttgcctatgatgaagagcgccgacctacaatcgccggtggagcccgggagggcggggcggccgttgaggtccacgaggcggcggatgttgctggccacatccccgtccgccatgccgtcgtccagtgcgagcagcgggtcgtaggagccggagtcggagccggaaggcatcgtcgccggccggctttgacactatatatatgggcagctcgctctctctctctcacgcacacaactagccgcagctcggccgaaactttcgcagtcaatgcctactcactcacaccttggcttggcggcggctaaaataagcaaagcagcatgagaatcggccgggaatggatctcaacagaaaataagcgccaactggcgcgctcgatttatatcccatttatattatttttgtgttattaattagcacattgttcataaaaaatatagaaatcaatttaatttccttgaaactcataaaaaatcgtagg

SEQ ID NO: 69323 - DNA, 21002 bp, Oryza sativa
ggctccgccacttagatcgatcatgggagtaagaatcatctagatctggttcgaacaagacccaatcaccttacaaaccgatggacgcatgagcaaattggtactttccacgctatttctttcttcatttatatcggatataaaataatgtgtttgatgttcagcagctaattaccatattttcatggtatcacgtaacacatattccctctatcccaaaatataagcatttttagaatagtgacaagtcaaacatttttaactttgattattaatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatattgtttatattttgggacgaaaggagtaggtgtttttatatcttgcagtaaatatcacggactttaagtgtcttcgcaaatttttccaaagacttataaatcaatactcgtaataaatacagagattacgccagggagctaatcgcgtacaaccgcgcacctacagttgtggccagaaaacgtttcgcgcgcccacgaggcacgtgtttcagttgatactgttggacgtaaacccgtcggcccaacaaccagacaagaaccaatcaaaaccactgcaaaataaagccgattttggtatacgtctcacgacagattttttgcctcaaatcacccgaatttgcttccgtcggatctcttgggcatggtttaatttgacggtcatgatttatccccctaccaccgcggcaccacctagcagtatctttaccgggcacacaatgaacaatacaaataaactgatgagtacgggcaaaaatatgaacaccatggtttaatttacagtgtatttttattaaaattacagtgcatctacatgctatatctactatttttacaaatgtaattttagttataaagcactgtaattttagttataaatgcaacatttaacacttcagatacctggacggtttctcaagcagtgcatttgtactaaaacgacaaatattctagttaccaaaatttacagtgcatttgtacttaaaattacggtgcacttacatgccatatttattgtttttacaaatgtaattttagttataaagcaatgtaattttttgttacaaatgtaacatttaacacttcagatacctggacggtttctcaaacagtgcatttgtactaaaacgacaaatattctagttaccaaaatttacagtgcatttgtattaaaattacagtgcacttacatgccatatctactgtttttacaaatgtaatgttagttataaagcactgtaattttagttataaatacaacatttgtgttaatctctactaaatactactctattaaccaatacaatcacaagctatacctggacggtttctctatatttttttaatggttagatgtaaatataaggagagaaaaaatattttttctcgaaaatcacacgacatatgtctagacagtcccaaataaagcagtagaaagcgccaaacgcctccgaatcagtaccccttccactactactgctcgtgctcgatcggccaaccatggcgtcgggctccaccgatcccctcctcccccgcgccggcgccgcacgccgccgccccgccaccggcggctggaggtccgcgctgttcataatctgtaagcacagctgccaccccagatcgcgtctcctcgatcgaaagctttgcttgaatcgtctccgctggtttttaggggtggaggtggcggagcggttcgcctactacggcgtctcgtccaacctgatcagctacctgaccggccctttcggggagaccaccgcggcggcggcggcggccgtgaacgcgtggtccggcgccgcgtcgatgctgccgctgctcggcgccgccgtcgccgactcgtggctcggccggtaccgcaccatcgtcgcctcctccgtgctctacatcacggtcagttgagtttcagatgctaaccgaacagcaccgtaccctccagccttatccattccgttctcgatctcatcgatgcgttttctttggggattttgttcaacctgctcaattccctccgtacatttgctacttctacattttaacctattgttttatttgttcaacctgctcaattcctccgtacatttcctacttctacagtgatccttgccataatttatcagtttattctaaaaaaatatttattagccatcttgcgcagagttcgatatagtatcaagggttacgcctagtgacctgagtagtattccaaagatcctaagttcaaatcttctatgcagctaattttaaattgggttatttgtggggctaagttttttatttcaatggtcgtatatatctggttggacgtagatgccagttaaaaaatacccttctcttaaaaaaaaaaggatttgagagatctcccacgcaatggcattatccgcacgcggttagttggaagcattttccgtttacgctgcgctgcggatggaaagtgactttacacgcaagtccaagcgaacccgttctgaattgtgatttactgaatttaacaagactttgcgtgcagctgctatcttattacgcccaagtcaaatgggcatggtttttcagttgatattgttgcacgtaaacagcatttcctgacgtcccgggagaagtttcagtttcaattggttaatttaattgtcccttaatttatagcctgggtcgtgtagtttccagtggccggtagtgatcatgctcaacacgttcagtggagtgagaggacgtatcaggcatgtgtttatttgcatactagtctccaaatattgttttctaccaataatagggttgttgctttcaatttagctagtagtctattttcgaaggaacagggtagtagagccagccacatcaataatctttcatgccattgtgtttactgtttagtgataggatcacaccgcgtcttgcagaaaatatttatgtacctgcccattgcaattgaagttcttcagctcagtgtctgtttggaacacattaatttcacatggatcagtgtctgtttagatcccaccctaaaattttacaccctgtcacatcgaacgtttgaacacatgtataaagtattaaatataggataaaaaataactaattgcacaaattgcgactaatttgcaagacaaatctttttagcctaattgctacatgatttgacaatgtacttttacagtaaacatgtgctaatgatgaattaattaggcttaataatttcgtctcgcagtttaccgacattatagatggccatctgggccgcccggcacggcacggcccaagcccggccgtgcctgggccgaggcttgtcgggccggcacggcccgaccgatgcaccgggccgtgccgtgccagcccacgggcggcataaacggcccaggcacggcccaatactagtcgggccgtgccgggccggcccgaaggcacgatgggctattgtgctgcctcacagaaagagtttatatttggtccctcaactctgtgggctgtgtttaaatggctggaaataagtctatttttgatccctcaactctgtgggttgtgtttaaatggctggaaaataagtctattttgtatacctattttcttgggccatgccttatacggttatataagtctattttttgtccctatattttttttatttgatcgggccgtgccgggccggcccaccgtgccgagggtgcagcccaggcacggcccagctatcgggccgggccggcacgggcacgaccctagtcgggccgggccgtgcttgggccgggccaaaattgcgggcttcgtgccaggccgtgggcctcgggccatatggccatctataaccgacatactataattagttttttttattagtgcccaaacaccctatgtgacaccctatataatacctgatgtgatacactaaaactttgcatcccagttcaattcttgtttgaatccggtaaaataccgacgttacaattacggttttgcatgagaaaattcctcggaacaggacctaaatatatttgatctcgcaaactgcgctcacctattcaccatggccaaacaacggcagggactgggcttgctagcgttgtcgtccacgttctcgtcgcctcagagccaacaatgcagctcctccggcgatggccggcaagtttgccggtcttcctccgtgcagagggccttcttctacgtctctctctatttggtggccatcgcccagagcggccacaagccgtgcgtccaggcgttcggcgccgaccagttcgacgcgacggaccccggcgagtcgtcgtcgcggagcaccttcttcaactggtggtacctcgggctctgcgccagcgcgaccgtcacggcggcggtgatgagctacgtgcaggacaacgtcggctggggcctcggcttcggcgtgccgggcatggtgatgctgctcgggctcctggtgttcctgctcgggacgaggacgtaccggttctacgacggcggcggctccggcgcgttctccggcgtcggcgaggccgtcagggcgtggaggaagagccggcggcgaggagaaggcggcggcggcggcggcgccacggttgaggcggagcacggcgagctcgcggaggaggtgagggggatggcgaggctgttcccgatatgggcgacgtgcctgctctacggcgtgctgttcgcgcagccgccgacgctgttcacgaagcaggcggcgacgctggaccggaggatcgggccgtcgtcgtcgttccaggtgccacccgcggcgctgcagagcttccttggcgtcagcatcatcccctgcgtgctgctctacgagcacgtcctggtgcccgcggcgcgcagggccaccggcgtcgccaccgggatcaccatgctgcagcggatcggcgcgggcatcgcgatgtgcgcggtgacgctgctggtcgccgcgctcgtcgagatgaggcggctgagcgcggcgagggacgccgaccccggcgcggcggtgccgatgagcctgtggtggatggtgccgcagtacgtgctgttcggcgcggcggacgtgttcgccatggtcgggatgcaggagttcttctacgaccaggtgcccggcgcgctcaagagcctcggcctcgcgctctacctgagcgtcctcggcgtcggcagcttcatcagcagcttcctcatctcggccatcgacgtcgtcacgaggagggacggcggcaccagctggttcgacgacgacctcaaccggggacatctcgactacttctacctgcttcttgccgcgctcaccgtgctggatcttcttgcttacgtatatttttcgatgtcttatatttacaggagaaaggttgtcgatgttcaatgatccatggatcgatgcacgcaatgcgcttgtatagatgtatattaacctgctgaattcagcatggttataacagtataatggcaatgccaggggtaaaatattggtgtaaaattccctctttacctttattttccttctagttacaaataaagaagtgagaatcgaaattcattgcctgcactcttggtggtccgccctttaaaccgtagtacaagcacatcttctatcccttggattggtccggagataaaaaaaaaccattcagataattatgttgaacaactaatcggcctaatttgaccaatgcatttgtgccctcgccatgtgacagttttagtggtgaaaagttaaaactgcagcgaaccaccaaactaggtgatgattctcgtaaagcatggccatgggcagagcatggtgtcgccacgttcaagcaaataccgaggaacgtgatatagcccgtcttaggggaaaaaagaagtacatatggacaagcaagtccaatggctacaaactaaaaaacacgggcacacaacatgaatcttgattcttggatttgatggcattttcttttctactatctgcgaagtggtgcagcagaatccctcgagttcgtcaatgtcttccctcaagtgtgcttttttaaagttagaacgaacactagcgtggcgcctcctgggagtcatggaccatcggaaaagcctctgaaacattcgtggcaccaatttacttgttactggcatcaaatatgtcctaacatttttatcttgaaactatcttattcccagttcgatgatacgatgaattgctctcgcagcagcaacagaagggatctactagcaggaatgcaggacaacagaagtggtctctgcctctctcaactgagagaacaggatccggcaggaagcataaagcacgaaaagaactcttttggctgaaagctgtgtcccaaacaaattgttcatgggtcaaaagaagtcttaaatcgtggaaagttcagcattagtaagattttaaaaatcgcgtggagactccttcaatcatggcaaagtctcagaaattgatgggataataactgccagtagctcaaggcacacaagcatctgatgttctcgactctcaagccaccacagcataaaacgtgtaaagcactggagctaaacatacactcaaacagggatttggatcctctgatgcctacaaaggcagaggagccggatccctcaaacagacactggagctttatccctttatcccctctcgaaatagtaattcaacaccggataaaaattgccctgatcaaatatactgaagtagtagtagcaccaaaattccatgtccatacaaattctgatccattgcctaacattacgacggatgcagagaagccgtagagcatagcagagcagagctgacctactcgatcactcactcactcaccagtgtgaccagttcactcctcgagctctacgaccggctcgggcagcgtgggcagcacggggtagttgcgcgagaagcaggcgtcgcagtagccctccgcctcggcgccgtagatgctgtggagcttgccgagcgagaggaaggcgagcgagtcgctgccgatctcgcggcggacgccctcgagatccatccggttggagatgagctccccctcgctgggcgtgtcgatgccgtacaggcacgagcccaccaccggcgggctcgcgatccgcatgtgcacctcgcgcgcgccggcgtcgcggagcagccgcacgatcttgctcgaggtggtgccgcgcaccagggagtcgtccaccaccaccacgctcttcccgcggatcacgccgtggaccggtgccagcttgagcttcacggcgaggtcgcggatcgcctgcgtcggctggatgaagctgcggccgctgtagtgccaccggatgaggccctgctggaactccagccccgacgcgcgcgcgaacccgagcgcggcgtagaaccccgagtcgggaaccgggatgaccacgtcggcgcccgcggcgggggactcctccgcgagcgcgcggccgaaggcggtgcggcgctcgtggacggcgtgcgagaagacgacggagtttgggagggcgaagtagatgtgctcgaagacgcaggagcggcgggggcggtgcgggacgaggcacgctgaggagacggacatgtcgcggcggtcgacgacgaccacctccccgggctccacctcgcgctcgtaggtcgcctcgatgaggtccagcgcgcaagtctccgacgcgaacgcgacggtgccgttgcggcggcggccgagcaccagcgggcggaacccgtgcgggtcgcgcacggcgaacatcttatcggccgtcaggaacagcagcgagtaggcccccgcgaggcgctcgcacgcgtcgcagatgcgggacagcagtggccgcgacagcgacgtcgcgatgaggtggaggatgacctccgtgtccgacgaggtgttgaagatggagcccctcgcctccagcttgttccgcagcgcctggtagttgacgaggttgcgttgtgcgcgacggcgacctgcccgaacctgtacccggccaggaacggctgcacgttccgcagcgacgcggcggcgccggcggtggagtacctcacgtgcccgatggcggctggcccggggagcgatgccagccgtgcggggtcaccgaacacgtcggcgacgaggccgagcccggtgaccgacttgagcttcccgtcacccccgacggcgacaatcccggcaccctcctccccgcggtgctgcagcttctgcagcccgaggtagcagagcgacgacgcgtcggggtcccccacgaccccgaccagcccgcactcctcgcgcgggtggtcgtcggactcgtcgtcctcctcgtaggagaacggggtgacccggtcgggcagcagcgccccggccgccggcaaaaggcgcagccggggcagagcgagagaagacggcttggaggaatacctgagctgctgctgctgcttcgacccgtcggcggcggcgtggtggtggtggcggaggaggagaaggcgcgacgttgacgcggcggcggcggcggcggccattggtgagtgggggaaggggagcggcgcgagggattgggggggaatggatgggtttcccctccgagggcgaggtcaaggggcgggatttaaagagggttttgctcgtcgccgtctctccgccgtaggatgcgatgtacggtgctgaatacataccatcggtatccgtatcgtatctcgtacgtgtaccggctgctgttgcgttagaaaaaaaaaaggaattctgagtgcgtagtggccgagctcgaggctcgaggagaatgggccactgatgggtgggccctgctatggtggagtagtagtagccgcctcgagcgctagtggatttgaccaggccgtgtgcaggtcggcatatggcggcggctggtccatttccggtccagggttggggtcccacgtgtgggtactgtgtcggtttcagacttttcagtggacacacacgggtgtgggctgtcatgcgatctcctttttgggctggagttactgtgggctgccatgagacctccttttgggccggagttactgtgggctggataggcggccttgtcggagacagtcacggctcggcccgtcccatttgtttgatggacccgaatactgtcgcatattgctgatttgcagttcccctctggtaaagtgcaagatgacgttgaggaggtggatgcgaagatgcccgtcagcacacaccatcacttttcaccttatcacatcactaaccaccgctaactaaaactctgaaaacacactaaagcatagaaacacataataacactccagtccaaggaatcagtcgttagcacggaggaacaaacaccacgttagcaaatacgggaaaaaaaaccctccagtacagcgaagaagatgaatgacaaaagaaaaaaaaaaggacgcacgagacagcaagatgcagagacgaacacaaagcaccagcaactaataaagcaactactgttaattcatacggagtataccccgaacacgacttgaagagtgacgaccaatcggcattcgagcgaccggctctcacaagtgacaaaaccgggagcaaaaaaaaacaatggaaaaacacaaggcggccacgcgggaggtccatcggccatcgcaattgaagcacggcgatgggggtatctgcaggttgtcccgccccgcagggaggtggggcctacgactacgatgaattgggatctggatcgcggcagaggcggggggagcgcaggaggcggcatgtgagggggcgtgcgtgcgtgcgctgtcgcggtggtggagccgtccgcgagatcgtgccatcggtccttcaccgtggatgctaaccacgctgcatttatatttgctgcgtaaaactcctctctgcttcccggctccctgctacgcgcacccgaccgtgtgattgatattgatactgataagcagtgacatccgtctgtaaaacatacacactccgtcccataaaaaacccaatcttatttacgaacctggacatatacgtgcccaggttaatagctggggtttgtcttttttttttggacatagtagtatttttttcaacaaaatacgtactaacacgtaaaagaaaaacagaatatgtagggtgacaactttcatgtctaccgaaattccaccgagtgtatttaatggtatcgcgtgatctctctttacatgagaacctagccatagtacattctcattttaccgtcatcaccttttctaccctagtgcgtgttgtgcatctaggggtgggcagaataagaccgaaccgaagagaccgagaccgagatcgaaaaattcggtctcaactattgaaagaccgaaatatattcggtttatttggtcatgggccttaattaaccgaattgaccgaaataaccgaattaggctcaatagatctagttggtccaataaacccactaataagaaatcctaggggcaggtgcgtcacagcctcacaggcatcgacgcatcgtttcatccccatccatcctggagcggcgccgtcccgactcccgtctccatcccatccgcatccttcttcgctccatcgtcgggcgccgcttccgcctccaccgccggcgccgcctccagccggcccggcgccgcctctagccagcgtgccttcacctccaccgcctggcatcgcccccagccggcccggcgctggctccaccgccgggcgccgcctccactaattgttgatttgctttgcttttgctgtttttacaaatagttttgttgatttgctttgtttttgctgtttttacggttagttcggtctatgaccaagaccaaaccaaactaaccgaagaccgatttgctcagtcctgagatttgttggagaccgatcggtcttgagattacaaagaccgaattttaaaaagaccgagaaaccgaaccgaatttttcggttagaccaaatacccacccctacgtgcacccgacactattggttcaatggcacacacttccgttaacaaactctatggacaattgtaggttggacatttgaaatgttgagtaaaaattcaagatcaacatatctttaattcaacccaatggcctactccctcaatcccaaaaaaagccaatctcccctcctagtacaacgaatttggatagccctttgtcacatcccctcctaggttgtttttttttttgggatgaacattatttaaaagtctgaactttttttatttaaaagtgttgtggcaggtttgttctaaacaacccggttacctccggcatttccgtccttggtgcccattgtgagtacaccaagcaaaatgtccatgcaaattgaagaataagatactcatttccacctcttcctctcaagttattacacttgtttccccccatttccctccaaccccggacaccccgcacacgtacgaacaggccacaaatcctcaaatatcggacagcgcagggatcgaacgcagaggaaatccaaaatccaaaatccgatcccctcgaaccaaagaattcgaagcgcgcaggcgggcacacgccccaaatgcgccggcggacgacgcgcgccgccgcagaagcagcacggcgccgatgagtcgcgcccctccggacgccgccggcgacctcttcgccgccaacctcaagggctccctcctcgccgtcgcctcctccgcgttcatcggggtcagcttcattgtcaagaagaaggggctccgccgcgccggcgccgccggcccccgcgcaggtccgccggccttatatttttcttggttctcctggtttgcagcctttgggcagcgcctctcgcgttcttttggtttcttgggcgttgttatgaggtcatgtggcgaggaatgtcctaaaggcgccccattttatggccaatctggtgctcttcgtcaacgatgcgctgtaatcattgtttgttcatggtgaatttcaggtgttggaggctatggatacctcttggagcctctctggtgggttggaatgattacaagtaagttcttgctttcttaggttgcttatttcttgaggggctagtgcaaaattattcgaaattcttgataattttttttccgaatttcgtagtgctcattggtgagattgcaaatttcgtggcttacatgttcgcaccggctgttctggttactcccctcggcgctctcagcataattgttaggtacaactgggatgtgttccctttgcttgtaaaatttcctggttagaacccatggtttgaattagttttaatctgtccatgcacatgcgtggtgaatgcgtaatctttgtggagcagtgctgttctagcccatttcatcctgaatgagaagctgcaacggatgggagtgctgggctgcgtgctctgtatagtcggatcaacagtgatcatccttcatgctcctgaagaggagacaccgagctcagtggagcagatttggcacctggcgacacaacctggtatatccttgtagtttccctttgtactttattatcgtcagtcatcacaattgtactttgtattttctgcagcctttctttgctatgtggcctttgcactggtggtctcactgatcttgatggcgcattgtgctccccgctatgggcagaccaacatagcagtgtatataggaatatgctctgtgattggatctctgacggtaagtgatctctatggactatgaaaatgcctttgttgttagcttggtctggtgtttaataggtttgtttatcttatttttgttatgctaggtaatgagcataaaggcagttggtattgcaatcaagcttacaattgagggcataaaccaggctggctatttccaaacttggttatttgcaactgtttcagctatatgcataattatccagttaatttacctgaacaaggtacacctgtagtcattttgtttaggtaacagaaatattgatgttaatttgcatgttcacatcatgataaactttcaggcactggacactttcaataccgcagttgtgtcccccatctattatgcgatgtttacatccctcactattttagcaagtgccataatgttcaaggtatgcaggttttagtaagttccacaaatgccagttagtttaagtccatttactagaacaaaaatttgagaatatgttttatggtttccaggattggtctggacagagtataagcagtattgcttctgagatctgtggatttcttactgtgctttctggtaccgttgtattgcattctacaagagaatatgatcaaactatttctccaggtaattatttctgagttttagtcaatcaatgcttggctattcttatatgagaagatgaatatttgttctgtggtacatcatgctgataatattattcatgcaaacataaataagtggttttcccaaagttgaagttatttagtcactgcagtttgagtttccaatctccttttactagccttgtggtaacaaagctggtgtaagttgtggttgttgagagttggtgctttactttagtattaaaatcactaccaatttgataattcctactgaaaattgtttggtttcttttagcagtgaagttactttaatcaaaagtcaatagtattttgcctcaaggagatagacttcgttctgttaacagtagttgtcataggcttactcattgccttcatagttatggatcaagaaagaaatggcctgtggattgaaaagtattaatcaagcctactatttatggtgtcttggcatatctgtccttttcaactgatttaaggcttgcctctagatagttatacaatgctaggaatccctcactttttttagtgcatgttctttaaaaaaaggaaaagtaacggcaatgggatttctccaagatattactagcacttcacaatgtctatgatattataggttacccaatactgttatcatatatatagagtggtactgtaataatttcctgtttttatttttttactacagacctttatactcctcttcccccaatatactggcatatccaagggaacggtgagacggtgaaacaaaaagaggatgattcactctctgctgacttcatcaccgtggtgcgacaagattactttgtctaaagaatagagaccgtcctgaatgctcggtaatctcctcaatatcgtctttcagcagtgacaagaccaaatcaactgcaaattgtaggattgtaggattagctcgtgcatgatcatgctgcatccaagccaacaccctccaaaggagcatcgaagcagcctggcttttttttgcccatttgcacgaaacaaggtcttctgcttgtttatcaaggtggtgtgacatgatctgttatgtgtatctgttcctttgattcgaggagcaagtttatgaggctgctcttgctagtttgacggatgtttttttggcttttagtttttgaggtttgtctgttgatgcatgtatattgtacagtctaaatgaatgtaagaagctagatctaccctctttcggtgaggttgaaaccattcatgtagcctactagcggttgctcaccatattagcgctgcagagtgtgaaactctgctgttacagttcacattggcatagcattgagagtcttggtatttacttacagtgcacattagctctttaagcttttctgctgctgtcctattcaactcctgacatgtaataattactgttcccgtgcaaatattgctgaaacttgaaatggttattgctgctgtgtgctgtccaggaaaagcacaattttgctcatctattctattatatactaaaagtctattaaacttcctacaaacgctcttaaaccgccacatggcatcctacaaacgctcctaagtcgccacatggcatgctaataaataatagaaattcctagaaattctaagaaaaaaacaaaacatctgtccatccgttttcattaaaatcagtggacccaatgtttcaagccgtcagatttatcttaaaaaaaaaagctttccacctccacctccttcctcccacacgtaacatcactttccctttatatgtagtcacgtataataaatatataacaattgatttacacatgtacaggtgtagaatagattagatcaaatcatattaaagtaattaatccctctcttctaatctcatgtgtatttgcgagagataaataaatatatactattcatccggagaaaatatatgtatgtatatatgcatgtacatgagactattatttggaaaaaaaaaaagaaaacatgcatatgtccgtacataaaaaaaaccatattttcctacaaatactcataaaccaccacgtgtactcctaaaaacacttctaaaccgtcatgtggcactctaattaaccggtggacccactattttagatttttcagctattagatttacaattatatagtggacctgatattatacgtcattagatctatttttcaaaaaaaaagaaaaagaaaatagcatcgatcccctcccatcccgcttaagtacatttccatttacgtgaactccatctgtgtacgccctcccctctgttccttttctctcctattttcatgattttcatgctattttagttagatggaaattagaatttataataatattttttctaaaaaaataaaactaaatcactgtccttttgtagaaacggacgtatgcctcctccttcgtgttccaaggccggtgtccaccctcctttttttatatattatttaaattcaaactagactgaatatttttaaccattaaattattaaattattattattatatcaaatagatttttaaaccttttgattaacaaaatgcactaaaattagaataatttaagtagtttaattagaaaatacagcacccaaagtattttaaattagatctaatattaaatgtatttataaaaatagataactctaaattatagtgcacattcgatctattttaaaaacagtaatctcctcccatcatcctgtctttcgtaataccactctcctcccactctggctcttgcatcctctcctctccaatgcaattatcgtctcttttattttttttctaactaacataatataaaaatagtcataactattattttatttataattaaacattcattagctatattttgctatataaaagttaaaatatatcatttgaaggtggaccctatcgtttgcatgaacactaaataaacacgaaaattaattgaaaatatgtatcgtgttatactaaatcattgtacacaattaaaatcaattaaatgccctcaagagtgttcgtaagtcaccaactacataattaaagcaaccataagctacatatatggaatactcctatgctttttaaatctgtgaaaccattatttctaaccattagatctatcttatatataaaaaaacaagcgtgtattcatggtacatcacattttaaaaatattactgtgtaattatatttcgtcgttatcgtattcatgttaggttgcgtggagcctctcactcactctatatgaaatgaatgttcaatggatcatctctcaaactacatcaatcattttagtctatataaacctgtcccacccaattcatcctttagtacactatgataatatatatgcaactaaaaaaagaaaaccaacttacttttactgacatgttttctaaagaaaataagtctaccttctttccaaatgatgaagaagattataaataattgcttatagatattacttaaatatgatttaacataaagctaataggttataaacttataaaagcaattaatgccatgaaaacaatttatagagaaatcatgagaggtgttctccggttaatatttcacttttataagtatcttaaacttagcgtacgacacatgcccgcgcgaatgcgcgggctaccttcctagttcaaatttaaaacacataagttttctacagtgatgtgcaattgccatggttttattgtagaactccatataatcgtgtgcacagaacactgataaccatttcattctcctcaaatatgaccagataattgttcagaagctttatttaaccctttcattccactcaattaggaacaaaccaatcaaaaaatttacatcaaactgcttatataagtacttgtaacctacaacgttattaccaaatttttttctactacaacttatcaaatcagatgctactctacattgtaccctatgagaatgtgttctatcttgatgcggttcctttcaaggctcctctcgtgtcgtcttccgccatgggcggcacgggaggcaacgacccggccatcccttcaccctcacctccctcctccgcctcgccaccgcccgagtggccaccagcaaagccgcgcggtaacaaggacggcggctacggggcccctctctccttgcgctccggtgaactggggagtcatccagggaggcggcggcgataaccgccagatcctcgccgctccggccggatctggcggggacagggacgacgtcgacggcggtggggatggcgatggcggtggggatggtgatggcggcggggatggcgatggcggtggcggagtttgcggatccggcgacggtgcggcgtccgacagtggaaggatcatgcggcgtcggtggcctgtccatcgcccgatgctgccgcttgtggcgtctgctggcgatggtgatgcaaggaggacagccggattctgctcctctaggtccagatctggcgcgtcctcagtcggaggtcaggtggtgtggagtccggtcgtcgtgcaggtggtgtgaatagtgccgatacctttcggtgtgcagttggcatttgggagcttccgctatggatgctttggttaacagggtctccgaggtgaaaaccttgctccgcttctggtgctagcaacggtgactccctcgagtgccgttctccttctttaaggcgttgcttttggagccctcgtttcaactccacttcaagggaattctccgggtgaaaactttagattcgttaggatcggaagttgccgtcgttctgtcggcgttaccttcttgaaggctttgttttaggagtttcttctctttgttggactactgttctttggttcagtttgtcaatgccgggttttcaccggttttcatgaaattaaccgtgttgttgtaagatttttgggtccagttttccttataaactggatcgactatcttcttctatagtgaaattgcaggagctccctgcatgtcccctcgaaaaaaaagaatgtgtttgaccatgaaaaatctacggaaccctaacttcagacgacccatctacagatatgcaccctgctcaatagagattgcttgcgtccgatctatcgagccccatcaagaacataggcaatggaagcatgcttggctccggcgaaacgaaggacggtccagcgaactctggcgagcgaaacgaagcatgctcatatagtccttttgctcccgccagggcccaagtcttggccttctccttgatcttggtcaccacgtttgccgctaagagttctttgtgcctaaagactctctggttttgttccttcaagacttcccaggccgttaggaggatcagggtacgtaatccttttttcggcacccccttggtggtctctagccctatccaccattcgtgtaccgttgtagctgggccccaactttccggtatgatatgttcacgggaggtccaagccaacaacgttctccaaattctcgtcgtgtaccttcattccatgagaaggtagaagatcgtctctggggtatgcctacaaagcaggcaataggtgttgttcggccatccgtgagttgccagtcagtcagatgtccaattctattttgcaccaccagccaggcaaaaattttacactttttaggtgcccaaggcttccaaatgatcactctatagtttgtactggttgaagttttgtacgccaatgccgccgtgtatttcccgtggtttgtgaggttccaagtgacgtgatctatctcgccgtcggtgagctgcattccttgaattgcattccatacaactgacataatgccactagctgagaggttgaggtcttgtaatggcaaatagttgctttgaagtccatgtgtgtaaatagagccattttttttttgaaaattttgcacagccatagttgacatgaaaaaaacggaaggacgttcaccccagtgcttaaaagagttccccccccccattttattgttgtacagtagaattgtgaatcggagtcagtgcttcattcaacataccattttacatttctttctcaagtatagcatctcaattgataagaaactatttttgacttcaccccagtgcttaaaagagttccccccattttatggttgtacagtagaattgtgaatcggagtcagtgcttcattcaacataccattttacatttctttctcaactgtagcatctcaattgatcagaaactatttttgacttcttttcagtaaataagaaacaaatcagtaggtgaacttacatcaaactgcttacagaaatagtgacattcctgcagttgcagaagtagtaaacaaaaacctactgtccatgcaactgagatgctactgctgaactgcattacaacctgaagactcttttcgaacatatacagaattagggataaaggacttgacaatgtgattgagcacaactgcacaagaaccctattaagtcctaatgatttatctacagacatgaaccctgctcagctcgggagctagctttcctccattgcttgcgtctgatcggttgcatgctagcgagccatcaagaactttgggagaggaagcatgcacggctccggcgcgacgaaggacggtccggcgaacaccgcgtgccgtggcttgctgatctccttgttcgtcgtcagcctcatggtcatggcggcgttgcggtcctcctcgccgtggagcgcgtccgcctgcagccacggcttcttctggatgtcccagcgctcgtcggaggacgcgcggctcgacgacgtacgaccgcacggcgtcgggagcagcgcagggagagcggcggcggccacgaactgcgccgagcgcgccatctctcgcggcgaagcgcgggagccgtgaacgaacgaacgacacagagcccgagcttgcggagaagaaggtgcagttcgttgtgggctcggaatacgacggcccactcggcccagtacgggcccatacaggcccatctaggacgaggagtaaatccacatctcggcggagatccaacggccaggatgggagcaaatatccactacactgttttaattggagcccacccgtttcggctatctcctccactatccccccctcgccatggcagccgcttccttggctccgcccaccgcctccttctcgccggcgccggcgccggggagggttaaggcggcggcgcctttgctctccaggaggcctcccgggcggttccttctcagggtggctagcgaatcctcctcggttcgtagaccactccaagctcccgattgttttacaaccgctgtttccagtggttcttgtcttgtttctggtttccactctgctgcgtggatttggttcctgtgccggcattggggttggttcgatatctactgtgtggataaatccctagctccggggtccggggtcttgtcccgcttccatttaccctttcttttactaatttgcgtctgtttatggcaattcttggtttggagcaaagctcatttgtgagtagtaccatcctgacatttcgctgctttgatcgtcttatgcttgtatgattagatttctggtgacacgctgctgggattgtatgagaaagagaggttaagccactcgctatatgctaacgaagattacgacaaagagatgttctgggacaacttggatgcggatttgcgctactggaccagatccctgcgcccagtgcaggtatatataaggtgtgctttagtggaatttaacaagcatatgtgcggaatcttgtactagctctaatg

SEQ ID NO: 69324 - DNA, 1438 bp, Oryza sativa
aaaaataactcaaagaacaattgagaaaggctttgtttcaaatttctcattttgttatatcttccaatgggagccgccgccttggagatcatcgggaaagagagaaaaggggagaggtggagacagataggggaatagagtagagagaagggtggaggagaaagacgatagccactggtaaataggacccacgtgggctctatcttttttctttcctttactataagtgccaagtagatgttatatgggatgaaaaatctagaaaacttgcctatgggtgtaacgtaggacggaaccgttgttcaaaccatcgagggattcaatttacacaaattttagtagttgggagacgttctatacctagttttattatagttaagaaatgcaaatgtaactcgatctatagttgagagggacacaaattggattttgttttcttttcgttttccttatgtcgatcaattttttgttgacgggttgttactggcccgacatttgatatgccgttttgggatgcaaattttgtaagaataagttcattttgtccctcaatttatcgtcgaatttgaacttcatccctaaaccgaaatattagttggtccctcaatttatataaccggatcacccaaggtcctaggcaagaagagggaagatagagaggagaagaaagtgctagtcactgacatgtggggtctgcatgggtctcacgttgactaagcttgtcatgtcagctaaaattgagcataatacggttttgtaaattgaggaagtcattatatctgctatttcggtttagggacaaatttaggactcggcaccaaattgagtgaccaaaagtgaacttattccaatttcgtatgttagaccgtttatgggctggcattttgacctgaggtcgtctgtgcgtggaatatttcttttgctgggcctttagtgggctgcgcttgccagtaactctctgtggatgggctgttagaattttggaaacttttcttacgctccgggccgttcatcagcaaacgatttctttaggtgagctgttaatgggctattcaatgtgcgttgttaacgggcttttctttccactgacgaaggcttcaggcaatacagcacacacttccaatggagtataaaacagtaccacaatagactatgccttgtggaaaatctggacacaatatactaatactatgcaggcgctttttcaggccttgtggctgatctgtaccaaattcgaaattcatgaatatttaggccaaaggtttataatcacggaatatcaggtgaacgattaacatatattcatgatatcccaaggttaatagtcatgaaatttttagccaagtctaacattcaagcattttttagccatggtctaagagcctatttgggggagcttccattaactgcagcttctccgaatctggaaaatgaacta

SEQ ID NO: 69325 - DNA, 576 bp, Oryza sativa
aattccaaatcactgttcatagctgaggctgcatacttaactttttcaggacaatggcagctacatcatgcaaacagtaggggagccaaggcaagaactgttcaatcaagtggtgctcaataattacatgtgctctttccagtagggaggagagggtgagagacaaaaggctaggagaagggaccctacattgacaataggtaatgtagcaaaacgttaagtggaagtccttttgctatcttcagttcaggattgtgtaatctaacatcattatgaaaaaaaaatagtagtaccatgtaagatacacacttagatactcaaatttcataagactgcagcttgagttccaaaattgctcaggtttgtgtaatctaacatcattatgacaaaatcaatgccatgtgaaatacaatgttgggatactcaaatttcacgagactgcatattatttagaaaacggataacaatccggcctttgcttcaaagaagatacaaccacctagttacgatgtttcagtccagacaactccaactgcatatgacaatcttgagtttcaagttcaagattagtagtag

SEQ ID NO: 69326 - DNA, 1561 bp, Oryza sativa
tgttttctcaagtcaagagtctacttatctgttaactgttatcattttcgtgtacaagtcggaaaacgaaagaatttcctccccattaattcctacagaaaatgaacctcatccaccaaatccctagaaatttaatcccctgacaaataaatccgaattagcaaagtgccatttttttcttcgttcttggctgtaacgagttgatggcgcagagtacaatactgcacgtacatatatacgtgtgcgtgcgtgcgtgcatgcatgtataatgatgtggcatgcaagaggcaaacgcacgtactccatccgtcccaaaatataagcatttttaacacaataacaagtcaagcatttttaactttaactattaatagcaaaaaaaaagatcaatgttactagatttatcattaaacaaacaattataatatgtaactctttttattaataatatcttacttttatagatatttattggttaaagtagcatctcggagaccgtgtcaaagtctaaaaatacttatattttaggacggatggggtacgtatatacgtatccgtcggagaagaatacgatgcaactacggcagtatcgtacgtatacgagcagagcaggcatgaattgccaagcctagtataatatagtatccttgaccttttagcttgtttgtgcatgcatgaacagttgatccagtacgaaattaattagctgcaagtatacatacatgtcatctcgaggtacgtacgtgagtagaatttatgtggcaggtcaatggaagtgcaaatgttgaaaaatgtacgctttggatacagtgaatatatatataatcatacagaaaaaaataaaaaaaaatcaagaacttgtacagagaataaacaattatgagcaaattaaagctaggcagtgatctgtacagtgacacatgaaggctaggtctaaaaggctcaagtactattccatctactacaatggatgcacggtcagtgatgagctctcttcttacacgcctccaaagtacatgaagaatttgtcagtacggcactaggtgataatcaatgaatagtgatcgaacatcaaaagatatatacgtgtatataattatacatgtttagagaaaatcgacctattttacgtcactgattttcaccggttccatgatttgtcactgataatattcctttctgtaatataacattaatgaatcaatgatattgttactttctctaatatatattacattgagtttatagtttctataatatgcgattaataagttgggccagatacttcttttaaaaaataccaaagacccttatagatgttaaagattgacaactaacttatccgagtgaagtttgaaattatgatatttttatagcatccttatacgacatagaagtatatgtataagtttcaagatttttgcattattattattattattattattattattattattattattattattattattattattattattattattattattattattattattattatataaaatatgatttatttgttatatgtttttttttgcggggg

SEQ ID NO: 69327 - DNA, 669 bp, Oryza sativa
attcctgcagcccagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatccatgaaaacgaccgggttttctgaagaacattcagggagacgaaatgcttggatggatacatacatacatacatacatacatacatatatatgtatgtgtgtgtatatatgtatatatatatatatatatatatgtatatatacatatatgtatatatacatatatatatatatatatatatacatatatatatatatatatatatacatatatatatatatatatatatatatat

SEQ ID NO: 69328 - DNA, 692 bp, Oryza sativa
catcagtgaaacttgagagattaaattagctattcacccaaaaaagtatacttaattctgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggt

SEQ ID NO: 69329 - DNA, 738 bp, Oryza sativa
agtagctcatcatttgagtttgggcaattgttggacaccattatgaagcatatgttggccggacgggaaaagaaagatgatgtaaaagaggtctctcctatcaggcagttgctgccatgggcaccgctctgtagcacgcacgcttcgctgcacggacaatatcgcaacctgcaacacaacaataacgtcgttaatataaatgaagataaagaaatgatcagcatagttgatccatataagggataatatgaataagattaaggttaaaagatccatttttataaaattgttttttttggaatattcactttcaaactaagaccacttgtcttcttcttctaatatttacaaaaactagatataaagccatgttattaccctaaatataaaaatattttttgctcatttcgttgttaaattgtatctagtggtccaagtttaaatggaaacaaattatagctatcaattattaaaaatggagggagtacaaccttgactattaataatgtttaaaatatttagtttgaagaaatatttataaaattaaatatttaactgcagagattctgaagctggttcaactgccgtaaatgttcttttggtgatggctaacaaacaagtgaacatcacttagtatacataggactgctttaggtcccaagacaaaaacttttcaaccatcacatcgaatgtgtaaattgtgagacgaatcgtttaagtctaattgcaccatgattt

SEQ ID NO: 69330 - DNA, 5106 bp, Oryza sativa
tccgagggagaggagcggcgcccgacggagtgtagttgggcggccccttagtccccgcccccgccgccaacgtggcgctccccttcccgtcccggtctcccctgccgccctcgattcgctcccctccccttcccccgccgaccgccgctcccatccccacccccgccgccgccgctctgaaacgagccggtgttcctgaggatgaaatggctaacctaaaaaggcaactagcgccaggaccttccacagctccaccagctccaagcactgctactgctcctgctaaccggatgatgaactttgtcagtgctggagtgcaggcataggctgagagcagcagcaggcaacaacaggctgctgctgctaacaatgaggatatcgagctgcctgatgagagcgacgaggaggaagacgatgaccaaattgcgaagaagagtgttcccgctgcggtgtttggagagcttggcaacagagctgcagagaacagggaggaggaaagctctggtgcccaggagaatgggcagcttggcgcccttgagaggatcaagcgaaggcgtcaatgatctgccactgtcaagatgcccacagagctggtgcccttgtaacaacttgtaaacatgattttgagtggtgtttttgctcttgtacaagaatttacgggagttattaatccgttattgatctgcgaccattttttcgtgtactaactattgggtacattccccgctttttattctctcttctaggctagaaggcaatcatgcattattcaattctttttcatttttgcgaggaaacattatttgatttcgagagtgtacactgctactggagtgttgaaacctgaaaaatggaactaggagacttcatttctgttactgtctcatgtggtttagcctttcatttgcaaagttattggttgagctacggttttataaaccgagtaatataatgatggtgatatgtaaacaaaactagaaatttcgttaactcggattattcgaagtgaaccaaaatagtgtattcctttgatcacaaaataaccatcacaaaactgtcagaaattttgaacatatatttgcaatttgagctctgaaggtaatgaatagtggaaaagaaaacatgtagtgaagaaggccagaatagaggaaagcatgtacaatttgatcacaaggtctctcattcgtcgatgggccggaacacctcgagcgactcgcgcagcagttcgtcgccaatggtgctcaccaccttagccgcgccgatggccaccggaaacgtgaagccgccggagctcacgacctgagccggagccgggcttcttgccgcggtaagcgcttgcggtggcggcggcgacgacgccaatggcaccacccatctggagcttagtagtagccaccgatgcggcagactaggcgtggccggagagcagcccggagcggctggtccagctcgcctccgacgagcacgccacggtgcgcccgttctggctagccgcgtccacggccatctcctgccgcggctgcctcttgtcacactccttcttgacgacgtcgtcctgcgtgtcgttgacggcgccgcctcctccctctccccagcgttggcgtcggcttggcggtggtggcgaggcgggaggaccgtgtcggcgtcggcgctgggagctagagcggcaggaggcagggacaaactgcgttgcactccagctccagccccggccccgcccgccgccgaacccgatcccctgctgcttctgctgcgttgtcggcggcggcgtgaggatcgtcgacggcagctgcatggcgagacgtggccccaccgccatcggcatcccccgcgtcgagcccagcggcgcgcggtggaggaaaccaccgccagcgactccgctcagcggccggaaagaggcgaagaagaaggcggcggcaacgaggacggcggcgttgcctccccggccgccggaccccccgcgccgcgtggcggcttcgtccccactcgtcggtcgccctgccgcttgccctgagaagagagagaggatgggaaataagagagagatgatgacatggcatcttacatgtggggtccacacgctgactcagccgtcatgtcggataaaaccggggtcaaaaccactgaaggacctcaagcaaacggttttcttagttgagagacgaccggtatccagtatctgattttatggttggaggatgattttataacttgatgacaagttgaggaccttaggtgtactttttccaaggaattaccttaggagacatccaggtggtggcaatgggcagaaggcccatccgacctaggaagaagcggaattttttttatttttagattttttttaatatttacagaaataatctatcggtcaaaaaaattataaaaatagatcctgctgtccaccacttgggcggcaagctgacgtggcaaacgggggagggacaggcggtgacggagggagggttttttgcaggaaaacccttgccgccctctgttggggcggcaaggggtcccaatgcaaaaaagccagccgggaccggccattttccaggcggccccttgccgctctctggtcgggcggcaggcctcgctgcctataaaaggcatgccgcccagcccctagccctcattcctccccccacaaatctagtaaaaaaaagaagaaaggggaggagaagagaagaaggggcgaagccctgccggattcacacgccaatttcaggtaatattcattgatcctatatgtgactattgagttaaatattgtgtattttttaaaactttgtttgaataaatgcattatatttttagggttttagttgtactaatctagaagtgcgtattgtagatatcggtaactacgtagatctgctagtttggaatcagtactttaccgttgcattgtcatacacaaggagatattacgttgtaggtgtttattgcatgaaagaataatatgatctagttatttcgttgacagatatgtcgaacaaacaaatattccaagtttaccatggcccatgaaacgtccgttacgggccaactggggtagatctgtcagaatttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacgtgggtggtctctagctatggttccgtttgttcacccgaaggatccaggtgtgcagatgaacatgaatgatggcgagggaccaagtgctgaagtaaatgagacttttgtggaagaggtcaacgcatgagaggacgggggcgtagtacctccagtgggcattcaaccaagtggagtggtcgacgagggggagactgtcggtgccattgtggatgaaatgaagagggaggattctgacaacgagcgtgtagaggaaggtgattcgtcagatgatgagacggataatgaatacgttgttgttatatgtgcacgatacctttcgacgcatgcacgatacctttcggcgcatgcacgactactttctgccgcaccgatgcagcctcctttattcgagtgcgatacgagtatttgcccgccatttgccgcatacgaccaatgtaactttcggcgccaatcaggcgtacccaccatgccccgccacattcacatgtcagggatatcactcgatttttggtgcctatataagtcgccttaacgagcgaggcctcacaatctttcagaactcagtcacattcagtactttcttccccacttgcttcattacaaatcctaccggctttcgtcaatggctagacgcctgggcgttgaggatccgaactggcgtagcgatccttgtgtatacctactaccaccttggtgccagcgtcctctctgcctatgcagtgatcgatgccaactaatggcttcgaggaatcctgatattcgaggaaggtgcttttttaggtgccctaactatgaccgtgaggtattttattatctgcatatgcttattcattccgtatgagcaatcgttttattcttcgtaacactactctattcggcagacccgcactacggcttgcgcatatatcaagtgggtcgatacagaaaatcccgttctcgacctaaccacttgtttacaagaaggtcgctggtatttcgcatccgaaagtactgagcaatacttgcagagaaaagcggcttatgaacgacaatgtcatgaacaacggtgcgactagcgggtgctaactacggcactccctccatgggaagcccgtccaggatgcaggtgtggtgatcgttgtcaagttcttcgttccataaagcctacaatattgggtcgaaggttctttgtttgtccaaatattcttgacgacgatttcatgataagaatattttgattacatgaatccttattttctcacaacatttactaactttgctcgcttcatatctattctttcctcccaggaaccaccaaggagatgtcaatatagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatactgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaaatccatataatgtttctacgaccgagactgcgataggactatatcaattctccgagtactaatacgtcaaataagttacaaaataatatcttacttaacatatgaaattacgaaacaaccaacttcaatacatttttataacaatattaacaagttttaccaataaatacttctttaattatt

SEQ ID NO: 69331 - DNA, 614 bp, Oryza sativa
caaccagattcaccgtgattagcctcaccctagtctagtgtaatggaattgattagttcaggtggatggtggggcctgttgcaacgtggtgtagcgttggacagtggatggttaatattgagtaattattacaactgatttactgctttcaactaccgtctttaaatgctcgctttatgcaaatgaaccgctcaagctgtccttcaattatatcctgcatcataccctctattccggtatgacttgctgagtacggtggttgtactcagtcttgctctatttttccccaaacccccagagtttgagtgcgtgtcagatggtgggttctccgaggagtaagcttcgtccgtgctgtcgaggatgcatgtggagtggtgttcccgctgcagtccaagtcaaggcttagcttcatttatcttttaattttccgctgcatttatgtaagacttttataatgtttgtaagacgtggatctgtatgtcgactttgtcgtttgtgtaccccggccggtcctcgacgggggttttaatgcacattttgcttggaattttattcgggaatttttgggcgtgacatcctgttttttagacagcacagttaattaattagtgaca

SEQ ID NO: 69332 - DNA, 2318 bp, Oryza sativa
agggtcctgtttggatctcctggtaaaaattttcgccctgtcacatcgaatatttggatacatgcatgaagtattaaatataaacgaaaaaataactaattaggcatattgcatgtaaattgcgagacgaatcttttacgcctaattgctccatgatctgacaatgtggtgctacagtaaacatttgctaatgacggattaattaggcttaataaattcgtctcgcggtttacatgcggattctgtaatttgttttgttattagtctacatttaatactttaaatgtgtgtccatacatcagatgtgacacgccaaaactttacacagcctagatcggacggacgaaaagtggatgtgacagaaaaattactacaggcctgtttagattccctggcaaaattttacaccccatcacatcgaatgtttggacacatgtatggagtattaaatataaacaaaaaaaactaattacacagattacatgtaaattgcgagacgaatcttttaagcctaattgcgccatgatttgataatgtggtgctacagtaaatatttactaatgacgaattaattaggcttaataaacatatgctaatgatggattcattaggcttaataaatttgtctcgtggtttataagcggattatgtcatttgttttgttattagactatgtttaatattttaaatatatgtccgtatattcgatgtgatacgccgaagctttacacccatgtcgtaaacacaaccacgttgatttggcaatgcctcttcggattctagcggcctgcgcttcggaatcggactcgcacgctctccgatctcgagttctgcttcttctcgagttcccaaggctttttcgcctataaaaccaagccatccgtgaggcctcaacgcggcaaccccatccaaatcactctctgcctccgctgctttgatccgaggagttcgccgcgaggctcgccgaaaccctagaccggtagacctttcccctccgatcgccggtatcaatggcagccacggtcgctgccgccagcagccggaagcgtgggttcatggacatccttgacgacccgtgcccctaccgttgcgccacctggcgaagcgcggccggagctcgtcttcgccgcctccgcggctgattagatcacaaccggatttgccacatcgtgaggtgctgcaaattaaggtgaaagattagttttttttatagatttggtacttgtttatgtgtttccgcttccacctttataatttttgtagcgtcaaccttgtgtttgcattgtgttattcaacggattcgattatgtttccttgtgaagtaaaacaatggaaaactgattatgttaagtgtttatgtaagattggatgcttgggatttttgtccgtgtataatacttataattaatgtgtataatacttataaattttacacaccaacacatcgaatgtttggacatatacatgtagtattaaatataaacgaaaaaaataactaattacacatattacgtgtaaattatgagacgaatcttgtaagcctaattgcgctatgatctgacaatgtggtgctacagtaaacatttgctaatgacatattagttaggcttaataaattcatgatggattaattaggcttaataaattcatctcgtggtttacaggtggattctgtaatttattttgttattagactacgtttaatattttaaatatgtctccgtatattcgatgtgacatgccaaagttttacacttgatgtaaacacaatcacgtcacgatttcgcgatgcctcttcggattccgagccgcagtggcggacgtaggattttataaatggggtatgataaactaatctacttataaaacaataaattatgtaattgttgtacaatattttctctaaagaaatataaaaaacccaatatatcataaaaattagactagaaataaactaaatcttatttttatctctagatcgcattgtaatgcattgacatgtaactagtaaatatatatataacattataataattggatttataacaagtgtcaatctctaattcatccataaaattttttatataattatatattgttcaatattataaatctttatagcattctagattatgtttaataaaaatatctttccacttattaaaaaactagtcaggtaccttatataaatataataatattaataaagataataattattgtttacacatgtaaaaacatagataattgttaacgaccaaatttggtaaggccatgggctgggttcaaagctagagtcaaagccagatttggaggaa

SEQ ID NO: 69333 - DNA, 3381 bp, Oryza sativa
ttatttgaagcatatcttgctctttatcagtctgccagtccatcttacttgctagattgatctgcgttttatatatttcatttaccctgttatcttagtatagagtcgtactggagtactagccgatacatgctaggtttgctgtatcggctatgctgcgagcatacacaatctttactttgaggcacatttagatattaagtgatttatattatctcggcacatcgtccgatctattccaatcacttggtttaaatgtatttcattagatagactgtgtatcgttgacatcttcaaccgatcgagtagatctaataatctctacgctttatcttcccttgccgatctgatgcaagttacatcgacttggctccaaacgatatgtcattgtcaatccagccgatcggctatcgttgacggatttaactttgtccctttttatttcttgttggttgcaggatcaaaccaactggcacactcagaacccgaaggtaatcgctttggacctgcactagagttaagcagatctctcaggccagtgcgtgtttttcgcgtcaacaataatatatattacggagcgcacacacatgagttagctactaatattcatgtgcaaataatagtgttggttgtggcaatattattataaaagaataagaatgagaaaacaagaagaagatggaacaacataagaatataaggttaaagttttagtttcacaccgtattacgacgaagaacaattttaataatattagtatattatcgattaatgtgagcatataccataccatggatgtgagtaacttttccccacgtgtgtttgagctagtgactaacctcctctttttcttaccttcttttgaagttctcctaacgtgtttgataaaaaaaatgttttgttttgaatgagataaacaaacaatttgactagattgttttttagagagaatccattgtgtgccgttgactttgtccctgttctataatatgccactgagtttgtcaagttatacaatatgccattgtactttgcttatcctctataatataccgtcgccgtccatttagactccgttagttcggtataattttgtcataatgaccgaaatatccatgggacggaaattctaaaatttggcaaaaaatccgaaatgtcattataaacaaggcagagaattgcgcatctcaaactttgttacaatctgatatttgtaatttttcgtcctaggggtatttcggtcattatgtcaaaattgtacaattctaacggaagctagacgacgatggtatgttatagaagttaagcatagtgcgatggcatactagaacttggcaaacctagtgacatattgtagaacaaggacaaaatcagtaacacacaatggattctctatatatttttttatggttgttcagttcattacctatctactattgtgcaaaatttttagaaaaagttaaatagtccatatcttacacattaaattacatgcatataatataattttcgcattatacaatgccctattcacattttataggagaaatataaaaaatgatttattatctatttaattatgagaaaaatattagtccaaattaatgtatatgtagaaaaaaatttaatatgatagaattatggaaatgcctactgatataatcattgtatatcacgtagtgagaaaaggagaccagagtcgaatgctttattgttgagcgtaattgatggcattaattttatcttttttagcttaatctatctaaccataattaattaacccgtgttagtagaagtccatatcttgatgcatcaacatatcatgagattattagtaatagctaagtacaccgacccaaccacacttagtatatcacaagactgtcgggtaatggacaactcatctttaattatgctaaagacttagtatatcacagtagtatcgggcaatggacaactcatctttaataattgtgctaaagaaaaaaagtaaattatagttcgtactatgtattcttaaaagttttcatactatgtcatctttaaccattcttttcatttacaaaagagctaactttacatttcaatttggaccaccctattccatccatatccaagtccggtgtgacgacgctctctctcgtggcccgatcttctgatgagggggataactctcactttgatcgagtgcgacgtttgcgatgtggctaccaaccagaacaagtctaggacgctgtgcaatcgctacaccataaacgatgtcgtaccaaccgtggcacacggttgatgatccctacaatgcaaacgagagaacactacaagaacaagataagatgcaatctaaatattgcgaataggtaattaagtacaaaggaacgagttgcgattgaagtggtagatctaatcgacccggcaaatcaacacaccaactattgggggctctaaatttatagtcaccgactaatcgagcgaggactagagacaaggtgaatggcacttggcaaaattcaactaaacaaaacccaatttttctaaagggtgtgcatagacatttatagaggaaaatagatctagggttatgttctaattcgtggaggtggacggagacacttccgagatgggcctagtctattacaaggctgaaagcccaagttcggtttcagcaacaacactgccttgttttgatgattcccgttgactcggaatgaatttggatatgagactggatgcatttgaaaggtaatgagataagctttccatcaagtcgaagatcacccaaatcggagttggcatgaagatgctaggtctgtttaaagttagtgttgtctccggagaccgaactatattccacaactcattggacttgaatatcttgtagatcctctattcatccgatacattctttgacaatgttttatatttcttatgcttggttacatatacttgatggtcacatcacagtgactcaggaaccactccgcacactaactctctctctctctccattttctttttccctccaacaattggggaaccgctatattcagcaagaaggagcccaaatctagtgtcttcgctcttcatcgggtcgactcctgcctcctccttgactccctgtgtctctgtaagaccgacaccaccgaccttaatggcgaccataatgatagtgtgcatgacgagaggggacgagaaaaaagggtgacccatggaggataacttgagggtgcgattgcacatgcaaaggcggagatgagcaacgatggtggctcatggagaaagagcggtggtggcgatgcgtggagtgatagttgttggtggtacgaggagtttgttgtcgatacgatcgctaatcgagtttgttaattcttgatacgtgggcaa

SEQ ID NO: 69334 - DNA, 2188 bp, Oryza sativa
ttttggtggagctgaaactgtttggctgaactccaacttcaggaggggtggaaccggagctggagctgtgccaaacacgcccgtatgtttaatgacaaattcttaattaccagtactaggatgacaaatcattaaatattctccgaatagaatatattacttggcagcgtagatgaaaaacaaatctcccgtctttttatcttcgcttcctgccctggcaaaaacaatggccgctgaacagaacaagggacaagggcggcgatcttcatctggcgagcaaagcaaagcagattcatctctctctctcccatcgtgactacttttggctggatattgtttgcgttcgttcgttaaccctagcttctcttcgagagctggaagaggctcttcttttaatttcagagccttaggccttgtttagtttgcgaaaattaaatttttagttgtcacattggatatttgaccgaatatcggaagatgtttttatacgaatgaaaaaactaattttataactcatctgaaaaccgcgagacgaatttaaggcctgttcactttgatgctattttcaaccataccattttttaataaagttgtcaaaaaatatccatgtctagtttgttgccaaatttaatcaatacataagaaatcctgctaaaattttgacaatattgccatctggtaaggtttattttgactacaatctgagcagacccttattaagtctaattaatctgtcattagcttatgtgggttactatagtacttatggctaatcatggactaattaggcttaaaagatttgcctcgtgatttccatgcaaactgtgtagttagttttttattttatccatatttaatgctctatatatttgtctaaagatttaatgtgacgtttttaggaaaaaacaatttgggtactaaataaagccttaaccttaatacaagtaacagtttgttttttccccccgaaaagtttggggctcaactgaacccccatgtcccaagttggatctgcccctaccgagccgcttcggaatcggactcggctctccgatctcgaattcccctggctttctcgcctataaaagcaagccacgcgggccgcgaggccgcaacgccggtccatccgaatcactctccgcctttgatccgaggagttcgccgccggtacaccctctcccctccgatcgcccgcaccaatggcggccacggtcgctgccgccagcagccggaagcgcgggttctcagtcgcagacatcctcgacgacccgttccccctcccgtcgcaccacctggcgaagcgcggccggtgctcgtcgtcggccgcctccgcggctgacctcggggtgagtttggagttcgacccgatcgaagtgctgcagctcatcttcccccatgaagatccgcaggtattgcaggattcatccatcgatctttgtttaccttctgttctgttttttctggttgctctgttttttttaagcttcttcaccataggataggagcgctattcgatcacgatgtagatgaaaggattgtgatttatgaatgaatcatcagccgcagaaattagcacgcatctattatttttgtgggattcatgtttgcacttgcacaggcacttaattagtaagtagagggttaagacttaagaatcctgattttactgatgagactttagatgttacatcatattggtattgaatacgattcagcattgatcattgtgtttgatgttgaatatgattcatcattgttcattgtgtttgtatctaatttgatctctgtgccagtttgtctgatactgtattttttttatctctttttgaatttgtagctcctgaagagcttttttgaagcgtccggtaatgtgttggacgctgcaattaggggattcaagcatcgtttgcaatctcatactgatactgagatcacagaggcggcttccggtgatacaggaaacgaggtggtctctcctaaaggtatggtaacatttgttttcctttcattcatgattacccttccagaccaattagttaattttgcggaaatctgaaactctcttttactgatggttgttgcagttgaatctgatttgtcagcgatgaacatcccatccaatgggtctgaatgggctgagctagttgtcaaggagatgtcctctgctctagatttggttgatgccaag

SEQ ID NO: 69335 - DNA, 646 bp, Oryza sativa
aagccttacccactagacatgtggaagtacggtagtgctttgcaacagaggcccgaagaccggtccttaaacggccaaggtgctaccatccaaaccatgcaccccgagcccagcctaaaaccattttagggaattttgaatagagggggcggtgtgaagccaattccacaataatccaacaattccagagtgtccaagtgatatgagaatttcccaagtctagagttgtaaaaccacctaatgttgcctaattaacttgcgaagcatctacctagaattatactagtggtactatgagtagagtgtccactagttgaggttttgtttgtctagggtgaacaaggtagtaataataacaataacaataataatatggtcataacaaaggtaaataggcatggctaaataaaacagtgataacgcgggaatttaaataaagcgataatgcaataatttaaatcaacataattttgtaaactgggattcaatatgatcaagatgatgtgtcttgccttgctcgttttcccaatcgacggcttcgacttcaacgaagagcggatcttccgaagctgcagcgtctacacgaccaacggaaaagaaaaaggcctttaacactaaataactccacataacagcagaaacaaag

SEQ ID NO: 69336 - DNA, 5924 bp, Oryza sativa
tgtcgaatggtctgtacctgaaataagtactcactttaaaatatgacatgaatttccatgctgaaatgtgagcctgagcgtagacataagcaagagtattaacttccaggacaaccagaatgtgctaccttgccctttgaagctgattgcatcaccgcctcaatcattttgtgtgaacttctaccaattgcttgtattccatcaccattagggggaatcggtttatggccatttggtgaccaacgactttcccgatcaatttgccttttaaactcttgcatcctctctacaagagcagcttggctcattagttaggaccggtgtcccttggattgctgtgcataagcaagaacctgaaaaaggagaatccataatgtgttacaaaaaaccgcaaatgagggtatagaaacatgcatgcacatacagaaaacaattggtctttagaaatgaagtgaatgttgcatacacatccaacacttaaattacaggtattactaggccttagcagagcatgtcattttgaaggaaatgagcagaaatttatgttttatataaagtgcaagaatgactaatggcccatcggtgacataaaatattggtgtatccaataataagcaaatgtgcattggcctcaattaagtcaagaactagcatgaaacattcaggtataggaatacagcacaagaaacattatgagaagaatggtcatggttaaagacttatacttgattgatatatggctccatctgatggagtagctcatatccctgaaagaaacagcaacagtggaaccttgaaccacattcatatattactaaggatgtcaaaatgcaaattatgacaatagattacttgtttgaaatagcgcagatgtgcatccattgtcccactgacagcctctaaaaattcaaatcttttcttggcctcgatatttgaaagtgcagtcacctgaaaattaaatagataagacaaagccacggtacatacaactacagaaatcagaacagttatacagggaaacagtgcatgtaccaggttgaaacgagcttgctcaaatgaggatctggcactatggagctcctggttgtgtgacatataaattagtaaggatgcagtgatccaactttctaaatacaaatatgaagacaaatgatagaaggaacatacatcctccaccgcagttgctacatctgtccgtgtgcctttcttcaaggataaatacctctcacgagcctgagtgagtagacaaacaactagaagtcagtgatagataaactcttcctaaaagatagccatcaacttttaactttttgttaaacatgcagcaccaagtacaagtgaacatggcaataccagtgcttaactgcagtgattctccttatcctaaaatagtttgggtatttttgtgcaattccttcattatcaattagctacacctacgtataattggctaatggaaccttcaaggttccagcacaagttgattatcatattggagagcgagatgatagaaacattattatgtcacctggtcatagagaaggctagccttgtcaaaacgcttcctggcatcctaaacaaacaatatcaaagttaaaacattgtatgcagatccaaatatttatccaatgttaatagaagattatgccagtaccttcacatcatgcaaatcaatgtccacaaattgcagcaacttgtcatttagcatattctcaacctaaaaaaagagtatattattagtaataccactaagtggaagtatggttacagcttctaataaaactggggttgtttccattcttggtaatgaaagcctggaacttgaactatgatacaataacatgaattatttcaaccatactattcccaaatgactagtaaatccagaatctcacattaaagtagataagtcatacaactggctgacaatatctgaaagagtgacaacttagaaaagaacattcagaatttcagattttccagaagagagaatgcatgtatagtaatgtatatatgaatgtttacctgtgagcgcaatacttccttgtaagttccaatttctctcagggcaattgtaaatttggtcatgacgggtcctggaaaaaagtgaatgccacacttactaaaggatcactaattttgaaggcaacaagctggggaatgaaatttactgaatcctaggatcactattttgaaggcaataagctggagaatgaaatctactgaaacctattttgtagttctcaacgattcgtgccaattgtccagtttggaaataacaaaaggattcctcgatcccatgttataaaaacttgaataaatatatctgaataagaactgcattactaacctccaaaagcaacactgattggatcattatgcccccctccaaatgcttccagtgaacttgcaaatgcaatatctccatcatatgcttcccctagtccttcactgtaataagcaaacatatatgtttttaatgctagatagcaaagcataagcaaaacgaggagagaagaatatagagagcccaatggttcttgagttaagagtccagaccatattttccaacagaatttgcaaataaatgagcaaacaaacttttggtttttgtaagtctaaaactgcagactaagttaccacttacgtgtatttgcggcaacctttatgaaacctcaaacatctctctctcagcaattcagaaccttcttcaagggattgtatctacatattgcaaggataaccatttaaacagtgttcatgaaccaaaaactttagaagacatgattcaaatcaatacaccacatttgcccaaactgcaaacgtttataatatattccccataacccttgaataaaagagtccctccattttctctatgaatcacgataattataaaccacttgttcacaatcagcgaaagaatcaaagaacccaaataatgtatgattcagttttagggtgcaggattatctcctgatggaattgaacaatgcccctgtcattctggaatttcaaacaggacccataccaatataacattattcgccaaaattcacacagaaataacctaaggtcccctttgcatcaggaattcaggataataatcgagtgccgaacacacacatgagaaaagaagatattctaacagaatgcaaaatctactgcagttgtgaggaacccaagccaaaaataacgcttacaggagatactttactcacacgctcatacgaaaaatacagaactaatgacgctaaattcttccatctaggaatgaaaccgtcagaacagcaacaaaaaaattttaagaaacctacgatacgagcagctccatttcaatttcaaatccacaaattagacccccccgagatagagggagatcacactttctccagccattcccatcgtcacagcccaaaaaacattcgatagatccaacccgccactctcagcgcaacccagaagccaccagcggcaagcattacaccaaaagctgcatccctttttttcttcttcccctacgcttccactcgcctgacaccaacctcccaaccacggcgcacgagcgcccccaaaccgccacgaaccgagatctccactcactcacctgcttcctgaacatgggcgagtcatccagcctggtgaaaaacatctccgccgccgcccgccgccgcgaccaccacactgctttgcctccctaccaccacaacctcatcaacgccctctcctcgcaccaccaccacccacctcgtcggcgacgcactcctctctctctccaccaccaccaccaccacctcctccgccctcctcctcctacacctccccgcagtcagagcagctcctccagggcggcgtggggaaggcggcgcagtgccggggggagggcgacggtggcggagcgcgggcgaaaccctaggaggcggccggaattgggcgtaatggcggcgattcggcggaggaatcgaatggctcggcgaggcgagaggagagaggagagaggtaaagcggaaaggagaacggggggaaatgaaataacggtgcgcttttctattaattatttttttcctcttcgagttttaatttatttactattattgggctaattaagcgtgggggagtgggggattaagcgctaatcgtgtggggccacacgtggtgggcgtggtgcacggtggggttgtggggtggtggggcccggtgtcagtgagagcctgagaggggcgttggtggactcggtgtatggaagtgtggggtgggggtttggactcggaggaggctgctcacctgccggtgagtgtattggtggcttgccctaaccacaattttctctctttttgccttttggatttattttttttctatagctttcagtttgttcttttggtttagctttgtgtttgatgacaaatttgcagtgtgtggtgactgctaaagtttgatgtttgatggtacgtcttttaaatacccgcaaaaaaaactaaaggaagtttacggtggcgtgcgaaatcgtcgagcctaggcgacgacaaagaatgtttgctagcatcgtaaaaatgttgtgcgtgtgttctcaacgaaagtaaagtggaatgaaaatgctagtgggggaacttggtggccatctgaccagtccgagaggtggttccgccactgaaagttggagctgcttagaagatactatctaaatcgaggaaaaaaagagagtaattctagcctcaatggtcaaaaagaagaaaactaagtaaaaaaaccggcgacttcttaaaattcaaaacaggagttggtttgatattattagtaacagaattcaaaatataagtacataaaacaaaattccaggcttggtatgtccaattgtgcacgacataaatccgtacatgaaacatgtactacttcgtgctgtttgttgtacagctgcgtcctctcccatctgtgatgaacagcgtcctctcccatctgtgttaaacacaaatctttcgtcatattaattgcattattattgctgggttactttaactgtttgctcctgaccaggatgttggtcaatggctgtagtacgatgcataggtaattgatcctgaactaaattacaatggtcaaacataggcattcgctaacgaccacaagtattggaagataactaaatcccattggttaaaagttgctactattactggctaattaatgtgctccaattgatgttaattactgtacattttgatctgaactgctatctctgggccctgtttggttccatgggctaatgtttagccctcaccttttagcctcaaattagccctcacctttgagcctcaaattagccctcgaaacattagcccctccaaggggtgctaatggggctaattttgtgtggggaccatcaaaaagcagaactctctctctctccttctctcctctctctttctactctctctccacattttagccttgaattagtccatagatccaaacatgtcaccctaggctaatgtttagcctaccaattcatgactaaacattagctctcaaaattagccctggtcacaatacaagtaagtatttgttctattactagcagttaatagtataaaacttaaaaaaatatagcaaagttataatattttgaaatattttttaagattactataacattttcaaaagttgaattgaaatatttaaaaataaattaatgatgaaagttaaaaacacagccttaaaaagtctcgtgcgacatccgtcctttgaaaaatcaacttctcactaggatttatacatagcgtgtgtgtgtgtatatatatatatatttaaagctcgaagtttttctttaaggaggaataatgctttatcggagggagtatagtaggtgaaaggttgaaaatgatatattttaacttgaacatgttgatatgagttctacatattat

SEQ ID NO: 69337 - DNA, 28687 bp, Oryza sativa
atgatcgtttgattggaccacaggaaaaatacaggaaccagatgagagagatagactcaaaagatttttaccaagaggttggagctcttgctaagtttcctccaaaacctatatgcaacaagccattccataggaattttataggatttgaaaaacttcaatccttcgaatcaaagggctacataggaaaatttcctataggatttcaatcctatgaaattccttcataattcctttgattcaaaggggcccttagtattttgataagtgtgattatgataaacgaggaagttgtaacctgtaaaagccaaacacctaccgacttagcccatttggagtactcactccgtcaaaaataaaatagatgtgacatatcttaggcctgtttagatcctccaaaatagcaagagttctgctattttggagcattttttgctattttgaatctaaacactagtagcaaaagttggcaatttgtcatttgccatttgctagtccatagtagcaaattgtaccaaaaagtgctttgggaccatacactctctctccccaccaaaaagtgctagaatggcaaaaaaaaatttaggatgtatctaaacaccagctagtatttttgcaatgccaaaacttttgacatttaccatttgccatttcaaatggatctaaacatgcccttagtacaacgaacctggatagacttatgtcgcattcagttttagttttagttttaattttagtttttttttacacggagggaataggtcttgacacaacctatgggctaatgctaatgcactaatctttggtaggaaatgtgtgtggacagaactaatgacagattgcaatggggacatacatcattgtgctcaaggcagtctccggtctccaggcttccctcctcgttttgagtggggttggcgcccacttctgatgagagttcggtgttcttcacggtcagcttacctctgtctactcagcttttgcattcacacaaaactgagataatttggtgtttcagtaataattgagctgagagatttgttgcatgattaaagttttttatctttggaaagatatgcttttggacttatgagaggaggtgtcggcatgtatagttttatgtgagacaaggggatgttgctctctctgtctcttacctttgtctcatctgttttttccttgttctattagctccaatttcgaggactggaggagacacacggttcttttcccatgtaaatttgtttcaacatagcagaaatatgtttcttgcaaagttcttccaacatagcaaaaactagtgttaggaattattttcataaacttaatccaacatatacttgatcacctaaattgcttatgcggaattggtgattgaccagtggtactgacaggtgcttgacgaagacaaagaaaaacgtcattagtcttattagcaatatatgtagatgtagtgctaacgaaaacggggtagcgaagcaactgtaaggatcagcgtaggcgtcaggctgtgtatgcaatcccatgtttctaagccctctccctcgttttccacgcgcacgcttttcaagctactaaatgatacaatttttaaaaaaagtttatatacaaaagttgcttaaaatattaaattaatctatttttttaaaaaaattagctaatacttaattaatcatgcactaatgaaccgctctgtttttcgtgcaggagggattgttttccatcccttgattaggctgtgcagtaacatgacaccagagagaatcagagttattggagctcgtccttcggtctccctctagcgcctcacttaaaatcggttttggggttttgaggaacatatgtgatgatcaccaccgtacatgagttaggcttctcagttcttgtagcgttagagagtcagctgggacaagtccatcaagaatgaggcgtgtaatcccatcatttcgcgccttgtgatcagctcggtggccaaaaatcaattaacaataagctctgatctgcactttggttttctttctttcagatatgaatgtcgatgctttctgattcctgctagttataaggaattctctccgtttcatattataaatcgcttgacattttttttaagttaaaattctttatgtttgatcaagtctatagaaaaaaaagaacttgtataacagtaaattagtttcattaaatttaacatctaatatatttgttttgtattaaaaatgttactatattgttacaaacttaaagaaatctctactattataaaaattgaagatgtttttgccggtattttggtacgtcatccgtatataagtcggtttttaactttgtttgtttttggaaatgcatatccgtatttgagtcgttttttgagatcatttacttttggtaatacagaaggaatcatataagaaatatgtttaaaaaactcgcattctaatttaagacgatcggactcctaactgcagctcatgattttctaaaaatatatatatatccaagtgaattcccacagtgaattttatcttaactaaaccatataacaataataagattgaaatagactttacccgttacgtacgggcatttttttctagtttaattaaaaaatcaaaccacttataaattataaagcgaagggaatattacttctacttggttaatctatccgaaatcagcgtgtaaaactagccacttaactagtgtccctctgtctgttgccacatgagcagagacagcccgtaaagatgccacctttctggggacggcaatgatgctcgcacggtgccgccccggcggtcggcgcggcgatcgtccggtcaccgccggtgaccggagcggaagcgccggcaagaaggcttttccggcaacgtattcccagatcgatcggtccaagcgcggtccttattttcttcctaagatgtagatttttatcccaaattttattagcatgttttttaaacgattaagtggtacatttctatagagaagttgttctaaaatatctgataaatttatttcttaaatttataataattaaaactaaattaacttatttgctaatagtttttttcttttgttatccgtatccttacttaatattttcttcattagtttcgaacactaccgtagaccgcagcaagcaagcaatagccccgtgacctccgctagtttgcttcccagcttacaatcgcaacgaacattaaattttaaaattaatttttatattttatattagattttaagtcgttaataatatatgtatttttatatatgttttatcaataaaaatatttttcagtcgataatgaacaatactgcttatataatcagctatagctatgtgaaagcaacccatgtcgttgcgagtgatcgacgagatatttaactatttatcatttttataagtggtagttaagaatttattagtagacccacatttcaaatacataagagcttatgtatgatagtctgcaagtgacaaatttttaattaccacgtgtttacttaaatactccgcgatcgacagcatgccaagcaggtctgtgggggcccatctagctgccaatcaaaagttggtgaacattgaagtctctgctaatggcttctcacattttcacatcagttggaaaggaatgcctttaatccaaggaatctgtccgattaataccaactttctttaaatttcttgtcgctgctgctgctgctgctgcttttctttgtgtttggtcatccacagatccactccaacctggagaagcttcacgctaacgttatggaggagtactagggcctcctgtggcgaagctttcgacggttgtatcttctctcagggtgagtttgaggataaggtgatcgaggagattgggaagatacgtaaaatgaggtgagccattagcttataattaattgagtattaattattttaaattttaaaaatggattaatatgattttttaaagcaacttttctataggaaatttttacaaaaaacacaccgtttagtagtttggaaaacgtgcgcgcggaaaacgaggtgttatctccctcaatgttacccgaacgaacacaaccttagtttagtcaaatagtttagtttttaatgtagatcttaagaattaagagctataaaattcaataaataaactaaaagacataaactaaaaaaaatgcctatttcatattttcaccggctgcttcttataaaaggaactatgagtgtgttctcaagtacacttttccaacttctattttctttctccacgcacactttttctatacttataagcaataattcttttgaaaaataattatagaaattttgttttaaaataaacatattaatctattttcaagttttgtttgctaataattaattgatgagctattactttcttttttgcgcgggagaaagctttagagcttttcttgtcaaacattcattcaaacacagccttatatcttcagctggacctcgagtcctcggttagtttgtttagctgggttgatgaggtgtgttctcatgtttggtgatcctctctagatatagtggtatcagtgagtgtgtcaatgcatgtgccatgctcatgcttcaacagaaaccatggtttgtttagctgacgcaacagtctaggaaagatttcttctttttttttcttttttgaaagcaataagcaggctatgacgctatgtatgagaatctgaacatgtagtagagatggaaaagtttcagataagtctccgaagatttggaaaaggcaagagcgacttgtgcgttggattctaacacccggcagtaagaatttttgctaaaatttgattaaattctgatcgaatttactgtttaaatttgagttctgaaaattattcgaaattttacttggaatatcaatatgcttccgtcccccatcaaattaactactccatccgttccataatataaaggattttgagtttttgcttgcgttgtttcaccactcgtcttattcaaaaaattttggaattattattattgttttttgacttactttattatccaaaatactttaagcatattttttgttttttatatttgcataatttttttaataagacgagtggtctaacagtaaaaaaaaacttaaaattgatttataggacggagggagtacttgtctgaccggggtgatcgattagacgcaggaggttgactggtagcgagagcagagagactacaatgagcccatacacgccaacaaaaaccgtggtgtttgctaacagcaaaatagtcttttttttttcaaacggccggtcataattgactggcgttatatcgatagaaggagaaaaagtacaaatagccaaagggctaagaaagagaaaaactgtacatgacgacatgcaaacaagcttgcatgtagcctccctagctcctcatggcaacattctcccaatgtgtttagcgccggccatactccaccaacctaattcctcttggatacgactaatcatctggtgtactgtcgcctcctttgctctaaagattcttgcatttcgttccttccagatttcccaagcaatgagcaagaagagagttctgagtcctttctgttttgttgcttccaggtcgcttgttccttgtgtccaccaatctaagaggtttctacttgtgttccattttgggatgatgtgcccttggtgcagccatgtgagaatcccaaaccaaatttgctttgagaccaggcattcaaacagaagatggtcgattgtttcgaggtttcgaaagcatagctggtagaaataattatttggccatcccctgatctgtaaccggtcagctgtccacacccggttttgaagaaccaaccaactgaagattttgcactttaccggagcccatgcctcccaagacaactttgttgatggcaagagtaccattccattgaattggaattggtacgcggattttgcactatattccccattagttgtccattgccaaacaatcgagtcttgtaccccctctgttagttgtggggtgttacgggctaaaatttcccaaacatggaagaattcatcaagaaggggaatggtgaggctgtggaggatgtcgttaatccatcttccttgttgcagggcgtcttggacggtgcgggttttcctcttcgaatgcctataaagattcggtgcttgactttttagtctttggccaccaatccaatttgattcccaaaagctcgccttttgtccgtcaccaatctggactctcgttgatgccgcgaaaagatccttatccaattcatcacagggtgtttcagtccctatccaaggcttctctggcgtcctccattcgaatcataaccatctcagtcgaagagctctggcaaacttttctaagttcggaacccccaaaccaccgtaccggacaggtgagcaaactttaagccaattgaccttgcattttccgccatgcatattctcgttacctgcccacaggaaccgccttcttgctttgtcaatttcttgaagagattgtttcggcggtttcagcaccgtgagggtgtaagttgggatggcacttagaactgagttcaccataattcggcgcccccccatgtacaacaatgatggcttccatcccgagagccgacctttgatcttatcctggagaggctggaaatgcaccttacgtaggcggccaggagtgagtggtagccctaggtaagtcagtgggaagctggctcttgcccccgaaaaactacacaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcataaagcgaagtcctcaatctagcatggcgacttccgatgttggttagttgcccaccttcggtcgccagatgtagaagcctttgtagggggtcgatagccaggataaagagatagggggatatggggtccccttgcctcaagccacgtctgtgtgcaatgcattccccctggtctccatttaggactaccttggaagtggcggtggaaaagagcaaacagatccaatttctccaccgggggccaaaacccatgttttgcatcagttcaagtaaatattcccaggagaccgaatcaaaagctctagcaatgtctagcttgaaaaaaagtgttggctttttgctggcatttaggttcctgagcatgttccgaacatacaggaagttgtcttgaatgcatctttttttgatgaaggcgctctgtgcaaccgagatcaggccatccatctgcctggcaagccttattgctagaactttggatatcagcttggcgacggagtgaatgaggctgattggcctaaaatcggtcaccaaggtaggggcgttcctctttggaagcaaggtaattgctgctctgttgagtactccaaagtttcctcctgacaggttatacaaacactggaaaacatccatgatatcctatttaattagttgccagcatttcttgtagaaggtaccattaaagccatctggacctggggccttttctgcttgcatttgctttaaagcggcccaaacttcctcctctgtaaaaggttcatctagttcatcggggttaacctgtggtagatcgatcgcgttccaatttaaggtgcaatttcgcgcctccttgttgcctaggattgagttgaaatggttgaaaagcgcctcacttttttcctcatgttctgtcaggatagcacttgttgtatggagttggtgaatgtggtttttccttctcctcgagtttgcgtgaatgtggaaaaactttgtgttggcatccccttcttttagccatgtcaatcgcgatctctgccttttcttcgactttgccactgctgccagccccaaaattcttagcttgaggtctttcctgagctggtgttcatcagcagtaaggatcctatcttcctgggccaaatccaatcggagaatcacctcctgagccacgtgaaattgcattttgatctctccaaacagacttctactccacttcctgagagctttagcggtggctgtcaatttgtggctgagttttgtaaatggatgtccaccaaaagtgtgagatgaccaggcttgttgcactacctccatgaatcccggcacccagacccagaaattttcaaagcggaagactacccttttgggtgggcttacagtgaaagcaagaagcaaagggcaatggtctgaacaggatgaggagagggcttgcagtgtgtggttggagaacaggatgtcaccatcaatattacaaaaaactttgtcaattctttccagagtaggcgcttcctgctcattgctccatgtgaatttcctattttggagcttgaactccttgagacaacatctatttagagtgctcctaaattgccccatccttctcctatctaaattcagattatttttatcacttgcttcacaaatcaagttaaagtctcccaaaacaacccagggcagcaatggctgcggcactaacgattctagttctgcaaggaagtctgatttatgttcatcctccgaaggcccacatacggaggtgagaataaaagggacatttcctcctatcacttgggccctaattgaaacggaaaaggtatgaatttgtgtgttgtcgacctgcacctttgtgtcatcccagaaaattgctacaccacctcttacaccatcagcagggagaaattcaaaacgcctcagtcgggaaccacctatttcccgccctaaaaactggtctatgttagctaatttagtttcctggatgcaaagtatgctcgcatctgcattattcgcaacctcacagatagcctctctccttgccgggttgttcaaccctctgacattccaattcagaattttgaggccttcaatcattcttgaaccataagtaactcctagagatgtgcactagtgcgatcaacatgctccaatggcaatacattgctccaacagcccacttacatagtacacaaatggagaagtagttcatttccaactgaccaaaacaactactcctatgattggccaaccaccaggtaacacagatcaacagagcactaaaacctagcttaaggctaggtgccattggcaacgctaatagtctaaatgacaacaaccgaacatatagtaacagcgctaatcgctgacgaagggtctgaaggaccactacacaagttaaagaacagagatacatgattcatcaacgacactacgacaacactcatcacaagccagagctcagacccattccggcgtggcaccatcagcctcctctgtcacatccggcggcagaggcttgccgctgtccaacccagtaagcgcgcgaatcccttgcaccacgaccgtcggcaaggggtcctggaagcgcttgatgtactcagccactgcctcatcacctaccggttctcccggcttaaggaccctcatctctttcataatgcgaacctgagctcgcatcgagattagaaccggagatggccgtgcctcgagacgcttgctatgacgactgggaagcagaactttcttgcgtggcctcccgcgacgacgcactggcggtgttgccacaagcggcggtggcagaggagcaaaaaacggctcaactcctccttgcatgggctgggtcgccgtgccttccatttgctcccccaccagctcgagaagcccaagcccaggagaagctatcaagccaggggacgcagctgacccatccggcccaagaggcgccaccggcccaggagaaactggcccaataggcgccaccggcccaagaggagccgctgacccaataggaaccgacgccccagcttctagggtagatgcgttcgctgacttctccgcgtggaacgctgccgccaccgccagctcgagaaacatcgggtcctccccctcccgtgtcgcccccaccacctggccgtggacagagcagcagagggcgggatcgacgagaagaggagcatgggcagcagaagagtgcgctggtggtgttggcgctgcgccgctgggtggcctgcccgaggcaggagaggcgagcctgctgctcgtcttgtcgttgtcgtttcctccgccaccttgggaagcgcacccgcgaagacagcgactctccgagaccgcacgacgccccttgcttggcgagcgcgaccggcaagagcgccggcggcgagaaggcggcctggatgggcgcctggctggggagcgacccacccgatggccggcgaagtggcgattgccgccacggggggtgcggctgcggtaccggccgtcgtttccgccttggggctcccttgagcggccacgacggaagagaacatcagtccaagaacggcctaccagagcgcgtccgttgccgccgccaaagttttcgtcgtcgtcttcttccctctccaggcgaggcgccagcgggacacgacagccgccctactgacctcgctgcgacagccggttacgcaagtcaatgccccgctgttccggtcgcccgcgctcctcgtgaagtctccgtacaggcagtggcggctgcggaggctgcagcggcggcggcgaaacaccgtcctcatagcccaaatgccagtcaaagcggtgcacgcgccgcctcggtggatcatcggagtctgtggagccgctggagtttgaggacctcgccggcaatggcctccagtcctccaccatgtcaagatgaatgagcagatggcggacacgacccagaggtgccgaggcgacctcctggctgggcgtgggcatgccacccgtctccagcacctgccctaccccggccgggaaaagagtgaagaccgacacccgaggaaggagattggggttctgcatccacacccagcaggcgaaggcagcagtgttgactctgttcttggtgtcctcttcgatacggtcgacgatgcagacatcttcgagcaccttctgacgtcgtagttgggagttcccacttgctgctgcaacgcctgcgccatctccttggcgctgacgtcgtagttgggcagccgggccttgatgacggccccatggttgtacaaccgcatagcttcgtgctccattgcagcgtcagcgacaaccaccgcataaccacaagcaggatggttctccggcaacccaggtatgtaatccattttggggccaagcctttcgcgcactggtgctttgtggccagtcagtggagggaaggcaaggggattggggatttcttgcttggagggtggtgctggatgagtggagtagatacaggaaaatattgagggtttgttcttgtattttgaagggcaaccagaagatatgtggccactgcgcttgcaaatgtagcatctgggagggtctctgcagtctgcaattttgtggtcttgagcgaggcaacgcaagcaacggcctaaagttgctggattgaagggacgccaggctggaattactccggtggttgggcgcctggacgccgtggccggaagaggtgccctgccctggcgccaccaaaatctcggtttcacctcttgccagattgatgaaggagctccaggttcgcctttactcaatcgattaaacacacttaactttctcgtctccggaacaacaatagctgattttagtcttgcttgcttccttgggctttccccccacaggaaacagacaccgagcagaagcaggagtaatggcggaggagatggcttttcttccaccttctccgctgtcttccttccttgaggttgaagcagtaaatggggcactaactacgctctgccggggtgcagctagaggcgtagcctcatgggcagcggacgcctggccggccatctggcgcgcgggcgacggcggcgactcgacgacctcgtcatcgtcgctgaaatcccagtcgaccttctcctggctacccgaagaggagccagaggaacactgagcggatgtggctgctggactggacgcccctgccggagcggccggaggcgggctgttgaggtcgccatggccagagtggccggtggcgggcggggagagctcccctggctctagctccatagctagcttcttatgctgtgtggtaggctgctccgagatcgcaacagcaaaatagtcgttgtgttatgtgtgattacacctatatgttgaattttcttgttagggtatgagattaatgttcggtatcgccggcgtcgctatcgccgtccttagcacgccgccatcacctataccggccggcttgtgctccgtcgcggccattggcaaaggtggtagcaagcctttgccaatctaaaatgaaaaagctaaatctaaaatttaaattttcaaacttaattttaaagttgattttaaaatattttcaacgtagttttcttccttattagcttttaaatttctaagaacaattatataaaaatatttagactcaaattacttttttatcgccaataagccgttacagctacataataaatcgattaaatttataataagtcttttacaacggataagacacgaagaaaggggatctaggaggaagggaaaagacgcggtgaggaggaaggaggcagtgtcatgtcagcagccatgacagagggagcggaactccggcacacggccggcgcgcgaccacgaggcggtggttgcgttcttttgacactggtagatgtgtcctaaccttcgcgagaccatttataagtgggctcgtgttttttcaagaaaaggaaaaagtacactgaaggtccctcaacttatcagcaagatacaaaaacgtccttaaaccgtaaaatcagatatatggggtcctttaactatacaaaaccgttcacccgaggtccctgggcagtattgacgccagatttgtcctacatggctggctgagtcagcgtgggtcccatgtgccagatgccacatcatctctcttttctcccttcctctctctctcattggattggccgggccggtggattgacgccgccaccgcacaccgccgcggaggcggatgcggacgtcaccagctcgtcgcaccacggggagggcctcctcgatgaccatcggcggaatcaccctaaactcgtcggcggagctggagcgcggacgacgacgtcgacgacgacttccaggctgccgccgagccaccgacaagcgagcgagcgagacacggcggaagagcgcgagggggagacggcggtccgtgggaggaggacacgcattccggtggccgggctgctcgagcacttcaagctcatcggctgcttcgacgacggcagcgtggagttcatgaccgtcgctgcacgtggcatgggtaaatgatgttaatttatgctcaacgtggatggaaattgatcaaaaccatttacagttgatggattacagaaacacacaactgccacccttttggaactcacaaaccaagatttgcgagacagcaagagctatatagcttaagaatattaacgcaagaggaactactaaaacagcaaacaataaaaccagggcctccttttgtttcaacgcaagaccttttgtttcgacaacacgggaatatgaaaataagcagttcaatacgcaccttgatttttgcttgcaatttggttgttgctcctggttccttcttagcatttggactctccaggttttccttcccagaatttatgttctcagattgtccgccacttaccagcacctcacgggcttctgccaaagcagcagcagtctgcacatttatctgcttcacaaatcctagcgcattgtaggttctatcagctgggctgacgaagtatgaaccctgggaggaacatatggccacaagaaagttcagcagagaaaacaacagcaagcaatgcccccagtgcgtgacaatatcattgattaatgaaaaaaaatactctcaggcatgactcaataataacaaattagaaatatatttctatccgcttagattcagccatagtccaccaatttaaatgcttgttccgaacacttgacaacttgagctctgcatctcaaattcataaattttacaaagtgctaaatgtacctgaaattgcatatctacgaaccaaggggacttccatgctgaaggagattctagtcctcttttgatgcatggggtatcagccaatctaacaagagcaaggcttcagaattcagaatggcatattaaaaggaacaaggatcaagtaatctcttcatacttcagtagcaggaaacaagcggggtttaattccctaatgtagtatcttaaatgcattcatcagtaggattctagtgtttcttcaacgttctcgtcgtcagcgccgagatcgtcaccgtcgggcgtcggctggtacagcggcaaggaccagagaaagctcctcctctactgctacttccgcaccggctaatgagcccgacacgagtcgccgctgcacggcgccgacgcctcctgctcccgcatcgccgcgccgccatgtcctcctcccgcggaccgccgtctccccctcgcgctcttccgccgtgtctcgctcgctcgcttgtcggggtctgcctctgcggcggtgtgcggtgggggcgtcaatccaccggcccggccaatccaatgagagggagggagggagagaagaggggaaagagagagatgatgtggcatctgacatgtgggtcccacgctgactcagccgccacgtgggacaattccagcgtcaatactgtgttgggaccttgggtgaccggttttgtatagttaagggaccccgtatatctggttttgcggtttgaggacgtttttatatcttgctgacaagttgagggacctttggtgtactttttcctcaagaaaaaagtactttagtccgactgtagaatgggccgcatgtacgagacctcccgttctggcccaaaaagaatcccatccagcacaaacataacgggccgcacggacgcccagcccgttccggcccaacctgaacggactgcacgagatctctgtccggaacatcacaagtcactctgtttaactggcaaaatagttgatagcaaatactccctccgtcccaaaaaaaattaaactttagagataaatctggatacatatgtgtctacattcatacctagagtttgattatttttgggatagaggagtaatttatttagagagagattgataaaaaatattgaatgatgaataatgtgcaactttaatcacagcccatgtattattacagaggcagacattgtctcatcagctcacggccatggcgatcaatggcggccgccgacctcgccgtgagctgcaagagctgtataatctccgatccccttgcaccatcatcgctaggaaaagaaagaaatcaaaaaaatttctggcctagcggttcggagaataaaattctgaaccccttggaagttcagtctcatttgcatatcgatcaggacaagtagaaattcagtcaatgtgtagttggttacagggagattggctgaatttgcatgctcaaccgaaatgactgggattcagaagctcgactgaagatttgatatatttgtgaatgcatgtagaggcccaactcaaaactgcttacgggtgacttcgtttttttctttttttcttttaaaaaaagggcatgaattcttgatgcttgcaccaatggcaaagaagatagtggtactggaggagacaggagagagctatgggccttgccgtcgcttaaatccaagctagctagtgttcggagattaaactctcgccttgcttgaaaaatgaaaatatatatatagagaggggaattccggtgcccgagcccctgcctagttgacccaatcccgtttcggagcagcaatgctgtgccacgccggcatccgtgaatcctgagcaccactgcggcctcttatatagtatacttggtcaagctcgcgagcctaaccgagtttgagccgagcctgtttaaaagctcaaaggtggactaggtttggctcgagctcaagcttgagcctagacaaacaaacttgctcgagctcggcttgttgacagccctactaacgaggaggccttgatgtctcgccgtcatggtgatcgacggcgggcggaggcgacatgtaccagctaggtgagctcgacgtctcgtgcaccttcaatttcaccattggacctttctcaaatgccatttacatttatcccaaatcctccttcacagttcatctagaattgccatgaactcgatcagccacaaccgcacagtgcaatgtgttacaaacaaccttcatctgaatttctgcattaccaatcagatcatatcgatccactataggccctgtttggtagagcttcaaactccaactctaatgggagatagctcttatagtagctgaggtgggtgtgaaagtgtttggctagactggttagctccacaccatcacatcccttgtcgccatttcgtcaaacacttggttggcatcgccttgccgttgccgccgctgccgccgtcgccaccggtccgcccatgtgccgctggtgatcaccccgtgcgctgcagccgcgccacccacccgccaccaattgccactgccgtcgatgccgtccaatccatgcgctgtcacccatcatcctgatacactcgcgtgccatccgcagccgcgccacctgcccgccgccgctgacgccgcccgccaccgccgcagcagccaggccgccagtcgctaccggaggaagatggggaggactgaggagagagaatgggaggagagggggtgtgaagggggtagtttaatggtatttttgtgtaaatacattaacaaattaaagggtagtgggtcttttggcaggaatatagtagaactgtggagcagcaagaacctagctccacccccgtggtacaattttgcagagcaactctgctaactctgctccagaaaatagagagtttataccgtttggcacaactccagctctaggtatgttggagttgggagctagagctgtgccaaactcaactgtgatattgaaggccttcagtactgctgagagtactgctggttctctctcagcaatgctcggtttcaacttgtgattctttttcttgagctcaggctgattcattttttacggctagactactgtcattctattttgacggcaaaacagttggcagatgtatatgcaactttgatctcattccatgtaatactattacagaggcaaatactagacagagtttccaataaaaagagcagcctgtcactctatcctagtataacataattcttgaaagtacgcagctaaaaacggtgtgtataaatctaaagagacaatatagaagccacctggatttacacaaaagcattcgatgaatgattatgatgaacgaggcaactattattctgcatcctggtgacaaggggcaagttcagcactccaacatgcacatacagtagtacagtgcacagagaaacgcagttactacatgatgcacgcaaagaaaaacatgagtgttgtgttactgcatttcatttccgctgttactttcgagtttcgacagtaaaaggttccataacatggcaacggctgcaaggctcaaccacatttagtctaaccgtggagggaacttttccctcgatgtatgttctgatagcgaagagtgctttagaggcttccatgagatcatcctttggcattcgcgagcatctaccaagtttgccgggagaacatctgaaagactcaaaactggtgtccaatgtaagacattcgactgatgtattctcgaggatatgatatgttagctccaacaagctcttcacggagcggaatccagtgatcttcacattccggaggttgtcatggcgttgctctggcaactgccttagatgtgaggggttctcgaaaattgaatcgttctctgggtgttttgcggatacctgaaaatgacaagtccattatagttgaattaattggttccagaaagtagtaactagacaagtttacagggtgaaggtgtggcttacatccacgatgaaagtgtccaaggaagggcaggcatcgagaaaggaaaccagagacaaataatcatatgatggagagagagttactgcagaaagagtaatacacaagtacttgagatggaggaatgtgttaggcaccattggtgtactgaccatctgcagaaagatgcttcagattgactaaataccatgttcaaatgtgtgaacataaatataaaaaaaaagtttaagagccaccgagaaagcatacctcacccaatgagcgtatggtaagagtttcgaggtttggaaaaatatatggtagctccgcgcaagcatgattgagaacagaggaatacccaatacttaggttcttcaccagagatgactctccaaaggagagttgtatagggtgataagcttgataaaaaatgtgcaaactgtgaaggtttggagctttgttctctattactcgcagcctggagcatccacgcacttccacataggtcagccgctgtagcacacaaggcaacttcatgtattttatatgacggcaaagccggagtttcaaccactccaaagcaaacgaagcggaaaaaacgcaccccaattcatcccccgtgattctcacatactccagatgcagcctcgtcaagctttgaaagcaaccaatctccgcagtggggtgaaaggtacagcagtaaagatcaagaagccgaatcgagcttccactcccatcagatagaagtgagcaaggaaagtcataatatgcttttcccttggacatcgagaggctgagctcttcgatccttggtgtaacagcaatttgaagccatctttcgaggtaactgcgtgctttggtactgaagagaccattgaactcaatcgtaagagccttcacaccaatgcctgagtgtttttccataacgcgatcaatttttctgatgaaatccgttgtaccttcaacgatacccatcgtttcagtactaaaggagagtttgggacggtttctccatgagtatagaaaggcagaagacaagcaggcagcacgggcagcgtctttcattggcataagggaatgtatatgctgccacatttcctgcatgcacaagcatgagtgaaccattacattggaaacttgaaggctaaaacaactggattgtaactgcggtagttaaattgagcattgtgtagagaagggctattagttattactagcttgtatacattttactgctatggatggtattgcaagacacagccaaaaaccttaaaaacattatgttggagggggccaatagtgttaatttttttcaaaatttgctaaagctacagtaaaaaatactgtgaaatttgaatgcatgggggaggccaagccactgctcgcctccccctgtttcctcccctgattgcaagttgcaacatgacttaggcaacatacttgacaaatgattgtggtcctaaaataatatgtggatcaatcctatccaccacttgtataagaattaggaaggataacatgaaatcaatgttctaatagaaagtgtgaaccaagtaaacatgtgcggaggaagcactgatacgtttttccataaagttcaacagtgtaatagttatcctaagataccaaaacaaaccagtgtaatacagcagtctgaatttgtgtgcttcccatgactctgatttaaatcatacggtcatacccctattccaaacaagttactatttggtgacaatataatgataggtttattttccagcattaagtacccatggaaggagattctgcaggtagaatgggccagatacaagacatttgttttagtcaaggttatcagcaggtaagcatgatgtcatctgcaattaccgcagtcgaacaagacatacttggtacatctatgagtctatgacgagtacaaaaataaacaaagtgaaatatgtacgcaaatttctgttttagttggaatagttacaccaacttttacgcactatttgcactgtaactctgttagtcttccactaccaggactgtgtgtcatacctcaggaaggtatggacctgaatatctcatctttttgccactgcgaggactgtcatcttgttgataacatgagccctttcgtttctctggtgaggcaatagactcatctgcaacaactaaaggttaagaatatagtacatgcgtcaacaggagaaacaagaaattaagcattatgatgcaaacaatacatgcttggtctagtgtttgagtggatgctgattcctactctcaaaacctttagtagataagcatcattatttggtcttcttaattacaatctcttttatgaacagatgcagactgggggtaaacgggagctcatgtgctcaaccggagaacttacctgctcaaacataaaaatgtattcgcaaaaagatcatatggtcgaaactaacaatctaaaggaatctcaaacataaagaggtacttgcaaaaagatcatacggattgaaactaacaattgaactaacaatctaaacgaatcagtttcacctactcgcaaaagagagaggaaactacaaaatcgaaatccgagtcttgctgcacaatgctgaagtacattctctgagcaagcaatagatgagaaaccccattgtttagcttattcatatgcttatccgaatcgcttattagcaaataaaaaatcatttgtgaataaaacttttatattcgtgtccttagcaactcaaaagcaaatgttgtcaaataaactaagatgaaaaaaaaatcaacattaaaattaagtcctaaattcaatttttggcttataagcataagcataacaatgaggccggcatgaataatttgcattgtcacatgaatggcagaactcattgcatcctcacatgaatagcagagcagacaagctgagacaggaaaaggcgacttaccgggaactagggcatgtcgactacgacgacgacgacgacgctctcgctgcaagcgcttcagcagcacataccccaatcccatgaccacgaacccacgattgctcgtccgtccacgaatcgaggaaaccggcgtcgacttccgttttagtctcctacttatttgctctcggaatctgtatcttgtgaaggaaaacgagggagagagaccacataggcgccgccgagcgagattatttctcagcaatgggcctcccaatttagggagaaatcggaattaggattcctgaattcgcggttgaatatctgagtctccagcgccaagctccatggagaccatggcgattcgcgagcacctgggcgggctccatggaaacccgcgtcgagcttgccgaccgtaggggagaaccggagaatgacgcgggcggacgccgcgaggttctgcggcctgcgaccgccgccgcgtgcacgcgggtagcgcgcgctcgctctcgcccctcgcggcgccgctctgcgccgggtgggtgagacgagcggagcgccccgcggcggtgtgtgtgtcgctggaggcgggtgctgcggcggcggcgggcggcggggcggggacgccagccaggttcctctccgaccggatgcatgcgtcgatggcggccgcgccctacgccgccgcagcagccatccagggtgcccgttgaggggtttcccactttccctcgatgcaggcggcggccgatgagatcgccgcgtcgtggaatggcgggggatgacgccgacgacccgcttctctgggctcgattactccatccatgcggccccgtgacccaccggagcggaggccgacggcggctcaaagtcgaggcgctaatgctaccagctcgtcggagtcgccggtggattggagaggatcacggcgaagtggggacctctcggattctggaaggagatgggtgggtccacctcgtctatctgaacttcctactgacaagtgggtccgcttatttctaaccgttggatcaacttaagcgataaggattgaattcgcgttcgcgggccaaaccgttacggcccaacaaaataatctctgctaccctcggtttcttcgcgttctgagcatctccaacagtctacccaaatcacactcttcaaatacctatatagccaactcttcaattgatttagcaagttaaacctgttgctcactccaacagcgtctccatccaccctctctattttaagtgtatgacactgggacccgtatgtcagtctctcactccttcctcctccactttcctcccaactacatcaccgatggcaggccacgaggagggaaaagccggcagggggcaccgccggcgaaggggcgacgccggcgaagtcgtggcggcgtcgtaggcgcgggcggcggcctcggcggagtcgcggtggcgtccctcgtaggcgcgggcggcggagtcatggcggcgacgtacgcgcgggcggcggcctccgcggagtcgtggcggcgtcgcaggtgcgggcggcggcctcggcgtagtcgcggcggcgtccctcgtaggcgcgggcggcagcctctcgtcggagtcgcggcggcgtcccttgtaggcgcggcagcggtctcatcggagtcgcggcggcgtccctcgtaggcgcgggcggcggctacctccccttcccccgaccccagcccaccgccatcacctcgaggtcggcggcgcggagtgcgcggatggcgacggcagggccggctcgtcgtcgtcgtcgccgttgccgtcgccgccccgctccagatcccgaatggtcgaggggaagacgaagtgcggcggagccggaaggacgacggcgggggtggtgccgggagaacgacggcaccgggaagacggcagcggcggcgccgggaggacgacggcggtggcactgggcggaataggcggcgggcaagaaggtagccgggatgggatagggaaagggggagagagagagagaggggtgggacctacaccagatggccagccgtcctggctggacaactttggctagtgaggtggggaatttagccactcgaatggcttggagagtcatttagctagtctattggagtagatttttttgttcaagttagccaaattttggcttggagagccatttagctagtctcttggagatgctcttataagggcatccacaatatgataaaatactaggtagtaagcattaaattttctcttgttacctaccataaacattgtgagtcagtggcgtagttagctaggtggcattgtggtccatggaccacataaaaatttgattgagattaaaactatagtatatgtgctagttaatataataaaaattgtatattggaccacctatttaattggcccattacatatagatggaccatattttctttaaatcctagctacgccactttgtgagagcgatgaataactactactcagtcatatggctactaccgggcaacaaggaataagttatgttatttgtacaacgctaatgagcatcaacgaattgttttcttgcgggaaggaggtacaacaactgaggattggtgagtttttagagtgagccccacgttataccctaccatcctgcacaaacaatgtggcgttagtatcctgctactaccgcctggcgtgcggacccacgttactaccgaactcagtcataaacattgggcatgccctaatgtcatgactcatgaccaacgcccgtcatctcaccccttccgagaggactattcgcgctagctttgtcaggatcgtacctttcaaagcgtcgcgaccctcagcagagggtatcatagtttcatcagctttttagtgaggtatggacgagaagccgcgttggggagatgcctcgtcccgagttgtcgcctcgcgccgtggtagaagacggtgaggtggtggaccgaatagaagggtctacccgcgaagctccaccggtgaccgacgacccaatatgccactccgagaatttgtgttgttagttgatgctgttgaggttgagttagttcatgaatcatgccgaactagcgtagtagtagtcgcatgatgttgaggtgaattagtgtccgagtcgtactgttcactggtccagtagctgatgctggcatagtctactcggatgcgtccattcaatgtaaatccatgtgattcactgctcaaaatcatatgatatacgagaaccataaaatgatttctggctaatttgtttcatttgtagctgttgatttgactgtaaacccctttttaagtaagattcactctaggccaacttctaacaaacattttcattttaaaatcggataaatttacagctgggacactttaacgctctcaactattttatccatacgcactagttatcgataggtaaaaaccaatgttatcaacaaccgtttgtatgtttgagaagagagttaagtggtctacagtgaaacaaaacaaaatgtaagatttcctgattcaaacatgaatcaatgggtagttcaaaagtgaaacaactagaatattcaacttacatgtgaaatttatttattgtaggcctcatgttctctctccccgccctcctcatcggcgcctgtgccttcgcggcggcggcggttgcggcgtccggcgacggttgccgcgccggctgctcgctggccatcgccgcctactacttctccgagggttcaaacctcaccttcatcgccaccatcttcgccatcggcggcggcggctaccaagcgctgctcccctacaacccggccatcaccaacccggactacgtcgtcaccggcgaccgcgtgctcgttcccttcccctgctcctgcctcgggctccccgccgcgcccgcctccaccttcctcgcaggcgccatcccctacccgctccccctcccccgcggcggcggcgacacctacgacgccgtcgccgccaactacgccgacctcaccaccgccgcgtggctggaggccaccaacgcgtacccgccggggaggatccccggcggcgatgggagggtcaacgtcaccatcaactgctcatgcggcgacgagagggtctcgccgcggtacgggctgttcctcacctacccgctctgggacggggagacgctcgaatcggtggccgcgcagtacgggttctcgtcgccggcggagatggagctgatcaggaggtacaaccccgggatgggaggggtctccgggaaggggattgtgttcatcccggtgaaaggtgagtgctactggtttctcagtttgattttgactgttttagcttgtaactgtgagttgcgagaggttttggatgataattgagcatgtgaaaaatgtgaaatgtgaagtgcggtttggattacagtggtttttgcaggtagtttgtgaaaggaagtttggttactgcttgaatgttcttagcatatttatcaatgattggaacttctgagctatgtgcttcttcttttttgctctgctgtccaattttgcttggttgtatttgtgattgatttaaagcaatgcagtaactgagttttggttatacaaagtttaacccctgtcgtatgctatttcacatacacagatcgactttgtgccatggtatgcagtagttttcatgtttcgggagtggtaatctatttgatcctgcatcatggttgtttgaggcatcatgaactcatgtctatgctacatagttggtacaatggtaccggagagagtatcatgcaagtcgaattgccacccttttttttactgatacttgataattagttagttagcataaccagataattaacacaactaactgcaatcattcttcagaaaagctcaccactgtcatttgcttaatctcttctcttaaaaaacagctgttgtcaacaattaatcttctaggtgtcaatctataattctatatatgctaacatcctttactctgttatttatttccagatccaaatggaagttaccaccctctgaaatcagggtaagcattcttcgactgtcaggtgaaattacaactgtgatttcctttattattttctgatatgtatttcttgtgcagtgtaggcattgttcttctcttctgtgagctcttgtgtatctatgctaaggttatcaagaactaaagtgggtattgtcatgaaacactgatgttcaactcacattcttctaggtggaatggggaatagcctttctggaggagcgatagcaggaattgtgatagcttgcattgctattttcattgtggccatatggttgattatcatgttctataggtggcaaaagttcaggaaggccacatcgcgtccatctccagaagaaaccagccaccttggtaatgataaacctcctttcttggctgtaacactcctctagatcaactatgccaaactgttgaacatattacatgctttgtaaagtgcttctgttgtgattttggtatatcagctgctattatttgtgtggtaagtagcttagctagtcttctttttatcattgtacaaactgtatgatttctctgcaaatgctacaactcaaaattaatatgccttgtcaattacagatgatgcttcccaagctgaaggcattaaggttgagagatccatagaattctcatatgaagagatttttaatgcaacacagggattttctatggaacataaaattgggcaaggtggttttggttcagtgtattatgctgagcttagaggcgaggttggttcaacatttttctcatcatggacaacctatcagagtgcattcacacataaatcaataaggaggacacaacattttgatgtgcattcttctatcaatttgaaatgacttctctgctgccttcagaaaactgccataaagaaaatgggcatgcaagcaactcaagaattccttgctgaactgaaggtcttgacacatgttcaccacttgaatctggtgggtggtcttatgattttctgtaataatataacagaaataatctcaactaccaactgaactttacattttgctatgcttacttacagaacgagaagataaactttgattagagtttagtaaagaccataatacctttcaatagggcacggcatcatatttttcatgttggaatagtactctcgagtctctgtactcgagtctctgggtgtactttgatatcgcctaattgttcgtcatgcaggtgcgcctgattggttattgtgttgagaattgcttatttcttgtctatgaatttattgacaatggaaacctaagtcagcatctccaaaggactggtaattgtttgtttgaatgcactctaagtacaatgagattatatcctaatgatttctgtgaattattcagcacgtgcatttgtctataggttatgcgcctctctcatgggctaccagagtgcaaattgccctagactcagcacgtggtcttgagtaccttcatgaacatgttgttccagtatatgttcatagggatatcaagtctgcaaatatcctattagacaaggacttccgggcaaaggttagaattgttcatgaaactctatgttggcctcttatcttcaatactcaatttcttgtttgaagaaagggtgaagggcatcacctctttcatttataggagatgcatgaaatacagaaacgcaagtttgttgttatcctgagaatatatgtaggaagaactacttatcttttatttaagaaaaactaaaacaagggtgtttctcctctatgattaaaagaatgatctcctctaagttaatttttttctccttggaaaattcttcagttctgagctttccatatcttccaactaggctggatcaccaacctgttgaaaccatgccagtctcccctttggacaaatctgggggctgtttaacacctcattggttcttgatgttgtatagctggcatgtttagggaatctctgagctttgaccacacctgcaatatatagggacacattttagcgatgtttgttgctgtttcctccacacccccataaagtttttaccatgcagattgctgattttggactagcaaaacttacagaagttggaagtatgtcgcagtcactgtcaacacgagttgctggtacatttggttacatgcctccagagtaagtgcttgtagtctctctttatttttttctgtgtactaactgacgcatataataggccatacatcatatatcatttataggcttatagcactatctgctatactgatacctatttgcaactagtacagtttagcaccaaagttgtatatggtttacttcccttttttttttttgaacgaactggctaaaaaaagtatagaaattaattatgagctccttgtgtttaagggtccacattgctgactcttccttgatttttgcaaatagagtgatcacttatagctccttgtgttggaaaattctgacaatatttttcagagctcgatatggtgaggtttctcctaaggtggatgtctatgcttttggtgtcgtcctttatgaacttctttcagccaaacaagctattgtgagatcaagtgaatctgttagcgaatcaaaaggactggttttcctggtaatatttttcctgctatcaaattgctgtttttcctgttgtcacttgtaaatgttaaccagaattcatgccatgtgctacaattaaatactcagatcaataaatttaccatccttcttccaatagaaaagtaatttcgttatcagtgtatgtaactacgccgatttgattcattaccaaatgttgtgaat

SEQ ID NO: 69338 - DNA, 1767 bp, Oryza sativa
atgccctttgttttaggtgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatccctttgtacagtttctccctctcttattataaaaccagcaaaagctggcttaggtttcaaaataattgcatccctaagtaaacatggcctttgctgcagggcttgactacttgtctccatatggagtaatatactaatcactcgccattctcctgctcgtttaatatggctggtcgtgtatccagctagcttgtgacatggctagctattcctgaacgaataatgcccaatctcaaagcaaatctagtttgacatcctcacatatttttggatagagcatcccaagctggaacagcagtagagatttattggattgaaggacaccatgagacaagccacccgaaggggaaaaaaaagggccttaaatcagcctttttctcattgactggaaaatggggaaagaaaggaataatgcgagaatgtttagagaaaaggaagctacaaatcatcaaataattattcgtttccaagatgatgagctatgatgctggggtttggccagtgcaaaacacatgggaaaattgttgtcacgaggagtaaggaggattgacgtgcaagcatgttacagttacacatgtacagttttttccttacttttagcgtttggatgtataactaaacttccctctattaatataacgccgtcaatctgattagccgtttgaaaaaaaaactcaattcctgaacaaaatatctgaaagttctgagtttaccggtcgatacccttaatcagctggaaatttgaatttagaaatacaaaaacatttgaattgggcgtcattctgatttcaatttttcttttggcatcttctcaagcttgctttctcattgcaaaattataaagctcggtaccccattgcaaagtttgcaaccactgcaaagctgaaacagagaaacatggagcagtatctcttcttggccactctactgatactatctctcgccttcgtcaagctcaggccacgcaacaatggcgagaacccgcctccggggccatggcagctgccggtcatcggcagcctgcaccacctcgccggcgcgcttcctcaccgcgcgctgcgtgaccttgccacccgccacggcgagctcatgctgctccggctcggcgagctccccgtcgtcgtggcgtcgtcgcccgccgcggcgagggaggtgatgaggacccacgacgccgccttcgccacgcggccgcagacagcgacgctccgcgcgctcacccgcgacggcctcggcgtcgcgttcgcgccgcagggggagcactggcgctgcctccgcaagctctgcgtcacggagctcctcggcgcccgccgcgtccgctgcctccgccgcgcccgcgaggccgaggccgccgccctcgtcgcgtcgctgtcgacgacgacgcccgagccggtgaacgtcagctccctcgtcgccaggtacgtgaccgacgccgtggtgcgggcggtggtgggtgaccggatcagtgaccgcgacgcgttcttggagaggctggaggagggcgtcaaggtggccgccgggttca

SEQ ID NO: 69339 - DNA, 2981 bp, Oryza sativa
taaataaattgagagagagaatgaaggggtgaggtgatcttttgttgttttgctttgcacactatgatatggttgatcataagaccaaggatagtgcgatcttctcaggtcgcgtgggcttgtcctgtcacggctagaggctttgattagctagggtttgggcagaaaccttaccttttatagggataactcaagactgctgctatacacacccgtgggtatttttcatgtaaatagtagtttgaccctcaagaaggtcattactcttccgttcaggaatataaggtgtattttgactgtccaattttgaagagctttgacgaactattaatccaataatatttaggttttaccataagaaaaggatattattggattcatgtttgaaattactttcttatgactctgattttgacagtgtaaaagtaccttaaaaaacatctttaattttccagctaaatcagatccttcctaagtcctaactgatagatagggtacaaaataaccaatcccatgctttgaaactaataattatttaggcaatagatattcttggaaggtatgtaaacccttcccatattctgttctacaatatgcattactgtccgtgcttcaagcatcaacgctcataacagctgatttatcaacaactttgatccaatctatccctattaccattttttgttttcttaaattcaagcttctggtagttatacttcttgcaatcggcattctctctagctactaattgtatttattatatattacagaggattgttaacagggagaaacagcggtcaacacgtgcaaggttctcccgtgaaaaaattcttcacgaatgcagactgctccgtgagcgtctacaggaatgtactgccaagtttgttgcagatgagcaagacactatgactattgatttatcatctttgcctgatgctttagatcttgtgacgacatcagacaatagaatacgtttgcttgttgctgaggtaatgttttaaatatcttttgattagttattgtcattcaaactccttctagcttctcacgggaaaggcacacttagaaagttgagctcaaactccgacggaaacatcagacactacctgacactagattcttcaaaggatctggagtcagatttggaacaactcctggcctaaattgatttgtagtttcctcagcctctgcttatgtttgaagtttgagccacctagttgggccttcaaagctgcattcttgattctattggaacaaggtttacgtgttagttttggttagctctggggaacagttttcatcttcccagctgaagagtgatatcatttcagagtcagtaaaactatatttaacaaaatgagtaaaatgatctatattttcacaaactttttttcctattttacagtcatagatgcatttactttagattacatactggcgccactatacctaaaaaagaagtcttgccaatgaccaatgtaatggtcatcttggtacagaagacattgttttcagtgttatgtacctgtccatttagaaattgattttgaatattcaaagttacgcttctgttttcatgaagttctcacttccttgtgcccatgaaagcggatctgttagttacatttacattcacaatctgtgttctataatgatcctctctcaatctctcaggctcaacttctgtcacgagatgatgaacagggctcttctgatgatggtgataattctgatggtaaatcctcagttaccatgagcagtgaagatgcatatgttactgatgaagagacaacaaaaatgttatctgatctgcttattgacaatgcacaactgaggttgcgcttgaattctctcatccgtaatgctgtaaatactgctgtgaagacggagaaagaaggtagtgatggaaccgtgccaaaaaagacggtgcttaattggttattggacagatagaaaaaccagtatatattcttgtgaattagctcttctagttatgcggccttctcaaagttatatgatgagtattgttataatgtgggagtaacaggagtggagaaaaaaaaatcaaaatcttccttacatgcagatcaagcatgtggtggtgttgtatctcttatttacaaagattgatcaaggataatatatttaggaggcttctgagcctggcctcctagcgggagaacggtagggctcatatggttttggggaggcttgcaactggagtggtagagaacatgggtcccccttttttgcaccatacttcaatttgtaattgccgagctgatggatagctgcatggttgtatctttgtacagatgtttcagatggtgagttcccagcaggaaagcattgtacactatagttaaactctggattaatcttcttcacccatagagtgctcaactgttaaatcagtacttcttactcatgcagttgcacctcttccagactgaaaacttctcaaagttctcatgttgcatacagctggtaataagagcgtaatttactcaggcatggacacctgaccctgcctgatgtttagatcattacgtgcgtacctttatacagatggtagccgccacctgtgtaatattttccatgtcactttcagtctttcgttagagttttcaagtcgctttctattttactttattaaatgttcttgacaagattaaaaggcgtatcctgaaattttttatccagatgttcttttttagataatagaatctctactattataaaaattaaaaatgtttttgccggtactttggtacgtcatccatgtgatcgttcgcttttagaaatatagataagtatttgactcggattttaagttcgtttgttttaggaaatataaaactaagtcgtataaaaaaatcttttaaaaaaactcacatactaacttgagataaaagttggactcctgactgcatctcatatttgttgcaacgcaccggtatttttttttctagtaaaagaaa

SEQ ID NO: 69340 - DNA, 987 bp, Oryza sativa
aatattgtcttgggatcttttttgcacggtttatgatagttgaggggtagagatttttgctatcgcggattagggacctcagacaaactcaacataaagttgagggccgtcaggtgaacttatattcccttatagttatgaagtgactttatccctcaaaatgagttcactttaggtcccttacttcatcgctccgtctgttttgtgatctttttcgcacggtttatgattagttgagaggtagagattttattgtggattaggaacctcagacgaactcgacttaaagttaagggacgtcaggtgaacttattcccttatagttaaggaagtccaagtggactttatccctcaaataagttcactttaggtctcttactttgtcgcttagtctgtttttcatccttatccgaaaaccatatacaatccatccttcaaagtgtgcaaacgaggtccctcggtaataatatttctggttttggctgacatgacaccttcttcaaactgtgcaaacgagctctctcggtagcaatgtctccggttttagctgacatgacgcctttgactaggggtcttcgtcccacgtgctattgacatgacgcttacgtggctatttgataaaaataataaggaggtgtttggaatggactaaaattttttagtcccttccaaattggatgtttggacactaattagaagtattaaatatagactattaacaaaacctatccataatcttggacttattcgcgagacgaatctattgagcctaataaatccatgattagcctatgtgatgatacaataaacattctataattatgaattaattaggcttaaaaaattgggttaattggatacatgccattgtaaattcttcagttttgaaatataccattactactcaactatttggaggtatgccattataatttttcaggtattggaaatataccattacataccccttggatatgtctaacaaaa

SEQ ID NO: 69341 - DNA, 3030 bp, Oryza sativa
aaagttgagggacatcaggtgaacttattccaactataaggcaacgcatcacggcccatggcccatgggatgcgcattctggcccacaaagcagcacacgctctctcccccaccagtaagccctagcctccaggagctcagccgtataaagccgcagaccttctccttcccctccccgccgccactcgccgcagcgtctcgaccagacaagggagcgcctccgaaaccctagctccccctttcccctccgcggccaccaaaatggtacgcttctccctcctccccgtccgcctctctccgtcgcacgacggcaagatcatgcgcgtgtgtgtcctcgtgccagtccacggcaccctgctctggtcgatttgtagggggattgcattctttattcatgttgatctgctgtagatgggggcgatcttgagccggaggagtagctagcttcttgttgatgcggtttcgggatttagagatttaacacggagattgatagtttctctttagcgatttctttttttcttgttgatataatgatatccacggtgattgtactagttatggtttttttatcttcaatgctttgaattattgtttttgatttgtgggtagagaccagattattgttgttaagatggacggattctttgagctggtcctttgcatgctctgaagcgcagaaaatttgtgtaatgggttatatctggattatgtgtagctattaacttctgtagtaaacattttcatcttcctttgaggacatgggatgaattcctttttttcttctcttgttgtgctaaaattgttcggtaatcttgtctgtggctttgactgatgggctccgatgatggcatgaaatctttgagacctgacattcttgtgatgacaaacataagcatatttcctgaggacccaattgagtttttaaccattggtctgctgaatgtgtctttgctgttgaaaaatatgtatacacatttgcttctgattatgcacatttgattgtgttgtttataggcctgctatgtgctttccaataaccagtatttgttaaatttgtttcatatttcttatgtatataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactatagttgttggtctactgtgcttcaatatttcaatgttattaggagcttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaataccatggatggaggtgaattgaaagataggccttggtcttgtgattgttatcttagaaggtcgatactaatgtttggtcttgtggcgttagtgaaactgttttcgtagcaatgtttggtcttgtgatgttagtgaactgttttcgtagcattgtattacttgttccattcttcatgcatgatttggataggttattgacaattgtttatagtaatgaattaaatattacactcctaaatctattatataattaaaggaatagaaaaaggagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataatagaaattctgaattaaaaataaggaatattagaagtagagcatagagtccatatagaaatacaattaagaaaaaaaatagaaatttggaattaaaaataagaaatattagaagtagagtatagagtccatattggaatttaaaaccaactaaaattcggaaaaaaaaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagt

SEQ ID NO: 69342 - DNA, 1155 bp, Oryza sativa
atagagcccatgggccgtggtgccccggctaagccccgcaagatattgtgggcttgtggccgcactttcagcccaagggcagtagtgccccggataagccctgcgcgacattgtggccgtttggttggtaaaaattttactcttgtgacaatagtttctagattttcaatgtacatgtgatttgcactatatatttttttacgcagatatgcattatccttgttcacaaaatcttactactaccagtttatcgcaacttaaaaattcgcttctcgttgattcttgtatagtagtatctcctataagtgcaggcgaatattgaaaccttaaaaatttaatagacgtaaaaatatttaaaatatgaaaagttatattggtatatttttatgagaaactctctttcataaagatatattcgccatgctctttaaatatatagtttagtctttagagactagtggccctgcggcggtcgcggcgacggatctagcctcccccgtcgtcgcggcggcagatccggcctccaccatcgtcgcagcggccgaatccggccccgagcttatggcggctagcggtggagaggaggaggccacgccccaccaccgcggagaggcggtagaggcgacggcagccggcggcggtggagaagggaggaagaaggtgaaaccgagagagaaggaagagaggcggcggaggggccgcgcagtgggggaagggagaagggagcggtgggggtgggggacagtagatttatatattcgcccaaaacatttttcgcagtggtcctccttacctactgccggtgaaaatgagatttttcgctggcggacacttaagaggtccgcctcgaaaaactggcagacacttaagaggttcgtctcgaaaaatagagtagtttttttaggcatttgtcttagcgtggttatcagcaaaaattggtttctgctggtggtccgtagccccccacctattgttatgtttttttgggcggtttttgcatatggacgccagcgtacaatatagggtaacatcacgaaaaatcgttttttatagtgtaaaattgttatgatgataaaatgtgtattgcggactatgctgatgatgtcactcatctgaaaacagagatagtaccaaggagtgaacacgttacatatg

SEQ ID NO: 69343 - DNA, 10141 bp, Oryza sativa
cccccccccccccctttccttttttttcttcactgctatcaacagcatctcacctgggcaataagttttgttttgttctagtactaaggccatgtttggggaatttaaaattctaagaagtgaccggtgagaatctagagaagtttccaaacttttggattctagtttattttttggattctattactacagcttctgaattgcaagagaaagcttcgtagttagagattataagagaagctatagctgtcagaagctctagacctaacactgatgggcgttgctcccgttgttgcgtcgtcggcgtcgtggtagtaatcgttaggtgaggcgcgcggcggcggcggggaccaaggcgcgcgggcggcggtggtggatgccagggcgccgcgttgcgcggaccacgcggccgcggcgtacgggggcggcagcgcgggtgtgggcgtggggcggtttggatgatttggcgttgtgggcggtagttacgcgcgaggcgggtggggcgggagagggcgagttgtgtgggccgggggtccggatgaatagaataaattggtgtggtgggccatctcggctaggccggcccacatgcatgcagatggaccatgcggtgcgagatccttcttcgttcgtggctatcccgtgttcgtgtttgcttgccggtctcctctcaggcaccgtcttccgacaagctttcaggcgatcgtaggagaaatttccgcgacttcactggtggcatgtactggtacgcgttcatttacaacgtggtactgcatgaatgcgcctgatgcaaaacgtctcctaatttatttgtatagctctatacatgtttgagacgggaaagaaggagagtaagaagatatggggaacgaaatgagagcatataattagttgagtattaatttttataaattttaaaatatagattaataaactttttaaagaaaatttcttattattttttataaaagaattataccatttaataattttgtacgtgcagaacaaattaaataaatgcttatatagttacacttgaaatattttcaataaaaaagcaattcctttggggacacaagtttcatcaccgacttgctccgcctactatggtgacgacacgtactcactagctagaataagcaccccttgacatacaaaaccaaaacaaacatttatattcttgtttctgtttagttcacgaaaagaaattttttgaatgtcacatcgaacgtttgatcggatgtcggaagggatttttggatacgaataaaaaaactaattttataactcgcttgaaaactgcgagacaaatcttttaagcctaattaatctgtcatcagcacatgtgggttactgtagcacttatggttaattatggactaattaggcttaaaatattcgtctcgcgatttctcccctaactgtgcaattagttttagaattaatctatgttttatgcttccatgtatgtgcctaaagattcggtgtgatgtttttgagaaaaaaaaattaggaagtaaaccgggcctaaccccatctaggcatctacagaactctccaccaaaacccccagccgtgtcaacgtgtcgcggcaccaattaatcttggctcccaaccccacatgtgcatccctgctccaaattaaatcccccagaatttttccaaaagcaattgcccttttatcgcgtcattcctgatcattgccacgtacagtgcaatgcaatcgatcgatcgagatcgaattcgatcggaatgtcacatctcacgtacgtacgctagctcacgctgccaaccaaccgcgatcgatcgccatttagcaaacagctcgccgcccccggggtccgggcatctatggggccattgctggttaattggtgtgtgcatctggcaccacgcgcatgcaccggcggttatatccggccatgcgtgcatccatgcatggcactactactcaccggccgcggcgtccctacgtgccatacgtgtaaggaatgggagtaataatatccgaccgatcgggttgctaaacgtcgttccatggagatttttctctattttacagtactttctccgttttatattataaaatattttaatattgcccatatttatatagatgttagatatatatatatatataggtatctagatttattaaatatttatataaatgtgagcaacgctagaataatagtaaaggtactttaaacatgaacatgacttatatttttctacagttatttaataagacaaagatcaaatgtacgcacgtccattaaaaatcagaggaagtggccggcatgcggatccagtggctgccaccgtactcgcatgagtaatactgtaaaggattcatattcattagactagagtaaatcaacaaatactggtgtgagttagtcacatctctgtgtttgatccacttttattttttttaagaaagtcgggacatcttatatctgacttatattatatttaactattgtacgtaggtcaattaggagcggaggcaaacctatgatagcttgggcttaagccttagggtttcctccataatcaagcttaattcatcttaaatcaccatgcatttcctaaaaaaaatattctttgtgtcctacttaaacctttaaggctttgataatttatgtatggttccacaaactggaccaacggttactgccaactttaggatagagatctgccacgttcaatctctatattttttttattttctagagaatgcgtactttttatccagcctatacatccaaatggatatacacattattttaaattgaaaacttatcgattaactcaatctaaaattcgatcgtatgaagatttaaatttagaataattttagagtgctactcaaatcactgcaaccaataaactacgtgctcaagcgcacgtccaatctctacatacacgagtgacacgcacccatcgccggctgctagtaccgtatgcccatacacagtacgcatacccacaccccacgatggaacgcggaatgtgtatctttcgccaggttcagagtacacaagaatttttagtagcatgacgcatcatatcctcataatcatccctgtgtgcgactgattgatcaatcgatcgatctctcgatcgcttttgacgacgcaactgttgccgccatcgatcgaatcggatcggagatctgatcgatcaacgcatttgcgactagtgagagtagctggctggctggctgtggctgtatgaccatgtttagttcccaaaaaccttttcctaaaaacatcacatcgaatctttaatatatgcatagagtattaatatagataaattaaaaaactaattgcacaattagaggggaaatcacgagacgaatcttttgagtctaattaatccatgattagccataagtgctatagtaacccacatgtgctaatgacggattaattaggctcaaaagattcgtctcgtggtttccaggcgagttataaaattagtttttttattcgtgtccgaaaactctttccgacatccggtcaaacgtcctatgtgacacctaattttttttcgtgaactaaacagggcccatatatatgctgctgctgggtgggggcattagctagctgcagttcacgctgcactgaactgaaagcagatagagatggagacgcagtgcgtgtagttggaaggtagctagctctagctagatcagcagctcagctttggcgttgatcgatgatatatcgagagaccgatcgttgcaggtttgaccggcggcagaatggaatggagcatctgacatctctagctaaaagctactcatgcatcatttcttgatcttcagagaaatagagatatatatcagagggatataattaacaactttatggatgtttaggatgcaccaaatagtccattattgatcactttacacatggttattaagacatgcatgtacaatggtgtgacatagcattattcatgatgtatagcaagtgagataaaagagagaaagatgtgtaatcggcagtttaatataatttatattttgcatatatatactaaactaaatcattagctatattatagagggcctggtatatatatatgacttgtttatatatggtcgacatgaaaaagattatatgaacatcaaccatgtgaaaccgttgtccatgccctagttaattagtagtataataatcatgttatctaagcttcggtccaacaaaaaagtactttttgagataccgacatctcacggtaccaaatcattttttatcgttggatttaacaatgtccatcctgtccggttagattcaacgatcgaaaataatttggtgccatgaagtaccggtaacttaagctattttttgctggatttgagcaaatctctcttacttgtttcctatagatttctctcttttctttctctaattaattacattggtgtaggcgcgctaatttcgcattgaattggcagagaggggggggggggggggttgaacctagctatcagacacatgcatgtcgatgagtcgatcgatcgagcgagtgtgtggcctttaacgacagccttttgcataaatgcctctgaatttattcagctagcgctactgtactgcatgctgcgttcgagcaaattaagctagctgcagctagcttcgtctgctgcttagcttccacctaccgccacctgctttgccgccggcggccggccggcctcgccgcagcgggtaatgcggctttcgccggccggccggccgccgtggaatgctgcgttgatccggcgagatcgatcgatcgatgagaggcaggcagcgaggcatggggtgttcgtcgtcgtcgtcgtctgaatatgtgcatagtgcgtatcgctgcttctgaattctgatcagctcggtggcgtacgttattttgtcactgcatatatgtgcagataaatgcaatgcattgcatgtgtctatatggacatgagatactctgactgtacacgagatatacgcaaaaaagttagtgggtacagtgacggtggagctgatctcaggacagtggagtcagaaatgtattttgacccaggaaatgtgtgtgaaagcccagaagctgtcaaaaggaattaaaaaggaaaatccataccatgacacatcctgtttttgacgttctagtcttgtagtaggagtactaattaagttaattatttctatgtttgattattagttttaaaaggatttatgatttttagattcatcgtgagaaattacatttctggctatgtgaatataccggatgaaatagtaattcacaggctaggtccaaattaatcctagtaattatagaggcccacaattaatgttaagattttattatcacattggaaaccaataagaaaggacttcaactcaaataggctgctaactgagagcacctgttgagcgattgaggtggtggccatatgtcaccgtggtgggaatgtcaaacatgcgcgcgcgcgaaggcgaggcgtggcatggtgtgcgtggcgccacggagacagggtagggctagctgctcatttttccgaccgtttgtgtttctatgagcaaaagcgtaaccgacggtatcaatggtgatgttacaccggtaaaggatgagaccataatgcgtcatcaactctgtaacgttcctcttgcgtgcgacactattttccaccttcgggtagacagagagttgtctctttctcggttcaatccctctggttcttcctctcggcacaattctctactttctgttcctacgcagtttcagtttgatctccccggttttgagtaccttggcgcacaggtactcagagcgagcagatctccgaaactccgtccacctgagtacctgcacgggtaggtgagtgatcaagtttttgggagcgcattcgtgactgctctaggcactgccctctacatcacgctctgcttcctctatattgacaatccctcggatcatgtcgatcagtactggcaacggaaggaaacaacggcaatggaggagagaacggtaacggcggcgacaataccaacaacatcgccactggatccagagcgttctccaagtatgtatttgtcatctcagtgttaaacatgtttgatgctattattcttgatagcatatttatgtttatcactatgttagaatcactcatcttttcacatgtcatgtttattatgctatatttttggattaaaacatgtcgaattattattactaaatttccaacagatcaaagataaaaagtataatactctagaaaaaggataaaaatgacatgtaatttacaacggagagagtagaaccgtgacaatgctacacgattaacacttccataggcttattagcatgtgaatgctacgctatcgattaattgcggcatattaggggctcagcctccaccttctctctttacaggagagcagcgtttcaacagtagtttttccttttactttagcagttctttgtttttccttttttttcttgcctcaaggaaatggccgtccgatcgattgcattttgtaacttaaaattttagatctgctttcttctaatatactccctcctttcctaaatgtttgacgccgttgacttttttaaatatgtttgaccgttcgtcttattcaaaaacttttgtgaaatatgtaaaattatatgtatacataaaagtatatttaacaatgaatcaaatggtaggaaaaaaattaataattgcttaaattttttaataagatgaacggtcaaacatgtttaaaaaaatcaacgacgtcaaccatttagggacggagggagtattattatgcaatcgtttgcgcgttagtgaaagaaataattgcggcctatcaccctatagtttggtggacgctagaaactcatttctagcggacatgttgtaatcaaaagacacagctagcgatgaaccgagatgacagtagacagcgtcattatcgcgcggcagtgcatgttcctggccattgatcagtccgagcccaccgctgatcacccgctaattaaactcttttcagacatcgccccccgtcggcccatgcagccttgccggccggccggccggccgccgccccccggccccggcgcccatgtcgccgccacggctgtcgtcatcgcgtcgccgtcgccgtcaccgtcgctgcctcagataattcattcattcatttggtcatgaatacttaattgttccttccgtttcatattataaaccacttaatttttttcatttatttggttatgaataattatttcctccatttcatattacgagtcattttattttttttcaaagtttgtttaagtttatagaaaaatataacagagttttcaacacaaaacaaatatattgtcaatatacatttagtgctatatttaataaaactaatttgatgttgtagttgttgttaaatatttttataaacttgatcaaatataaataaaggttggtttggaaaaacgtcaaaacgaaacgggggaagtatctacgatgaaagacaattaatcatttggttattatgatggggttttgtttgatcgattgatacacgttggttggatgggatgattagttgatttggctctgtgccttgctggagatcgacaggtcaggccgggaaataattttgattcttggagatgattttgatcgatcgatgtgacgcggggtttgtgtttggtttgcagctgattgtgattgagaaggttgattagatagccgtggggcttacgcgttttaatcaggctgtacctcgagatgggttgatcaatggatccatgaaaaccgctaaatcgcagccgactgattatgcacccggtttctaaacctagctaggatgtaaatagtcatatagtacgagattaattagtagctcgcataatgtatctctgttttttgttgtttcttttacatttgttcgtatgattttttttaagaagggcaaaagtattgtcactttttgtatcgataaatagagaagtgttcgtatgatcgattttgttgtagcgttattttgttgtcgttgttagtgtgccagatcgtgataaaggctctatttttttaataaaaagatagtggaatttattctcatctttagttaataactaattattatagaggttacaaatcttttttttgcggggtacagaggttacaaatctaacgactgtgaattacaaatcttcatatagataattatgtttagagtataagtgaattacccgattttccttatcagtcttaacttttgtgttaaattggttggtgcatataactcaataataatgtatttttttttgaaggaaggcaaaagctttggtaaaacttctacctatagttggcgagaaactacatagccattgtctctctagagatttgaaaattgtatgtaatccttgtctttcccaaccaaaaaataatatcttcgaaaacagcttccaattattatgcatatcgaattttgtctgcatcaccgttggagaccaacgttgaaccaaagcaatcctctaatatactccttccgtcccaaaaaaatcattctagtattcgttattataggaacggcccatccaatgctaaattggttttatgtgggatggagggagtattatatacgctaacttcagtttttcttgttatcaagcacgatcactttgctaatttgcattatattgcatcccaaaattgtcccttggccaatggctaaccgagcagcatctagctagcaatccaaccaagcagacttgacatgtatcaagtattcaacgtactacaaggctccagcatccaacctgaaaccggcatggtgcgtcgctgatctgattctgacctttccttagctgtctatgtatggctctgcaggcagcaaaccaaggaggctaccatccgtgccacccgtgcttggatgcatgcatgaacgtcatgtccagcgccagcctctgaaactctgatccctgcattgtcaatcgatgagcttcagattcgattctttgcttgtactacgtataatctctttcatcatctcaagctgtcaaaacaaccagtactctactaatgcactagtctctccatctcaaatcatactaatctagtactcaattagagacaacctattactataaatttagacaattctattcgacacaacctaatactaagagtattaggttactatattttaaaacagatggaatagtagtaagtactactcgtttcattttcgtcgtcatcagtaatttaggagtagatagtataataaccgtccgtcatgatagttgcaaaggcgaagccagtggcaccgtcaagcttgaattacaaagagtgtttgttagtgatcgagaactttttacatttgatgccgaggaaagtacagtgaaaccgttgacggtggagcctaggcaatcgcccgacctgtctgagaggtggcttctttcctatatagttgtggctaacttcttctctacgaagagagtaattatatctacggttctatatttatacatttcttttgggtcccgaattcctgaaaaagaatttggaaactttggtccggaaaaaagtattaaaatttaaataaaatttgctaaattcaaaaaatatcgtgagaagtagcttcctgtgcttgggatccaaaatttcgttccgaaatattgaacctgacttatatcctgaattagaggccggcaacaatgggtggtcagaataaacggtgtgtgtgatgttgcatttagcgtcagacaatcagttgggctaggcacagcgcccaatctgaagaagaatctgatccaaggctagctgataaatgttcatgcagggaccagtacctaactacacagcaacatttactcctcctccttaagattaattttcatctttagtaacatgtaaggtaggtggtatgtgtggttaatttactgcgtaaagatccagagacttttctgacgaaaaagttgcaaagattcagagattgttgcatcgcccttgagacagcagcaaattcagtgaccctttcatatgaacaaatggtcgcttgtttttgtctaagtagagtacaatggcaatgacaaagaagagactactacttctaattaaattgatcctagctctagtacaactctttaattactg

SEQ ID NO: 69344 - DNA, 2177 bp, Oryza sativa
ttaatagtactccagaacatttgtttgagttgtttctgacctgagagtggtcactgaaagcatcactgtctatgccaaacccatacagcacagggctcagagatgcaatcctcatggaaaggaactgtgtcacaatcagaggtagaatatgttatagctaagcaaaaactcttgtacctttaattttttttttgtattctagtcatgttaattacctcaacttggttctgtaaggactgcacatagttgatgatctcatccaaaatgagagcctttccagtgacctacacagataaatgattttttttcactttcaaagatagtatcaaacatattaacatatacaaaaaaaaattgtcactgcaaataccactagtttagttagtagttaactagtgatctaaccttgtcacaaccagggaccagagcctgcagcatcctcatcctctcactgatcctttctctcctcacctgaagaaaatgccagagcagatagcaaaaaatgagtcccaaacaaccaaagctaatagctgcacaaaccacaagcaaaagatcaaagttgaggaagaaatttaccctctctgcaaggctgtggctatctgttgcttgccctctccttgccctgacatggatgaacccctgaggtgcctcctcctccatctgatccctgctgtgtttcttccctcccctcttcctgccattctcctttgcctcctgattgttcaacacaacatcatatgatgaaacaaagaaacatgagccaagaaattcatcttggaaagttatctgaagctgtattcttgaaaggaaaaaaaaagagattcagaaactgttttttcactgtcatgctcatgtgcttttctaccttggagtgagcagagttgaggctggcagtgtcttcttccctgggcttcctcttcttgtcctgtggagaggtgtcaagaaccacagatgaggtctccattgaggcatcttcagggatggctggagctgtggtggttgctgctcctccatggctgccatggcagaagaggaagccattgttggtgatgaggccatgctccatctgctgtgggaggtgtgagaagcctgccattgccaatgcccttggtgtcctagatgctactacctagctagagctagagatacctatatggtggtggagttgcttcttgttcttggtgtctgaactgaaagatgaagctctctagattgcaacaagttggctccttggtgaccctgctattggtttatataaaagttggggagaggggggattgataagaccaaatcattataaatcaattaattgatggataggttggcaatgggcagtgttaggaaagggcccctgtgtccctttgctgtaggatgaaattgtaactgaagaaaatgcccatcattttattttgtatatactgataggtaggttggctcctctttcttttcttctctttactaggagtatttgctagtcaattagttgtctcattgtgtgtgtaagcaccttttttaaaaaaaaatggcagcagctaattatgtaataagaacacacattcaatttcgtgtgttgaccatatataaattataaaatggtacattgaattattatttgctccacgtctctaaaaatacattttctcaagaaactttattttactgtgttgcttagatcacttattctaagttatttgttaagtttatttttaaatatatttaatttatctctataatcaagtagatatataatctggtaaataatctatttaagcagttgcaattgcttgagttaattgaaaatatcatacttcctggtgtttgcaggagaaaaatagctcaagatatccaacaagacttctttacttaagttcatagctttcaacagaattttgtatacattttctgctaggatataatatgcagagatccttcatttcctgtacatgttgcaaatcttcagtctgtgaaggagaaagctttcagatgtgcagacctaacaaaaacataaagcctgtgaatcattaactgcaaattgaatcctcctagcagtaaacattaactatgctggagtgttggagtaaccgatttcctgatagcagtcaaaggaggctgctttcttctgggtggtgaactgcaaaaacgcagtcctacgatacagtgccagttcgggccccgtt

SEQ ID NO: 69345 - DNA, 580 bp, Oryza sativa
aaaaaatggatttttcttttacactttaaagtgtaaaaactccaagtatttgaaatactaactactactagtaaagtgtaaacactttatataattaaaaaagagaaaaagaaaaagaataatgggcagtagacgggcccctttggttggcccagtccagtagtacaggtagaaactaaagcccattccattgaacaagaaggagtagaaaagcaaaattgaaggagaaacgtacgagcgtgcgaattggatgcagctgagaaggtgttcgtccgctgcatccgcatccaatccttcccggcgaccgaataccggccgggaaacctccaaaatcgagctggccggcaaggccgaatttcgctacatcggtttcatctatttaagttgagtaagagggaatcatgcgctggactttgaactatgtaatgaacttcattatcattattatgacgatgaactttaaggttgtggagtatgtaggactttagatctgatcgttgttgatggctaaacatatagtttctcaatatttattcatcaggacaatatttcgttagaatattctactagtgaaaaattt

SEQ ID NO: 69346 - DNA, 644 bp, Oryza sativa
agccccgcaactccgaagctctgtttcaccaatccattccatcaaccaccctcgtccgtcgatcgaacaccttgtgcgcgatcgactccacacccctccattcatcctccaccttatataccccttagaacacctatatcctaccatgttttagcatactagatcctaaccgaagctctgcgtcgagttttacctcgccgtaccaagccgagcaccgtcgaccccgcgctgttctgttattcgccgccacaaagtttttccggccgcaacccgtcgtttcaaccgatctcggtgagttctttcgttttaaccatctatgtactccctagattctattttagcaattggtttgatctaccatgccaccctctgggctgccgacgtgagcacggacaccgccaatggaggagctcgtcggcaaatatattacacaccttgccgaaggtcggcaagctgcttaaacccttctaggtacctgatagatgctctagaaccccttcccgagccatgtctaactcacataaccctgatcaccttcacggcttaactatgccaccgcgcgcctagccgctagctcaaccacataccaaattgacccctccgacgccggtcaccgtcgccggagtaccctagcttccttccat

SEQ ID NO: 69347 - DNA, 559 bp, Oryza sativa
cgaattcgagctcggtacccttcgtttaggttaaaagatcagtttgaaatatctgattaattacctcgacgaggagcaggatggcgacgagcgagatgcacaagagcgacttggccatactggccatgatgatcaaacgactgaacctgaacgagccgaattcaactgaatttgcaaggtgaaattaaagtactggttctgtttgcgaggtggaggtgatgaacaaaagacgccggccggtagcccaatttatagggcgagaggtcggatggggctgccagatctatcacacggtgtatcccaggaggcacgcatacgcagcagcagcacgcagcacagcaagctctgcgtgcgccccccatccttggtggttccgtgttgggctctccacgtcgccacaccttgcatgcatcaatcgcttctgtgatcagatcagcgtgcaaacaattttaattatgtcttcgatgagaaatcagcggctggatatattagtgattagttctctgacgagcactaagcttgcatgcgtgctgaaatctacacgctccccgctgctgaa

SEQ ID NO: 69348 - DNA, 8649 bp, Oryza sativa
aatcgacgtttgcactatctttgtcttcaacatggttccttttggggaaaggggatccccaagccaacatttttacttttaaacgggctctgcactggtaaataaaccccaatttggtgaccaaatgccaagggattaccctgcatcatagtatattttcttcgtcgttagcttgcccaattttccacttcgtcgaatgtccggctcatctcgcagggagaagttcgatctgtagcaaaacttgcagacactgcatttccgctctagctgttttcagatagtcttggaacaaaatcttctgttattcctcgttgaaaggcatctttgaccgaaacttgacgactagttgcatgggtgtaaaggggcccgaattaaatcgctaaagtctcgttggttatccatcgatcatgcaagaaggaagttcgcaacccatctccaacgtcgacttcagttagggcttgtagatcaggcagcagtttctacattgaggtccagtgaggcccaagtcgaaaagatgttagaagcggagtatctcaggccctatttgggggagcttgtcccagctgcagcttttcccaaaagctgccccaaacagtccacagcttctgagaatctgtagttacatattctgaaaaatgaactaagaagccagaagctggagagctgggtttcagagcttttccagattcttagaagttggctaccaaacagctgcttctcagaatctaaagctccccaaacaggccctgagtgttctttccagatccattttgtccatgagatctttgagttgtacatagggatgaaaacggagcggatagtttccgtccgctccggataaaaatgaatatggatacctttcggatcggatacggatacctttcggatcgtatgtataaattatactacattttatataaaatgagctaattatatatgttgatatttgtttctattagaagttgaattggttttcgtgttccgagaaaaatttgtttccgtattcgtgtccgatcatattcggttcttattcgtattcgagatagtccgtattcgtttccgtatccggcaaaaaaatatgaaaacgaatatagtatgagcattatccgtccgtatccgctccgttttcatccctagttgtacatactgaataggcgtttaagaaggagcgcttcattctgaatttttaggtttttgatttcgagccctccctgtgcctttggcttgcatactgaatcctaggcaaccaggcattgtgctcccgagcagacatcgtctccagtctagagaaaagcccatcttcgtttgtcaatttcctctatggtttctgggggtaatctgaatgcagacatcgcgtagactgggagactgctaagaatcgcgtttatcagtactagatgttctgcctgcgacaaaagagaggcttcccatccagataagaaaccatctaacttggaaaccagaggttgcaggtcagctgaagatagcttatggacataaagaggaagcccgagataggctatcgacagtttttccagtttgcactgtagcagtcctgacaagatcaactccttgttctgatcgacattcagggtaatcactgtgcttttaacccagtggcattagagaactttagaagggtatccttaaggccttgtttagtttgcgaaaagaaaatttctgggtgtcacatcggatgtttgaccggatgtcggaagaggttttcgggcacgaataaaaaaactaatttcataactcgcctggaaaccgtgggacgaatcttttgagcctaattaatccgtcattagcacacgtgggttactgtagcacttatgactaatcatggaataattagactcaaaagattcgtctcacgatttccatcatagccgtgcaattagttattttatctatatttaatgctccatgcatgttttcaaagattcgatgtgatgtttttagaaaatttttgggaactaaacaaggcctaagtgctgtcagcaaaacggaaagagcaaactctgaaatcgctcacactcgctcactctgaaaattgccggacaacgatagtaacctcaagaagttcggggaaacgtcaagaactgaagaacaaagtagaatttttgtgcagcgcaacctctgctgcttttctgttttcactctatattctcctccaccaaaacggagtttgttacatgcacaactgaacggaacgagcaacccggatcggctactgaccgcgccatcccacgatctgaaaccaggtcattcggcagctaaacaaaactgacaacatgcagaaggaaatagctattctaccgaccggccaaaacaaccttcagccagccactacgttcatgcaaaacagaaatataaaatgctcaagattacaaaatatccaacaatttctccccctaatcttgacgcatcacactggagacaaacccagctttcccctcagctccagaaatcggaccttgccaagaggctttgtcagtatgtctgcaagttgttctgctgaacttgtgtactccacttcgacctcctttctttcaaccctctcacggatgaaatgatatcttgtatcaatgtgtttgcttctatcatgaagtacaggattcttgcagagattgattgcagatttgttgtcaacttttaacatggcacaacagggcttcttcatttgcagttctcccagcaaacgtgctaaccaaatcccctgacaggcagcagttgtagcagcaatatactcagcttcacaagatgataatgcaactattttttgcttctgagactgccatgtgattaagttttctcccagcttaaacaacacccctgttgtactctttctatcatccacatccccagccatatcactatcactatagccaactagccgaggaaatttctcttctccctttctgaacttgagaccaatattcagacttcctgccacatagcgcaaaatatgtttcatggcagcccaatgttcagcacctggattctccatgtatctactaacatatccaacagagtaggatagatcaggccttgtattaaccaaatacctcaggcttcctataatgcttctaaactgtgttgcatcaatgcaatcttctactccttttttcagcttcagtctagcatccataggaacctgacaaggattgcaaccttgcatcccagccttctctaaaattcttcctgcatacccagcttgggacattgtaatgccttcttcagtctgtttaacctccattcccaggtaataggacagtaatccaagatcactcatactaaacatacttctcatctgctccttgaattttgctatttctgtccccaaagctcctgtaatgataagatcatcaacatatacccccaccatgagtctggcattaccttcccctctagtgtacactgcattctctgttgcacttcttacaaaatccagatttgcaagtgtagaatccagctttgcataccaagctcttggcgcctgctttaaaccatatagggccttttttaacttcagtactttgttctccttgtgctcaacaacaaaaccaggtggttggactacatacacctcttcctccaattcaccattgaggaaagctgacttcacatccatgtgatgtatttgccaaccctcatgtgctgccaaagcaaccagcaacctcacagtttccatccttgctactggagcaaatacttcttcataatctatgccttgttgctgaacatacccctttgccaccaatcttgctttgtacttcaatatctcaccttcggcacttctcttgatcttgtaaacccatttgagaccaattgccctatggtcagatggtaagtcacagaggaaccaagtattgttaccttcaatggagctcatctcctcttccatcgccttcatccagcactgctccttctcagcttccttgaaactgaaaggctcctgctccgctatgagacactcgtcgtcgtagtcgaaatcgagcaccggagttgtggtggccagcacattgttcaccgtccgaaaacggggaggagctccatcgctttcaatactggcatcagatggtggtgtacagaactcaacaccggcaggtgagcttgatgtcactggagaccacacgggcgccgcgtcgggcgtggccagcggacttggtgcggtttcagtttcccgtgcgcctccatgttccacaaccacgtcaggaacacgatttccacctagcggagtggaaaaaaactccacagtgaaatcctcctcgcctccagtttgagtgacctccggatcacgccatggccacattgccgcctcatcaaagacgacgtcgcgtgacacataaactcgccgtgacaccggatcatacatccgataggcttttgagccctgctcataaccaatgaacaccattcgtgtgccacgatcatcaagtttcctcaaatttggcttcactgtcttgacgtagccgacacagccaaacaccttcaggtgttcgaccgagggacgtcgcccgtgccacgcttcatatggcgtcacaccatccaggctctttgtgggcgaccgattcaatagatacacagccgccacgactgcctctccccagaaatgtgccggcatccccgccgccttgagcatagagcgagcagcagcgacgatagtcaggtttcgcctcttgacgaccccattttgttgcggcgagtatggagccgtgagctggcgactcacaccccgatcggcacagaactcagtgaactcgacagaggtaaattctcctccccggtcggtgcgcagcgcccgcagttttcggccgctttccatctcgacgccggccttgaactgcttgatcgcagccgctgcctcgtgcttgccggagaggagccgtatccacatgaaacggctcatgtcatcaacaaggagcaggaaatatttcctgccgcctggcgttgccggcgcaatcggcccgcacaggtcgccatgaaccaactcgagcgcatcctgcgccctgaacctggctttgtctgggaacggcactcgtcgctgcttgccggcgaggcacccatcacacagttgatcgacgtggtcaatcacggggagtccacggaccatctccgcttgcgccaatctccggagggcctggaaattgaggtggccgaaacgggcgtgccaacgccacgccgtctcggtgccattcgccgccaaacagatgggcctcgccatgttcaacttcagaatgtacaggaagcttggggagcgctttaccttggcaagcagtagaccatcaggatcacgcagcgtgcagacaccatggtatatgtgagcatcgtagtcacgcgcgtcaagccggcctcctcctcttctgcaacctcatgatccagaatcacctttttctcagtgagatgcacctcatgcacaccaggtgttcgcccgagtgtctcctcaccggcgagagacacccccatgacgtgagccatgagcaaggtcggctcctcctccccctgcgtcaggtttacttcccctcgacgttggcgccgcggcttgcggcactgccttgcaaaatgcccaaactcatcacaattgaaacattttaccttggagtagtcacggctggtgttcccactgttgatcgtctccttccccttcggtgacccaccggccttgccccgacggttgttctgggtgccagagctgcccctgctcttgctgctgccgccggagccttcctgctcctgtttccttgcgcgtgcctgccactgttcctccgtgaggtagagcttgtcgccgccaccttcctcctcatcatcactgtatgagttgaccatcgacagccgcccaacgagctcctcaagggccatcgttttcacgtcgagaagctgctcgagggaaatcgccaccggcttgtacttcttgggcacaacgcgcagcagtttcttgttgatgtgttcgtcttccatgactccacccatgtcgcgaatgtccgcgacgacggcagtgagtcgcatcgcgaactcctccggtgtctctccatccttgaagcgcatcgcctcgaattggcgacggaagccctactccttcgcctcacgcacacggtcgacgccgacccgcattgtcttgatggcgtcccacgccgccttcgccgtgtcatgcttcgccagcccgcgcaacatctcgcgcggcaccgcctgaaggattgccgagagagccgcccgatcgtcgcggtactccgcgtatccgggttcaatcgccgtccacaacccctgcgcctgtaggtttacacgcatcaacaatgcccaatccggataattggtcctcgacagcaccgggaggcgagcagtgtgcccagcatctctcccctgtggcacgagaggaaggttcgcgccgtctgcgccatcccccgcgccgctgccacttgcgcctccgcgcccgctgccgcttccgccgccgccaccgccaccacggcgtccgggcggtgtgtatcgcccgccatcatcagacatcgtctcaggaccgtcgtggtaccgctctgataccaattgtcagcaaaacggaaagagcaaactctgaaatcgctcacactcgctcactctgaaaattgccggacaacgatagtaacctcaagaagttcgggaaacgtcaagaactgaagaacaaagtagaatttttgtgcagcgcaacctctgctgcttttctgttttcactctatattctcctccaccaaaacggagtttgttacatgcacaactgaacggaacgagcaacccggatcggctactgaccgcgccatcccacgatctgaaaccaggtcattcggcagctaaacaaaactgacaacatgcagaaggaaacagctattctaccgaccggccaaaacaaccttcagccagccactacgttcatgcaaaacagaaatataaaatgctcaagattacaaaatatccaacaagtgcttgtacatcctcctcttccactcggtacacagatgattaagtatcatccgtgtaccgtatagtggcgcaagggcgatcctggtagacggcgtgtctgattgcctggttatgctcgagcattctttgtagcacatcggcaaccaaaaaacaggtatggcgacaaaggatctccttaccggagcccctttttacatgagatccatctcccaggcactccattgatcaagacaagattttgaggagcagagtaaactctgaatccattgaatccagatttctgggaatcctgtgacagcaagtatttggaagagacttgaccaagtcaaatgcctttgcaaaatcaagctttataattacagttgggcacttccttttatagcaagcttgaatcaattcagtcgtatagattagattttccgagatgcatcttccatggaggaaaccagtttggtccaagtgaatcatcttcattagagctttttggagcctagtcgcaagaactttggagataaactttagtgagaaattttgcagggagataggtctgtagcaatcgacagtgttttcttttcccggctttcgtgttagaacaatgaaggctctataatcctctcaaggttagccccaaagttgtaaagatcctagccaacctcattacatcctctttgatccagctccaagcagcacggtagaaactaggtccaaatccatctggtcctggcgcactagttgaattcatacctttaattgaggttaggatctcttcttgagtgatctgcagtccttgtccagctagaaggttcgaatcactttcttcgtctgtatatagttgttgtagatcaaattcccaagaaggctggcccagaagttgattgtaataggagtacataagttggaattttccattatggtcagctacctctaccccattatgcttgatcgatcttattcttgattttctaaaatttttagaggcatatgctttgaagaaagcaatattgtcttgtcccagcttcaggtgtttcactcactacgcctcagtggcggatccagaaagaaatagcagtggggtctaagtaaactagatagagttatagtccctctcctatctacatatggtaaaaatttttagtgtgatctttgtgggggctctcatagtcttcacgccagtagtgggggctcgagaccccaccgcccccatgctggatccgcccctgactacgccagatcctcacacctctgacgggatatctatgacgagcaaacgatttggtcactgatgaccgtcactttttttttgaccggaattactgccaggactttgcccagcagtgtaattttataaaactcgaaaaatatttacaaagttacagaagaagaaactgaataaaactataaagcttgtaaccaattaaaaacaatttgctttaagggatccttcattctgcacatatgcaaaagaacttctttcacaaaaagagatctctaggcttggaaggagggctgaatgctcttaaagattaaaccattcctcttcttctaaatgtgccaggctgccaaaaagaaaacctccaggaagcccctttgagcaaacttgagtcttgctagagcaatcatctgaaagaactccaaattatgattccactcaattcctaagtgttgaccgtcacctttgacgggtcatacgggatgtcg

SEQ ID NO: 69349 - DNA, 1494 bp, Oryza sativa
aactcctcccgccaccggaagcactcccccatgattgcgcgcagcgccaggtccgtcatcggcccggtgatctgcctgctgatgttcaccgccgccgcctccgccgtggacgacgccgcggcggcggcgatggcgtcgacgaggcgggcgacctgctcctcccggatggggcggaacgagcgcacccgcttcacgctgagcagctcgagggtgcagatgccgcggagctggcgccacttcttgccgtagggggagaagaggatgccgaccttgtcgccgatggactccctcaccgtgacgctcatggcgcgggtggcgaacgccgcgtcgtgcgtcttgaggacctcgcgcgcggcctccggcgacgacgccaccacgacggggagctcgccgaggcggaggtacatgacgggggcgtcgtgccgccgcgccagctcggccagcgcgcggtgcaccaccaccccgcgcggcctcatcaccgcgaggtggtgcaggctgccgacgaacggcagccgccatggccccggaggcagcctcgtggcgccaccattctcgtcgccacgacgacgacgacgacgacgacatagctcgccgcagatcatggcggcgacaatgatcaataccagcaagttcaacaagctccatgggctcccctgaagcggattactcttcatcaaatccatggcgtttaacaaagcttacagtcacttaatttaccctaatttgaccgcctgcaaaaacgattttttgcagtattgagttgattaacacaatctaagcttgattacgtaggattactatgtgtatcaaactcgtgatgagttagcgttgtgtgtttttgatgcatacgaataacccttccggctgagggtatttataggaggcaagtaagatagctaatggtgaattggtgatgatatcacctgcacaaggcaatatgtagtgttaattgcaggcttcgccgccgcaatcgtcattgagtgtgatagaaataattggcatgaattttcaacatgagaacatggaagaagcatggcatctgtgcctaggtttcatgctgacatctcgctgacgttggcatgatatctaccagaagaaggggccaccgccgctgcaatgagaaggggacctccaccactgcctccttgcggccgccgccgctgtctccttgcagccgccaccgctaccgggagaaggtaccgctgcaaggagaagggggtagccgccgctggagaaggggccactgccgctgcctccttgcgatcgctgccgctgtcagcgcatcgctgccaggagaaggaggaggaggcgggagagggcgagaggggagggggatgcgagtggatggagtgaggagtgagaggagcgagtggatgaggtagagcgaccgatcaagagatgcgagtggataaggacgtcgaccggtcggttttttctaagtagaaccggcacctatatttatattataggtgtcggttcttttaaaaaaaccgg

SEQ ID NO: 69350 - DNA, 607 bp, Oryza sativa
cgaataatgtggtacaaaattaatcgtgacctcgatcgtgtgtgtagtactgtagccgaccgtcgagcgatcgacgatgaagatgatgacgaggatatcgtatatatggatctcctgcagcccaatctcaataatatgcagaagatgagagtacgatggatgcaatgtcaatctcatctcatcaatggtgtcgctattacagcacgtggttttaataataatccacggtacgtacggtgtctagctgctacttgcactgtgcccctcctctacttaaacgcgccatcgtctggatagctagctacgtactgagctcgagcttaattagctctagctagctgcagcaatggccatgggggctcgcctctgcagcagcagcattattgttgtggtggtcgtcctgattgtggcgacggcggcggaggcgatgcggtgtccggggacgacgagcgtgtaccggcggccgaagaaaaggcggcggacatggtggacatgccactggacgccgacgtgttcgcggagccggcggggaggaacgcgccgcagcaggtgcacataacgctgggcgaccacacggggacggccatgacggtgtcgtgggtgacca

SEQ ID NO: 69351 - DNA, 536 bp, Oryza sativa
gagtggcagctcgatggtataacctcctcctcactgcctcaccttccgtactcccgttagcactgcttgttgtgtggtccttcattctgctgagctatatatatgttaatttaaagaattatgaaaatgaaggaggcgcgtcactaatatttatttcctgcaggcgccactgtgccaagaaaggaagttgttgatctcatcaagaaattcaatattcaagttaataacttaacacaggtgtaccttcagtttatgttaccgttccctttgtttacattcgttatcattttgctttgcatcttaatcaagaggagccacttatccatttgtcgtgaacctattcctgatttctgttttcctgctcaactgtgttcagcttgaccgatccttcagcgtgcccttaattcagtgacttaataggcttggcactaaaaacttatgctcgtgtgtatatatatgtatcttctgtgttctaaacgccacgtcagtgataagtagtactgtcgtccttacgctctgaacattctatatttctt

SEQ ID NO: 69352 - DNA, 1294 bp, Oryza sativa
tttttgagtatgaaatcagtatgatgaagttccaaactaagcttcagcttctacccagaaggttccaattgcattcactcaggcaaaacaaaaggccaatgaacctgctaattaaaaagttaagccacagtcaagaatctcatcctgtgcaatgctttgaaaataatgtctacagagggccataatagtgaaggatcatgacagttgaagaacaaagggaaaccaaaatctatttaaaaaattcagtggacttttgacatgatcaacactagtagatcacatggtaaatggtctttacagtttaatttggattcaattcaatgtttgcatatctttaaagcaaatccttgtgtatgtacaacattccgttactcaaatatactgcattcgtctgtaagtgaatcatttcggacattagtgtctccacaattaactttaaccattagtggttacatgcatatgttaacaaaagattgaaagtttcaaatactatgattgatgatattcttttataatgtatacttctatatcggtatcattttcatgcatacaatattatggacatgctaatgctcaaagttgggctccattggtagatgccatctggactgaattgaatggtttcacttacttaacaggtagctaaacctaacagcttcgcaattttaaccctgactatgggtaccatatcaagttattactcttggcaactttaaccgcgactatgaacacattttcttgttattgaaagcacaaagaactgagattagtgtgtcgttgcatataacgtgaaaccatgattaacgatgtgagtaccaatggtccaatgaagaaaattgtagctactctgggcagaaaatagaagataggaaaggtgagtggtaccaaataaagcaaggttctctcagtgtaaactggctttcttgaataacagacggaggaatgcaagtaccaacaatatcctgcaaaaaaaagcatattgtgaatatcagtaacaaaacattacgacttatatcaaatacttgtatataacactgtttcgtttatttgtaaagtaaataggaggagggaattggcaaaatctatgtaacatcgaatatatagtcaggttatttgtaccccatggtattgtgcagcataactggttaggtattagccacagggtaattagaagaacaccaaattcttttcagattccattagaactaatactagatagcccatctatcagttttgcagtctccatcgaaacaaacaaatgtcttcagtaggtgtgtgaagccactaaacactc

SEQ ID NO: 69353 - DNA, 1702 bp, Oryza sativa
aaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttaattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgccccgcgccgccgctcattctccagcaccaatcctcgcccctgtcggcatcgaaaacgagggaagtgcgcgtgctgatgtttaatcatgcgatgccaatgatgtaagcgcccgacactgccgcgccctgctgcccgtcctccattacctctctctctctctccttgccgttggttcctctgagctcaagctcgatggtgagaggctgtctccgtccgtcggcgacgagtcagtctatctggctttcaatcgggttaggtcttcgtcctctgcatcacctcgtcgtcgatttacctgtctccacaatccaagcccattctgccttcagatctggtgacggctgccttgcagtagccggatttggcgagctcggggggagggggaggagcccacgacgatggtggagctgaagcggatgacagccaccgtggtggtgtagactgattggcccaggaggcggacgcctcgagcttgcgagaagatggcgtcggcacggtgttctccaaggtgggggtccccctcgcgcctttctctcgcctgctttagacaatcacgagccgcctcgcatcgcctaccgccgccgctgcatcctccgtcctcccctcgctgcttcatctggtgccgcctcccataatccagaggagggctccatatggtggtgcagcgcttgatccggagcagctctgatgttggacacgatggcaagccaagggattttaccaccagcatctcctggccaccctcatcacccccctgctgcctcctctaccatct

SEQ ID NO: 69354 - DNA, 3509 bp, Oryza sativa
tatagggcgaattcgagctcggtaccctaatgcttaaaggtgtcgattctttattttattcatagtgcgaagctaggttggaaaaggcctataggtgtcggttttaaatgaaccggcacctataagaccggtccctatatgggttttttttagtagtggaaataaaccatctaaattcctaatcacagaaggacaaaagatctaaccaccaaaagaccaccccaccctgagcggctgcgcttgcttcgcttctttcccttccgatctctttttttcttgttggtttctataaaataaacaaacaatttaaatttctaattaaaaaaggacagtgatctataataaaaaaagacgaaaacatgtctcaccacatcgttcatattttctttcatcatgatctcattttttctttatctttatctttacatatttaaaatatttgtagtgtttagagatggcaacggggaattcaccgtcaggggtcacatccacgtccccgtccccatggtgataaaatttcaccatccccgccccgtcaaccataacggggctacatttctccagtcccgatcaccacgtggtgaatttatccccgtggttacagcggacgacgtggcagcggacggcgtgctggcgagtggcgatggagggcgttggtggctcccggcggcgcgacgacagccgcaggcgctgcgcggcgcgacaccggcgctctcggcggtgctctcggcagcgagtcgacggagggacgggacaacacccgtgcctgtgccacgcaagaggaggcggcggcgtgcgcgtttcgagcagtggtgctcctggtggctagggagtggcagtgcacggcggtgtgcctggtggctggcagagtggcgaactggcgatgcacgcaggtgcagcgccgcaaccgagagcaggaggactggaggagagactggatctgaggatttggattatggagtttgaccggttgacttagggttaggttttatatatatacctattaaatgggcttcagtattatgggccaaaatgtataaaaagtctagaattagtcctctatatagtaaagtcgggtcaccgcgggggcggggacagggaatcgtgcaccgtccctgcccccgtcatcctcgatggtaataagtttgtaaccatttcatcccccatagtggatacatattaaccatcaccgtcacctaatagatgaattcaccgtagggaaacggtgaacgggaccccactgccatctctagtagtgtttctattattcgtggttgtatggcgtacattaacgattttcgtgtttctgcactggcgccctagcaacacgtgcgagtctgattgctcccaaaccaaaattcaccgcttccacgtcgatgatgaagcatcccacgtgtcagaatccaataggatccacactcagcacatcccatttgccttcccacgccaggcgcacaaccataaatcatatcctattttggttctgctccatcggtaagtttacaatttaaatgacgtcaaaggatcgccaactcgtgaattaggaaataaccgagtcattaatataacaaagtgtataatagtaacaagcatcataatccatatgacatgtggacccatgataactagaaaatataaattaatatttaattaaagtaggttcactctttttaatatacacatggattcgatctacatgaagtcatgaacgaacaaacacccaatttaagaaataatacatctgataatttgaataatatattcttgaggaagcgcctggtgcctggaagcttgaagtggccgctgacggtgacccatacgccgacagaggccatgttggtggtgtcgggtaggcctacgctacatttaaggcagcgatgtagagtgtggagatactcgtaatgggaggcaaaggggtcggtgtcgctaggcattagtaaggcccaacagtggaagcagtttgatgaagatgaggaaacagtgtagttgaggatacgatgggagtagaacaggagcccacgctttgatcgcacaagcatgaccattatatgttgaatggatttctcaattattgtgttgtaccgccaccacaagggatcagcgtatggtgtccaagcttttcactccaagtaattcctataatgcaggaagggcaaaagcagagttttgtcaatccgtctactaaaaaaaaagtttctgaaaaaccggtgaacgtacacaaaaatagagaaaacaaccatagaaaaaaaagttgaaacacactaagaaaaactgaaaacatactactccctccgtcccataatataagagattttgactttttgcttgtattgtatgaccactcgtcttattaaaaaaatttgtgcaaatataaaaaatgaaaagttgtggttaaaatactttggataataaagtaagtcacaaataaaataaataataattctaaaattttttaaataagacgaatggtcaaacagtgcaagcaaaaaatcaaaatcccttatatcatgtgacggagggagtataatagagtggaacggaacatttaacccctcttactagatcccatgcaacacacgcgcatatttgctagtagatacaatatataaagtacttgaaaacaaatctatgccatatataccattttccctttttcaattaaacacttgacaaaccattggtggccactctgtacaatttaataaaaatattatcctaaatgttaaatatttacaaacgaagggagtatttactatatcatatttaatctgttgtaacggtggtgatagtgccatatcatctcatcagcacaaaaatcgctttgcagattttttttaatgataatatgtcatctgtgcatgtggcttctataagattgcatgttacaaattgtatatatgtagaataagaaatttgtagtagtagcagctggcatttatttttttcagataagatcagactaactactgtagctggatctctaatttaattaatgtaataaattagtattagattatctataccactagagcatggtaaaactgtatgttaacataatgtatatagcgatctgttcggtcctggctaagctgcatatgccactacttgttcaaatcagttgacccaaaaatgcacatattaattagtcaaagcccgcaaaagctgcaaacaaacgtgatgtgagctcgatcggaagaaatctagtagaagtccaaggttccaaacttacggcatgcataaaagagcgacatatatacacaataatgttaaacaaattccgtcaaagctcactactttgtcaaaagatcacaaatttatcgacgggctagccggctactcgatcgactgttaaactatatataaggcactcctggccggccgtcgttgcttatagacttagcactctcattttctaggtttagatttattggtttaagcttttaagtcggtcttttgactttcatgatttatgaattggcggatctaatatcataagtttaatggtgaaa

SEQ ID NO: 69355 - DNA, 3228 bp, Oryza sativa
agtcgtgtcgtaacgggtagacttgatcatcacaatcaccaagtcacaaccaagtcctatgaacacatcaccaaagcttaacatcttgtggtgaagtgaagtggccaacacttaatctaggatttgtcatgaatgggcaccagtaaaaggggacctaattgggcaaggttcatcaggtaaaggtgaaagcaatcagaagccccacccaacactttggcccagctgccatccaaaaagtccaaatcatgcacatctgaacaaacagaaggaaacaggacagtactgaaaagtggagccactcaaagctgcacaatgaatctcctaagcatgtggatctaaccagcccaataatattactgcaatccagtatttttttttcttatcagtaacttctacttctatcacaggaatgaatgatttcaggaaatagaagctttactcacagagaggacatctccaatgttactggagacattttcagcaacctttgagattggcctgcagtcaaatagaagtacaattctcagaaaaaaaaaaagggacagacagtgaacagaatattaagcatgcaaagcacatagacatctgaaataaaaactgcaacttgtcattttccaggttgtatggaattggagtgaatttgttggtgagatttaatttgtcgatacacaagcagctagatttatcgaaactctcatgctatcactcagcataatttgattaacaagaaacaagtaggatgtagaatcctattcagtgccttaaaacgttaaaatattcatctcacagctactgaaaaactaaactatttcgtgctactaattccaggacacattagccaagattttaaccaaacaaattccactgaggctttcacaaactcaccaggagaggtgtccgatgagatcagcaacctgggggaagtactggccaagatgcaggacggtgaggccgaagaacagcacgaacccaagaagatgcctgaacaaacaccaagaacgcccacacgatgagcagcaagaacacagcacacaaagctgaaccagaatcaaattcagaaaaattcaggttgaaatccatacgtccagatgttgatggtctcgttgtgccaggagaagaggctgaggagggcattgaggatgggccactcggagcggtagtagtcgaggatgaactcgttctccttcatgtagtccggcagctcgtggtagctcaccagcctgcactccttcctcttctcctccctcttctgctgcttcctcttcttcttgctccctcctcccttcgccggcgccggcgccgccgccggagcaagctcatcatggtaggcgctctccatggtggccatggctgcctcctctcccataacttcttggcctcttcaagggaaaggtttgtgcagtgcttggctggctagctgtggcacggggttaaaaagggaaagagcctaggacacaggagatggagcagctttcgcaaacaagccaagaaaatggtagctagagtgcagtgctatccaagtcagtttctttaattttcttctcaatgcagcatgcaatatcagcaaataatgccaataaatttgatgctacagcaatgaaatactgaaatggattttttttttgtagaaatggatattgatgagatgatgagatttgtaggtgcaaatggcgtgagattgcgtgtattttgggtgagattatacgctgcgagaacaatggagagggggggttttatttggtatgaggtggaagaggacaaatacaggtagagtaggaggacaaccacatcaatactgttgctaacagggcttggaaaaagatactactactacagtgatgtatttttcttctataaaagtccatgtcaaataccagtgaaatattgattaaatgcctttggacacctaactcaagaatttcgatgtgtctgcattattgctcagcatcaatattgttgaaatcattttttatatagcctgagggtattggtttatagttaacactcttaatagtggtatgtcatcttttacacagtttgacagcagtggtggatgccataatggcgtagccaacaataggttcaatgtaaaatatgtagtatatacgatgataacagagaagaggagaaaagagatggtgcggcagtgcataaaaagggagcataactaggtgtcaaaaaaagtctagcaagttcattatcactttcaccacacaacatatttacgcttacatgcatgtatgactatgtgcatctacgatgtagagagaataaagatataaaaccttttcattacaaaaatatgccccccccctaacattatatttgacgctacacacaaacttatgtcgatattatatgacgtcaaatattaatgataggaggcggtatattttctttcaccaaatagtatagcaagctcattatcactttaaccacaccacgtatttgcacttacatgaatatataattgtgtacattcacggtgtaaagagaccaaggatataacactctcattataaaagtatatttacgctcccttccgttgttatatccttcctccatctcatataaaaccaatggacatactaaaatgtgtcaatattagtactataggttggtttctttgggacggagggagtagtagagggttttttttttcttcaaattgacagcataaagaaagtgctttgaaatagaattaggtagctgttgtttgctccgggtccatttctgaagttttgacccgtctatgttgtaggtgtcagctggccatccatccctccgtcttcccacctgtcacaataaattcttcagcaatgggcactctcgcagtccagcaagaagctgcaggttaattttctctctgtggcgtgcaggcaaccgttgaaaattgaggctctgattgcttcattagagataatgaaagctttctgaattcaacttcagggaggttcagattcagattagttgggaagctcacaaccaacctgagctaacccaatcttgtactgtactcgtactggtatagaatggctgagtttcagactttcagtctgcagtccgagagagatgacttgtctgattggccgattcgtcgtagtacttcaccgttttttgcgccttatgaggaaacgtgcaggtttgcatggaatgattggtgagttagccatgaatgtggcactgaacaggaggggttaccaaagttgacgcaagagaattgctttg

SEQ ID NO: 69356 - DNA, 593 bp, Oryza sativa
atgggaaaggtgaaaggttggaaaaaaaatttgggacttaacttgggctttttaacttttccgtcacattgaactttcgtacacacataaacttctaactcttccgtcacatcgtttcaatttctttgaactttcaattttagtgtggaactaaacacagcctagtagtatgtactgaaccagttcgtcactaagaagtgcataccattatctgtcggcagccatggccacatccaacaattacacttgtgtgggcttgcgaaaaacccacacaactccccgccggcccaccaccaactccaccaccccacacggcggtggaaaagcctagacccggaccggaccggaccgacgccctcgcttggctgccaccgccgcgcgttgacggttagacgccaccgcgggaggagagcccctccctccccgtccgcgtccgcgtccgcctcatctccgccgccctcttactccccctccccttcctccactccgtccacctcggaatcgtcggcgcgacgcctccaaacccccgcatcgattcctccctcccacctcaccccacccttccgcccgctcgatccaccgccgaagcgggc

SEQ ID NO: 69357 - DNA, 691 bp, Oryza sativa
aagggtttgtctaagtcaatctctgatgtcgaccgagaaagtacagagcatacgactaagtttcccgtcttgctgtaatcgagaatttggattgaagtcaagaaattttatctcggcgggtacaccatctcttcattccgtattccttgtcgagatccagcaaccgttctcgagcgatcgagaaggcgtagagtctgcgacggaactttgtcaatatttgtcatactcgccttagtcgatcttggtgtagaaccatagagacatgcgatcttcgataatgtcaaatagaattttcctgaaatcaatactcagaaaagaatattagacagaaatagcccccgagcgaacgctctaagggtgacatgttataatatgtatggtaaattgaaaatgaattaaatttaccgaccaatattttgagtatgagcgtcttctctcttaccgacttcgatcagtcagtttgtagagtcatacactctccctagccccagccttgtcgtcggagaatcgttcttggaggataaggctcttggacccttgacctgctgtcacgcccagaaattcccgaatagaattccaagcagaatgtgcattaaaatccccgtccaggaccagccggggtacacaaacgacaatgttgccattcagatccacgttttacaaacatcataaaagtcttacaaaaatgcag

SEQ ID NO: 69358 - DNA, 518 bp, Oryza sativa
ccctctcctcccgcagttgatacagcttgtgcctgaacaccaggcgctggtacctgcaccaccgaccgaccgaaaccctaattctcccaaaccggatgctaaaccaaaaaagcacaaagaggaggggacaaatctggcgcggcgactcacagcgtctgcgcgtcggtggcgaggccggagaggccgatgtagagcttgtcgtggatcttgaacaccctctggaagtccgtcgcgacggtctgcagctgcaccccgagccgccggtcgctggcgatcgcgaagcagttcttccccaccatcgccaccacggcggaaccattgtactcgaagatctgcgaggcatgggagaattaagatccgtggggcgggcggcccggccggccagggagcggggcggcggggggcactcaccgacatggccggcgcggcggcgagttctcggcggaggcggaggcggaggcggaggcggatgcggatgcaggcggtcaggttcgaagtcgaggaggagaatcggagga

SEQ ID NO: 69359 - DNA, 1353 bp, Oryza sativa
tactcggtcgcttgaagatgtcaacgatacgcagtctatctaatgaaatacatttaaaccaagtgattggcatagatcggccgatgtgccgagataatataaatcacttaatatctaaatgtgcctcaaagtaaagattgtgtatgctcgcagcatagccgatacagcaaacctagcatgtatcggctagtactccagtacgactctatactaagataacagggtaaatgaaatatataaaacgcagatcaatctagcaagtaagatggactggcagactgataaagagcaagatatgcttcaaataaacgagatcttaatataaagggcagatttagaagatcgagaaccataaaaggcacaagacaactaaaccagataagatcagctgaaaccccgatgctatctctattagaaatcataggaaaagctagataaaacgattcaagacatcacttaacagatcgaacctaaccgatgcagcattatgcgtgaaaagaaacataaaatctaaacaaatcgatgaagactcattcaagatggtagatacgctgtataatctagctcaataccgatatctaaatctatcggttcttttcgatgatagaggctggccgatgaagttagatgacgggatcgatctaggctatacagcatatatgataacttggcgatttacatagacaggattagagtgttatagagatgtaagcactaatcccgataatgcaaaccgccataacaagctttacctcttcgtcggagatcgaacttgatgcagcccaactcgaaagcaaagaactcgtcgaaacaatagaaaaaaggtggcgatgcgccgaagtattattgaactgtcgtcccatgattacaaggtgtcgggtcatatttatacccgaggtacataacatgtccttgctggacacgactcttatctctattacaatttaaaatatgaacaagtcccttaggcggactcttaccaaaaatatctctaaagaaaagcgtcatcggcttgtcttcatcggatttagcgtcagccgatacatacgacaggcgatgccgcctgtagccgattcatacggcagccgatgatgctcatagccgatacgcactctcccttccttaaacagaattcctccaaatctggctttgactctagctttgaacccagcccatggccttaccaaatttggtcgttaacaattatctatgtttttacatgtgtaaacaataattattatctttattaatattattatatttatataaggtacctgactagttttttaataagtggaaagatatttttattaaacataatctagaatgctataaagatttataatattgaac

SEQ ID NO: 69360 - DNA, 1922 bp, Oryza sativa
cctttaacggacgaggagacatagggcttgttcatattgatgtcattttcaaccataccattttttttataaagttgccaaaataatatacgtttagtttgttgccaaaaatttggtaaatatggaagaaatcctagcaaaattttggtattggctacaatctgaacatgcccatattcttaagaaatcaaaacatttcttttcctatatggatgtaacaccatacactatcactcaactcaatatattctttttcaataatcaactttcagtcctcaaagaaataacaatcaaaattctcaacgtgagatgcgtgtggagagatctgtccaagtctaccatccagtctctcgcccgccaccgcgcgacaccatcttaccatcatatccaaacaacgtgctacccttgtcgatcgatcagtgatcgatgttgagaccgacagatattatcgcaggtacatgcacgacatcgagcacgtacgcacccgcgctcgcaccgcatcggacgtacgtcggcgcacgcgtccgtgatggcgtgtgggggcatgtacgtacgttcagggtaagttttatagtggaggtggatgtcagatctaatttggaccatgtcatcgtcttcttattaattaaaaggcaacgcatacaacatatcacatctaatacacaaaccaaaatattagtttactctcacatcatttttcacttttcttggagattgtgtagagcttgccccttgtataagagcaagtttaatagtatagcatactactagcttcaattcatccgtagccaatctaatagctaattcatacaatagttgcttattatacttttaatatatggtcccacatgtcatatacatattgtgtcttggagtccgtgctgcagctggctacagatctgtagcccgttgttcttctctatcatcttttatcttattaaaatatgtttatagctagctaatagtatactattgtacctgctatgagggatggcttattctctctcttcttcacctcattatctaccggcagcagagccgcgccgcggcggcctatcctcctgccaatttttgcttctccaaaaaaaaaaaaaaaaagcctctctgcaaaccgcgcggtattgtcgccttgttcaggctaccccatgctagcttagctctactaactgcacatatcgccaatctatgggcgcagttttccgtgaaggcgccgtgggcgtgctctcgcgctgattgggtacatgtggttctctcaaggtaactcttttttttagagggaactcttgttcagttttaacttcagtttacaacattttttaaacagtatttcaccactttgtttggagaccacatagttcatcacgtggattatttacctgtggtacagtctggctgcccgctgtgtgtacatgcatgtgaaatttaacatcccccaatttatttcttgaggttaattactccttttattctttttgcgagcattttttttaaataaaaacgaagccagacttgctgctgttatattaaataggaattgagtatatttacatattcactaacggcgcaaagaagaaaggaataaaaacaacaaaaatacatttatatctttgcataggcactagatatgaactaaggtataatattcttgcgatatctttggcgccatacatatatatatatacctcacacctagattaattttatctatgattttaaccattagctgttgcattggagtttctttatttctgaaagcacttttgtttctttcacaccaaatcttccacacaatgcaatcagcataggtagtgacttcattgtcttagtcttgtgtttgcgaggaattaatcttatgaatcactctagctactcctagcttgctagtcttgcatttaatttaccatctctaattgagggattgg

SEQ ID NO: 69361 - DNA, 3917 bp, Oryza sativa
tattttgtcttcactaattaatctatgtttggtgaggcacaagaacacatgtttgattaattacagtgtaataagtcatatggacacaggagccgagaggcccgagagtagactatgtcaaaacgattgagcagaattacaaccacaactttaattctacatgggaacaaagatggtgcacgtatgatttggttaacatatatggtcgattttgctgcaaagcttgaggataaaatactagctaacaagtcttttctttaaaagaaaactgaaaggggatgtgctctatgtaaagactaagatatcaacactgtaagcagtaaaggttgcacaatcctcgcaatgtctaacaaaatttctgtttgtgtagaatccacagtgtatagacaaagctagcgcgagacaactgatctatttctgaattcattctcagtatctgttagtttaattacaaaccagtttacatactattgcgtttaacaatttttttcttcgatggagaatgggaaaaaaaatgtgccaaatatggtctttatcaatgcggaccatgcatgattcatccgaattttcccagcgtagaggacttatctggctagggagggtacttctgttcactatataaactgggctggaatgttgctacaccatctttcataccaaacctagccattgggcccgagagcacttttcaaatagaaaacacaaaaagccactgtgcacgcggggatctcccgttccacctcatttagtcccacctcggaaaactagctccacacatcgcagcataaatagccggattgcgccccttgctgtcgcgagctcagcagcgcgagcttgtaacccgagcgggggcattaaggtggtgtggacgttgcggtacggctgcgggcctgggtcggcattgctacagatggctcgcccgttccaagttgagtagtgggccggcggggcttgtgcgaaagctctggggccccacggttcctagagtggcaggcatggcgtgaggctggtttcacagagcagcgaatactgcccgcttccaacggtggaaggataacgggccgccgcactgctggcccgcttgggtctcgcatcctactccaacggaccaccacttttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgcatgcctgatgcctggttagcatgcatcatcaaagccccatgcagtccagatttaaaacgaggtgatcaccaactgcgttggagacttggagtctttaaagtgaagagaaaaagcacaaaggccatcacaggacactggttagcagataccagcagccatcaggcaaggcaaagttcctcacaaataatggggcggctaccgaatttgttcatggcattaaagcaaggaaaacatcccgtgaaaagatggacaacttcaacatttctgttcaaacgggcaggcttaggatacagcgacacagagacgttctcaagctcacatattatggatttgtatcacacagcaaggttttaatgaagtccacagatcccatatgggatatcaacacacgcattttagcataacagtatttacgaatctaacaaatatgagtagcctttgacgtgacaatggctcatagcagcttgagaatcatatctgcaaaatgagatacggtggaagttagttaacggggaaaaaggtttaatgaatcaatgcatataggcataggccatttcccatatatggaaagtgcagtgaatatgtaatatgcatgcattaaagaatgcatttagtgaactcaaatttgtggcgtgcatttacgctttaagttagcaagcatgtgaaaatgcgatacagtaaagtttgaagacatttgtatacccttctatgattttgcatgaaaatacaaattggccttgaaagactgcatcgcatagagaaaaggtatgcgtgcaagtcactctatacacactgtctcgataaatgcaacaaagttcactatgtcctgataaatgcaacaaagttttagtaacgttcgtccaagtgttagggcttgtagccattgttaacctccttgtcaaaattttggtaagatggtttgatgccaaattttttttggcaaagatactttaaccttttgtctagccttcccaaagtattggcattgtgaatttttgcaacagaccaaatgagcctataaaagctttgccattaccaatattttggtgtggttgggttgagccttatatggtgtttggaagtaaaatcaccagaaaatgcagtcactccaagatgtagcactaagggggtggtgtttcacataaagggaaggtcgacacaactacaaagggcaccacagcaggatgttatgaaagccagccctttcaacacaaacaagggtaacaatagtaatcaaattacaaataaatggagatgagatttcatcactgaggaactcaacataaaaaatacatcatgaaaaatgttactttatatattcggtgaagagcttgtgctacttacattaacaaatgaacattctgtgagtaggattaaataaacaaactgatagtaggattaaataaacattttgtactaccaatattctgtgagtggcttcctggcatgtaaggtgcagaaaactgcttgcgtactgatttaactgttcaaataccattgagaaggcaacataaaaacacccaaaacctttttatctaaaagctaggccaaaagggtttaacatatttttacatccaaaacatgttgaaca

SEQ ID NO: 69362 - DNA, 2240 bp, Oryza sativa
ttttacatccaaaacatgctgaacattcaagagtaaaaagacaacttttatgtttcagcaggtaaaacaatacaatttacacaaaatgaataggtgttatcatgatatcatctgagcacaccaatgatcactggtctcacttcatacatgctgttaagggtgctcctaagttaaagcagaataatattatccttgttatttgctatcctcctcactttttaggtagtacaagaagagtaaatcattatcaaaatatcaattccgtagtaagtcataatataggactaccgcatgttagctgttaaaaatcctgaaagtcattttatgtcctatcacaattcacaacactacatacctcccaagtaatcagccaacagaagagatgatttgccgcatgtatgatgctatttgatattggaatacacagaaatttccattggtgaaattaaggctgtttggctgcctgggctgcatctgcgccacagacaacagcaacagtgctgcaagcagcaaggaaacagcgggcagcagcagccgcagccacagcccaggtagccgaatggcctgattgttaggtcagtgataacagcatgactcattgttttattggcatccatgttatgcaatgacgatgtcttcagcacagggagcatgacatgaatatgcaacacctcagtaaccctcgccatttgacaggtaagatgtgaggtatggttagtcttatgtttccacaaatcttaaaccatagcagcatagccattatttttcggtgcgcagctgcattcagaaaggccaaagtaggagtataactcaaggaaacagcgtggtcttgtagatactagatacacaccacataaccaccttcacattctccatcaaattgataaaaactaaaacaatatttcacaagtgcaacagaaggtaagtattcatgtatgatgctaggggtggctatgtttatcacctgaagtgaaatccctcagccgcgggccttaagctcagccaggcggcgggagaggtcgtcttcatcaacagccttctccttctccttggcagctggtatggcgtgagcggcggcctgcggcaacccaacggagacctcaaggccgtagtcgtcggcgacttgctgcatgaggctgttgacctcggtctcgggcgtggagagcgaggtggagccggccatggcgccctccatgaactcggcctggacctccatgttgacgaactggcgctcgaagttgtccatggtctcggacatcttctgcaggttccccgtggcgagcgcggagtcgagcgacttgacgatgttggccatggacttgccgatgacctgcatcttcgcctgggtgtcgaggcgcgcgacgacggcgtcgaggcgggaggcgaggcggaggtagttcatgtgctcggtgcgcttgcggatggcgttctcggcgtagatccgcgcgccgtccatgttccccttctcgatcgccttcttcaccttgagcttctgctccttctcctccttctcgcacttgcgcgcctgccgctgcagcgacttggaggtgaacttgaggtcgaagatctgggtcatcagcttctccgggttccccatcgccgccgccgacgagctagccccgatcgtggatttggctagggtttgacgaggaggaagaggaaaggcagatcggattgggggatttgggaacgcgtcgtatttgcgaggagacgagacgcgaattggggatttttattattggggagatgggattcggttccgtttgatttgattcgaggaggagacgaccagtcgaccacgcggtttggtttagtgtacgccttaacggcgaagtaatccccgccgtttgtgtgtcgctgcgtgtggggtcggcgtgtccaactccaaccagtgtcgttggcgtcaccgacgccgtttggataaagcgttttattgtatctctaattttggaataattaattactagaaaatagatgcggccttgccgcacaatgcaccagccaatatgaaatattccatccgttatatattgatcatcaattgactaaaatcaaaaatttcaagttgattattatgtaatgttggtgtagttactacatctaagcatgaaaattgggtttgcatgcatgcatataggtatttgaggtagtaaagctctcttttcttgttgggggggggggagttaaaagtgtgcatgtttccttattcttcaccacacttacttaagtttttttttgtg

SEQ ID NO: 69363 - DNA, 1416 bp, Oryza sativa
tgtgcaccacacagcccttggtgtatttctttcgccatttcttctccttcggcaaaggagatgcatcgaagcaagggttggagcaccccggagcgatacagctgccctgagaccagcttgtattttgtggctctgagctgtaaacgcttcgcttctgcttcatcttgtgggagctagcaattcttgaggtacttgatgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctaacaatcaaaaataaacagcagcggactagcgggcctacggctccatcttcacaggcgctcaactggggtataagccaggactcaacctaagacttcttctccaaagcttctcttactgaagggggaaaagattgagcaagaatgagtacaaccacagtactcagcaagccacaccggcagatgcatgattaatgcaagggggtacaaggggtaataatataggggttaagctttgcagaaaacagcatttaaaagtcacttagttgcccaaagccattttataagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaattaagccttacccactagacatgtggaagtacggtagtgctttgcaacagaggcccgagcttaatccttatagtacccgaggtacgactaaccaaacccaaccacgcacctcgagcccagcctaaaaccattatgggggttttgaatagagggggaggtgtgtgtccaattccaacataagccaaccatt

SEQ ID NO: 69364 - DNA, 1787 bp, Oryza sativa
cgaacgaacgcgaacgaacgcgaacgaacgtgactgaaacatgaatgaacgtgagtgttagtgaacgaacacgaacgaacgtgaatgaaacgtgaacgaacgtgattgaaacgttaacgaacgtgaatgcacttgaactaaaagtgtgagaacgaacgcgagcgaaatgtgtacgaacgagataattaaactattgttgaacttaccatatatatatgattatatatacttgaaaacatgaaatacattatatgttcctttgcatttagactaatacattttttttgcatgttgcagagaagacgtcgtcgttgtcgtccctcaagccgaagtggtagctagccctcgaaggaattcacgcaggcaagtgatgtaaagatgtgattgttagagatataatataagattgttagatttctaatataagattattagattattagagttagcatatgtgagtgttaaagattattagattattagacttagcatatttgagtgttagagatagttagagatttaatataagattcttagaggtttaatatacgaaacttaattagacttagcatatgtcagtgttagatatttaatataagattattagagatataatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatatttcaaacttaattagacttagcatatatgattatctaccgtacaaatacacgatacttagacttagcataaatgattatttgagttttaatacaagattagtagagtgttaatattacgcttagcaaatatttcttctatgaacagatggctgatcgcgatgaggaacagatactgtacgatacaatcgcatcgggaagcagccagtactggaacgaagaagaggggaacgaggatccaaaccagtacttgaacgaggagagggatgcagaggggaacaaggagggaaacgtggagagagatgcggaggggaatgaggaggaggatagtggaagtcatccctccgctggacagaagagggcacgcggacaacgaggtgccgcgaagaagatagagggtcggcacatcataactgaggtggacgcagacagccgacctagtgccccggcacaagcagccaagaattttgtacgccacagcggttgggttgtgagggataacgtgcctgtcagcaaggtgtactagcgcagaacaagggcacgcggggataatgacagctttgtcccgaaatcagagaaagagatgctgtgaaccacaatgctcgagacgttcacgctccttgcgggtacggagaacatagtgaaacagtggactcttaagaaaatggcagaacagttccagaccttcaagggagatctgtaccggaaatacatcctgaaggggcagacaccgaacttcgacgtattcccgaagctaagggatcactaggacgagttcgttgcttacaagacaggtcaacaagggcaggcgatgatggaaagaaacaaagaaaatgccgccaagaagaagtaccatcaccggggat

SEQ ID NO: 69365 - DNA, 645 bp, Oryza sativa
tatattttggaacgagtatagtataattttacacctcaaagcataatactcaacttatatgtgtattattatttattatggttttagcataattttgttgtttcgttgttatttggttgtcatgcaaatggcaaaagacagtgtttagaagagtgttttcttatatttggatttaataggttcattggtttaatattatggatctaccgatttaaattgacattaattaaggattactttttttttctttataatatttttttctaaatttaaattattagctagaaaataggaaggtgagagagaggattattggaggatggaggaagtgtacgtacatgcctatgtgcgtgcacggggtgttcggaggatcagtctgcttttcatctaatctaaataggaaagagaaaaagaaaaaaaaatagatgtgcaaccgggagtacgtacgtacgtttggttttttttaatacctatccacgtacttaatgggaaatttttacataaatctaatggttgaaaataatgggttcaccagattaaatgaaatcgatggttagatgctttacttttttttcttagaatttctataatttattagagtgcaacatggcggtgtaagagcgtttctagatatgccacgtggca

SEQ ID NO: 69366 - DNA, 602 bp, Oryza sativa
gggcgaattcgagctcggtacccctataaccacatgtaacaatgctcaaaagcattaataattatcacaatgttattctgaagtataacatttacccatgagatgtaaagaaaaaagatattatgcatcaaattaaatatgaagattattttaagttttctatatgatcaaaattttagttatgtcttgccttgcgcctcgagatttcccgcggcttaagcgtagccatctgggtccacgtcagctccttggatgtcgatagagcttgctctacggtctaacgtacgagtacgaaaaagatagcaaataaagcctataagcaaattgctacaaagaaacgataaaaccaaggaataaataaaattggagcaaggcaaggggaaaaataatggtttaaaataaattttgatttggaaaataaaagaggggttttggtttctaaaggttggaattgaaggaaaggataaaatggataggtgtggttgatttggtggatttggttttctagtcggtgctagagtaaggcagcacgacggctagatatttggagttggttagctgatgctaaggatggggggatcctctagagtcgacctgcaggc

SEQ ID NO: 69367 - DNA, 640 bp, Oryza sativa
aaggcactggtcgcgatcgcgtcggccaaggtggcaaagcggggtccggtcaagaagacctccaaaaggatagggctcgtcgaggtcggtcgcgcttttagcgatgacgagtcctccgatgaaacccctacttcgcctactggccggagcttggggctttcgactgctccttgttaggcaagaaaagattaaagctaatcttcttcgtttaatccctcccacgagagaatagagagggatttggagggtgatttaatgcactctattgtggtgcagaactattccctctcaaaaatccccttcaatccctctttcttatagattaacagaacaaggtattagtgttttttttattgttacgagacttggaatctaaatataccctttggctacgtataatgacatcggatttatcaccattttttttaaaaaaaaactaaagcctcagtcaaccgctgactacgaaaccgtttgttcaaaacttatcgactgaaatgggccgtgtcatatggacctatgttttcaatctttcttttctttatttttgaaaagagttttcaatcaaattaatacgacatatgaacggttggctggataaactgccaccactaatttttaaaaccagctagctagatagaat

SEQ ID NO: 69368 - DNA, 1003 bp, Oryza sativa
ttatagtcctgtcgggtttcgccactatccaactctattgaccgtcgatccagcgggatggcaaaggtggaatatgcgaggagaggcagaagagtcggctagaggcaggtacctacttgctactcccctgctgcagcagagatgaaggttagggaccgctagcccatgtagctcgggagaaaaaagcttgggggcaagagccgacggagctccggtggtggaggtcggggaggatgggaagaagcggcaggggatgggcgacaaccagatttgcccttctcggccataatgttcttctcccctcttgatctattcttctttcttttgcctcattaggcggcgtctaacgcagatggatgtgtacctttgagcaatgacaactaatgagcagcttgagctcaaggcggcgtcaacagccggtagagctcaggcaaccaagattagtggcatgagtggacggagctccagcgatagaggttgaggaggacgggatagaaacggcacaacatctagccatcattcctcctctcggcgccccatccctatagcagtcatcaaggaagaagaggagcagtgccctccaaatctgacattaacactacccgtagcccgttggaggtgaggggagcgcaaccatgtagatggatctggagaagagaggtcgggtggaggcaggaggtgtggaagacgatgagtggtgaagatagtggccgtcatgtggtggaggtaggaggcatggtggaggtgtgtagaagactataagtggcgaagtatgactgtcacgcgggtcccattgactataaccagattttatcgccatgtcaaatgccatgtaagtttaaaataggcttgtagttggatatgggggtaaatagattggttcgaagagttgagaggggagaaagtgctggattattaattaaggggaataaatcggactcacacgatagtgggaaatcagacttttccttttttatgagctaaatgtatggatctttcttgg

SEQ ID NO: 69369 - DNA, 5111 bp, Oryza sativa
ctaaggcaaaggtggtggcggatagaggagagctcgggggtccttttaaaggggctagcgagcggcgacggaggcccacggcgaccggcggcgagaaggaaaggtcggggattcggaggagagaagtcgatccgattcgagatcgaatccacgagtttccaaaccgaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggtcggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttggtaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcgtgaagatactctgccacagtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaaatgatcccaccattctgatgcaggtccttgcaactgatgtgaagcgaacacgactttctcctgatccgtacactggagcagttccaacttcttctcaacagcgtgtagccaatcacctgcttctactgggttggtagtgctagaaaaggtaggtggcctcacacgaagaaaatcagttaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctgttgcttattagagaggatagaaggagaggggttacactaaagacaagaccttaaccaggttaacactgatctgatgtgtgtagaccattatattgttcaagttgattaagcaagcaacctagtatagttacacactcatcattgaatcacaccaatgacgggaatgcaaccatacctacacacaagcaagcaacaagcgttctaccctactaactattctccaaggacactttggcggcataggttctaaggtaggatccaaacttcattccatcttgacatctgggcacttcagatcgaccatcaccttcttattcatcgatccacttgacttaacctccacaagtagaccacattggcgtcttcaagtttcaacaactagtttcagaactactccagttgaaagcaggaggggagaggatgaaaaaatgatttatagagaattctagagaaggaagaaaggaaaattttcacaaatcatgttttcggaaaattagtccttaaggtttgaccatttggcttatcctacagtcaagatggctctgataccaacttgtcacgcccggaaattcactagttatttccgaacatatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggaattgtgtttaggatctgtgtgacttgccttgcaataatcggtcttcaattaatcttcttgaatacttccggcgcactcgcgaaccttcacaacgacggaaacgacaagctaacacgcaaaacaaggaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttaaactgattttaattgaattatgacgcaataatgaattatttttgaaaaggaaaagaaagattattgcgtcagcggctagggtttcggtggacctggcgcacgggcggcggttcacgcgaacggacggccgagatcgatccaatccaaaacggacggccgagatcgatcggtccacgaccggctcatgacggacgaccccgatgacgtcggcgatgacgtcacctaccagcggcggcggctcggcggagcggacggctcgggcggcgcacgctcgccggcgaacgacggcgcggcggtgcaaacggagagcaccaagacgtagatcacggcgcgacgaactcaccgatgaccaaaacgacggcggaggagcaaaggacggcgccggcgacgaggagaaagcggcgaagctcttcgggtcgacgacggcgacggcgctccggcggtcttcggcggcggcgaagcggtgggtaccgagctcgaattcgccctatagt

SEQ ID NO: 69370 - DNA, 696 bp, Oryza sativa
tagttcatcagaatcagtgcaggacgaataattcatattatattcttcttttatttacaaattgcaattatgttaccctgcagtcctgcactcctgtctgctatcatgatttcaagattagttgaacaagagcaaacttagtggcatggaatatatttttatattttccaatgcaaccacaggatagtcctgacatgttgtgatttcagtgcaacatgttagaaattccaatgcaaccacaggaaatataattattttattgaagtctagtatatttagctcacatcatctataaaatagttaaaatgtctcgtaaaatccactggtccgacaatgtgtgaaaactatggatttacttttcattaggtttaccaaaattccatgtttaggagatggacttcaggtaattgttgatatagaatttttttggaactggtcatgtactgaaatttccattagatctcaaagtgagtaagctgtcaaattttatatggacttgctaaggaactcatatttgctacaccatgaatagtaataatccactacttgacaccttccataaaccagccttagctctaatactttgcttgtatttgaaatatttcagtcatgaagaaatcgatgttagccatcctgatttttttagcagtgctaaactcaatggatacatccctccaataaaagaggtaacattac

SEQ ID NO: 69371 - DNA, 525 bp, Oryza sativa
cgtctgcccgggtgggaagacgaggtcgtcgatgccggagacggaacccattgcactgatcagcgaaaagcttgacgcaacccctacctggcgcgccaactgtcgaaactagatttcggcaataataaaaggggtggctatcaagctggaaaagtgtatgggtttggagacaaaagatttatacaggttcaggccttcttattcaagaagtaataccctactcctgtccggggatgaatccgccgagtgtcttcttaattgtatgatttggagaaaatcaacatgtgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagacacaaataagatattctatctatatttggtatcctgattcagtccaaataccatcgccgtgtagatatgggatat

SEQ ID NO: 69372 - DNA, 8573 bp, Oryza sativa
tcagatcaaggtccgagcactcaatcgtgatggcagagcacttgttgtagttattcctcagacctgatgcttctctaaagagaaataagatttcattcatcacccgcgcgtcatgttctctcggccggagaaagggaacaacatcatcagggtagagctaacagccccgcttctttagcacctgaaacatcaaacttaagatgtgcatgacaatgatgaagagaatcagcgacaaagggtcaccttgccgcacaccacggtgcagccacacagccagcggtgggcggcgactggcgagtggcgcggggcgatggggcaggggatggtcggatgtgggcggtgactggcgaatggcacgggaggcgtacgacgcaggtgctggtgagcggcactggcgcctggtggctaggcttagagacacaagtgtgacgccgccgccgtgttaggagactggggagggaggagagtgcggttgatcccctttatccttttcacttttctgctagggttcactgtatttcgattttgggccttatattctatgccacaggcccacggcccaagcaataacaacccatgtgtgacttgctcagaaactgaggattatctactctagcttgttaaggctcacgagcagctcacgagttagctcgagctagctcgttatctctaacgagcttaaaagtcagctcggctcgttacgaaatttaaatgagacgagctgagctgagcttgtcacgagccgagcgagctaacgagtcaagagtttcctgtccacccctacatgtggcgccaacatgacatcatctttcctttcttcttcctcctacctctctctctccccctcatctctttctccccatttctcttcacgggagcagggcccagatcatcggtggtggcgacggacgagggccggagcggcggcagccgacgcctcctccaatcccatcccggccagcgttcacccagtaccgcagggacggatcttgcccggcaagcgcttaggcggcacggtggcagtggcagcagcggtggcgggagggtccgccctctgcggcgttagcatgtactctcgactgtgccaccgagagtcaccctcgccgcctctctttctcttccctcaacggacgacggcgtttgcgcatcaccgacgcccctacccatggattgtcaacaatcttcccccatccccgctgctccgttgccgccacgcctcatcgctctagatgccacagcctcccccgcccgtccccgtggcatcgttgccggtgccagcgccggcggccaggagggcggtagcaaccccttctctctccctctctttccttcttgacgcggtgcagtgatgaggagtgctcgcggagcacgattccggtgcaaagacagcattggcgtgatggagaccggtccacagccgctgccgccgtactgtcgcgctgccactctgcgacgtgctttgtggcagtgacgacggtggtggccaccgccgtcggctccatcgccgccctcccgactgcagtcatcgctccggcccgctgcccactccctcgagctccgccatcgagctgttgttgcggctgccaccaccgctgctatgcgacgtgcttcgcggccgacaatctggcccctgctctcgtgaagagaaacaggggagagagagggaggaggatgtaacgccctgatttttgttcagaaataaaaatcattaaataatgcatttttagaaattatgttaaaagttaaatcaatttaatcaagtgaaatagtgagggaattaaaattttcctttaaaaatcatggccggaaatattttgtaatattctctgtgccctaatatactctccagatttgtccgtgaattttcggagctcaacatctaattctaatatcacaaagttcattgaatcaaataaaataaaaggaaaaccaattaaaatcctgccctttgcaattgggcctctttcggcccaagccttccttctcacccgcggcagccctcctcccctcctttctcggaccgctcggcccagctcgcacccccttccccgcaaggtcgtttcatctccccttggctccctcctctctcccaaaccaccgacagtcagggcccacatgtcagttcctcccctaacctccagctccccagccgaaacctccattgccgccattgccgcccacgtcgccgccgattccggctcctccttctcacgccctcgcgcccaaaccatgtggaattggttcccctccacctcttccaccaattcccccccactctcccgcgaaatcggcgccaaaccgcctcatccgcccacgtcgcaggagccccacttcgccggccgttgccgcccctctcggccacggttctccctcccagagcactataaaacgatccccgcgcctccctctcccttttccctcttttcccgtgctccccgcgtcctccctcgctctccccacgccgagcccatgcgccaccggtttccggcgagctccggccgtcgctcctcgccgccttagacgccgccgcgctgcgccaccaccaccatcggcatcagcgtgccgtgccacaccccggcccctactccctttcccctctccgcctccgaaacattgccgcaccgcgcgcccgagctccaccgcccgtcggcatcctccagccgcgctccaccgccgctagggtcaccgccgcgctgcaccgccaccaccactacctctgctgcccctcgccgcacactggcctttgctcggtttccccaacccctcaccgaaacaccacctccactgtcaacccgagccgccaccacctctaccgcctccagccgtccatcgccgccgccctgagtgaccttcgacctcgcgctctccttcgccggcttcgcagcaacgatagggagcccgacaatcccctcatccaagcccctcgtcgccggaatccattcccctcgtcgcaacgatagttttcccccacattgccagcggcgcccgcgttttcccgtcgccttgcgcctcctcctttttccctgatccctccatccccgtggacaggtcgaggagctgctcagccatccctccgcgctcgccggtcatcgctggagtgccgtcctcgcttcccaacccgaggaacgtcgtcgccaatcctcgccgccggcagccttcccgttttcgcctcgccgtcttgtcttcttggtgagcatcccccttccctcccagcctccctccgctgcgtcccacgcgtgccgtcgcgctagtggtcgccaccggcgaccatcaagccgtgcgccgccgctccctggccggccggccggcttgaagccgtgccgagcccggcagccacaccgcgctgtgcctggcagccacaccgcgccgttggattgggtgaatccaggcctccacgtggccgtcgtggtgccgtcccacgcaggtgccacctcggcgacacgtccttgccaccttgcccgccggtccaccgtggccaccacgtggtgcacccgcggatggcgcgcgtgtggactcggtccaccgtgcacccgtccctttgagccaccgacaggtggggcccgcttgtcggcgccacctattcccctcggtgacgtcataaaccattaataattgtgtcataaatcggtaataattatagaaattgatttaaatggctgaaaacttttaaaattcatatctaattcatactaagtccaaattgggccattcaacttgcagaattcatctaaaattgagctctacatgtttgtttactttttatgtactgttttcttggtttttattagagtttttttttctcattttgcatgccagtgtgtagtttccgccgtttcgaaagatcgcggtcgcgaggaaaagtgttcggaagattctttcaaagaagcaaggcaagtcacacatttccccttgagcatgttgatcccaatttataaatgttttaccgtttgcaaataaatatgcatgttttgctaattacatgggattatgggtttaccaatctactcgcttgtgccatgtttacttgttaccgtcctttgtcaaccaatggatgatagtttatctagctcatgatacttatgttgatctagctagaattatatatgcttagccatgcttaattaccactagctcacaaaatgggataattacactatttgacatctagtatcatgatgagctgcgtgctcgagacatccgaccatgtttcattggtcataattatccaactaaaatgtgactgaatggtgagcagtggatgcatggttttgctagtcgcacccatggcagttaaggaccggttcacgggaaaccctagaagacttgcagtgcttaccacaagcgggaatgggtaattgcatgatctgtagtatagctcgaccctttcctaggcaccggtggcgagggtgggcgttatggagttggatcggccggggtgtccggttgtccagctgccggattcaccgtggcgcacgaggggactgcccacctccggggtagggggtgggggtgaaaccttagcatggtgtggttggttagggaagagttatatgaagggtcttatcacaatcactcgacatggtaacgtgtctgcgtaggcacggtgacatgccggtggattgtgttttgtgggtacagttgtgcacctctggccagagtaaaactattcgaatagccgcacccacggttatgggcgatcgaccagattcaccgtgattagtctcacccttaataaatcgactcaatgcactgtagttcaggtgggttggttgggcctgtccaacgtggtgtagcattgttcagtagagatttaatattaccttaattactaaactgttttactgttttgctcaataaaatgttttacaaccacctttatgcaaatagccacaaaccgtccttgtgttccccttgcacgtctgcatcattggtgtggcttgctgagtacggtggttatactcagccttgctattgtttccccttttcaaaactgtagtgcttctgagccgaagacaaagttagagaaccaaggctcagaccccagttgagttttgcttatggagtggagctgaagcctcgctaggatcgcctttttccgctactgctgctttcgtttcggtgtgaggactatgcgcctcttctgtaagtatttacgtttggatctgtctattacttattgttttgtgtaccctggctgattctggacagggatttaatgcacaaaatagtctggaaatttgggctaaatttctgggcgtgacaaaggaagagttctcaaaaaaaaagaggaagaaggaaagaggatgccatgcgggccccatattatttttgtgtgaatgacaaatgggttctgcagatatttttttaactctaatacacgtgagcgccacgtcaactccacgtggaatgaagaccgagtcaacatcatcacgatggtgccatgtcagtgaaaccaccctccaaaaccaccaagggagttaaattgtactggttttaagagttggagggttgatatatccggtattgtcattcagggatacgaattagattcggacactagttaagggagtcaaagtgaacttattcccttattatgttacatattggattgggttttatatggacgtgtcgtatgattctgggtttatttgggcctcttcttgggcttaacaaatatattgggccattaaaatagtcagatccaaatttctttttattttttattgttttatgtcagataatttcagctgttagattttgatccaatgacttcaaaatctgcataattgaggcctcaaaaatcattcgaatcctatatagacagccccttagcttccacgccagggaacatgtcgggaaatagatagcatgagtccaaaacactctatctaacttcttgattgaaagataaatgattgcaaacaatagaaatctcaaatgcagataatttacaatttgttttacttttaatagacatcagttgcaaaggaagggcacccggcaagtttcattgaaaacccaagtctgtggtcctagtcttgcaaaaccccagatttaacatgaccacaaaacttgactggaaacacccaaaataccaggttgaaatgaaacgaacagtgatattagaagtaatgaaagggagcataaacttgtataaatagtgtctacttataagtgaacatatgtgcttgtataaatgaaataaagcaacaataatcaattgtctcaatctaacacaattctcgcaacaatctctgtaggctacgacgaagcacttgcatttttacgtttttgttcagcatagggaaaaatacagatcaatgaacaattaaatttatttctcaaaagtggtggaccgaatataaggtgggttacttcaaagtgtcactttatctagcttttgtccctctagagcatttttattgttttagctctgagacagacatacagatccactttttgattccttcattgggcaagcaaactaggggtgttcatccttggttccatctgaaccagccaaaaccaggcagagcaaacaaactttagccaaaaattagcccatagtgaatatggctcgctttttttaacccatagatgaacagccctaaagcaaaagcagagctataaagaaaaccagttatatgcaattctaattaccttacaaagtagaaatatttgtctgtattaaggtctatctagtgactgcacatgccatagaaggctagagtgccatgaattttgatcaccaatgtacctacaccaaggaggcaagaacccaagatttttgaccgcctaccaaccgccatccaagaatcctaacatagatatatcatatatgtattgcagcagaacagcagcaatgttaatccagcagtacgaaaaattatcacaaaatccagaatctcctgcttgttctgatcagttagcgatagatttgagtgaacaagtagtctctgactgaactagatgtatgaactaatttaagcgatgcggtaaagtcctagaaaataattgtccaaattaaggggcttactcataaggatattacgcctgccaggcagggtgaagaaagtctccggagtggatcatagatgctgtaaacctgtttccattggttggagatcactagggcacgagtggactcgaggtaatccacatttgagtatgctctaatggtgacaagctcccccacgtgttgaggaaaatcgaaggatatgtgagggtcattgttgacccaattaagtgaacataagccagggttgccagcagggtaatcaaaggaaattaatttgcaaccggtaacaatctcctcctcgtcctccaagtaggtcagcatttggatctcgacaattgacaaagagtacatgtgccctgctgtgatggtgcttgggcttgcaacggaggagacagagacatcgatcttgtaagcagtgatttcgtcgctagtgttcgatgagccaaggaagagtagtgttccctgaagagggatggcacgtccgatgaaaggcaggtctttgtcatctagtttggcccattgctgcgtctcggtgtcgaacatgtgagtgcccttctggccgtgcccggttatggacagcagaatgtaggagccaactgctacatgggacttgacggtatccaccggtggaaagatgtagtcagttggggtgagatcccaagggaaaaagggcgggcgaggcaggggtttccactcgcaatccagcagacagcagcccgaggcattgtcgatcactcgagccatggagagatcgagcacctcgaaccagggcacgaaattgatgtcccccgtcacgcagggcatgcctgccagggcgtatatcctctcgcccatcggtaccaggatagggcagagcttcgtcgacaggagcttgggtcccgataccaccttgcacgcgttggtgtcgaagacgatggtctccgggccatagtccctgatgcctgtgttgccgccgacgccgacgatccacggggcatgcctcctcgaccgcacgggaacgaaagacatgcagtgcttggagggcaagcgggcgaggtgttgcggtagaggtacaggggtgtcgccgtcgtcgtcgccgccgccgccgacgacagctggtgggttcaccttgaacacggactaggcagggcaagtgactccatggccgaccaccaagtacacggccgacacagactccgtactgcttgtacgagcgatctgacgagggattgaatctccatccttttcctccatcttgtgcttcttgctcaggcaggttagggttggggattgtttttgggacagattccaaataaacatatttttaactcgagcaaatttgtaatagcgtgatctagtttattacaaatgttgcacgaatacgaatcgaaaccttaaactattcgaccaccaaatcggacttattatatagtgagagagagtaggttcccccgagggaaagagagtaggttaccctgccagcgatcgggcgcccgatcagcgacagaaaaatcgagcgcggctgcttcccgcgctttcacgccatcccaccacggggcccaccacacgcgccgtt

SEQ ID NO: 69373 - DNA, 23209 bp, Oryza sativa
  unsure (1)..(23209): unsure at all n locations
caaataaacatatttttaactcgagcaaatttgtaatagcgtgatctagtttattacaaatgttgcacggatacgaatcgaaaccctaaactattcgaccaccaaatcggacctactagagagtgagagagaggaggttcccccgagggaaagagagtaggttaccctgccagcgatcgggcgcccgatcagcgacagaaaaatcgagcgcggctgcttcccgcgccttcacgccatcccaccacgcggcccaccacacgcgccgttgcaacaaatcacccacatattacgaaaaccctctattaagggaatccgtttcattttttgtttcatcaagtttcagtaagtgtacatgtgatgtttcactatgtacggatcaaatgttacagtgaattgaaacatcctttcgctatttgatgaaacattgtttttatatagggtgaaatagtgcccgattttttttggaaaccgttgtttcatacgttgcaaaatattccacgaggtgatttggttgtgtttcaacttttcaaaagactgaaacattttcgaactacttagtgaaacatttccggtctaaaaaaatcgagcgttcttttaccaagtagatggaaatgtttcactaaatagttcaaaaatgtttcagtctttttaaaaatctgaaacacaactaaatcacctcatttaacattttgctacattgtatgaaacaaacggtttccaaaaaatcagacgttgtttcactctatataaaaacaatatttcagcaaatagcaaaatgatgtttcaattcactacaacatttgatctatacagtgacacatcacgagtacactagctaaacattgttggtggaacaaaaaatgaaacggatacccttaatagagcgttaccgtaatatgcgagtgatttgttgcaacggcgtctgtggtggggcgcttggtggggatggcgcgcaagcgtggaaggcgcgggaggtgcggcgggagcatgggaggcgcgggcgcccgatgcatgcgcgcccgcatcgggcgcccaatttagacaatttttgctttatttaaacttgctcttgtgttcggtttcaagggatgggaactactcccccccccccacacggaaaacggaacgatccattagcatgtaactaattaagtattagctatttgtcgaggagtgatcctctctagcgggaggtcgtgagacccccctttgtgagttcagctgggggataaggcgcgaactactaggtcgctgcaaatctgagtgagagaccagtgattatacaggttcgggctgctatgaagcgtaacaccctactcatgtgtttgggattatggtgagttgttacaagagatcttgagctcctcgggaatccaagccgtgcttcctttagagctcaagctttcgagagtcgtcccctttctcggtgggtgaggtcctccttttatagttcaaggggataccacatgcactgttcatacctaccccccatgggagggggggccacatagcctaagtcagataactgtccgtgccttcaaccagaagcaaagtggtcgtccgcctttaggtggggcccaacgccgtcctccgcctgacacgggggacatccctgtcattccctattaattgtataaagactttggtgaattcatcatatacaggcggcacactcggtagtgtgctgatggcatacctgcccccactccacctgacacagggcgggacgtggggccactgccacccgtcccatccgtctgtgaccggtcacatgccggtcaaggccgattgacatgcgtcaatcgggcggcaccacgcgcctgcccatgccgcattaaacgcggtgtggggcggttgggacgccgctcaattaagacgctgggcagggtctcctgctcctgctccgctttctcggccgccacgtggtggccgagtgagggcctcagggcggtacgtgccaagggcacgaggggtgtgacgtggcaccccaaggccccctggccacctcagtgctacccgatctccccccgaggggacggggaaatagtcgtctcctttagtctccgtcgccgtcgttggattcgcaaagaggagaagaagcccgggcaccggttccttttagccgtaacctgctggaagcccgtcatcgacgtgaatccgatctactccgcctccggcagagccttgccatcgacttcgtggttcctggacgtcgtagtcgccttcttcggcatcgcagcgccaaggtgaagcccgtccgctggttttcctctgccaaagatcgccggaacgccgttgtcgtcgtcgaccagtacctcgttgcccttcggagctcgtcgccggtcgtcttccgtcatcgtttgtcgtcgccgtcaccaccagtgagttcctctcatcgtcctctctgcgttggtgctctcggatagtccggccgagcttcctagctcctgtggccgtgtggtctagtgccttgttctggcgatgatgtcatgctgacgtcataaatccccttttccttctcgaaaataattaaatattgcgtcataaatcgtaaatccttttatgttcaaggctaaaatcagtttaatattgtaaaattcataactgattcatatggaatcggaattaagtggtatcagagcctactctcgaggtttcacgggcgcgtgtgtcgcagttgcgcagacatgatgcgcatggctggtgttagggatggcaatggggccccgttcaccatttccccgtggtgaattcacctattaggtgacggagatggttaatatctgtccaccatggtgaataaaatggtaccatagttatcaccatcggggataacgggggtggggncggtnaaccattnaccgtcctcgccccccgcggtgacccgacctttctatatagagaactaattttagactttatagacattttggcccataatactaaagcccaattaacaggtatatataaaaagctaaccctagcctctcctccagctctccaccacagccacgcccgcacaggcgcgcggcgcgggcgccgcttcctccactcgcgcgcgccgctgccttctctcgcgatctcccccgcaccgccctgcagacgcgcgcgcgccgccggcgcctcctctcgcgcgcgccgcctcctcctctcgcccgcgccgccctgcagatgcgcgcgccgccgccgccgcctcctctcgcgcgcgctgccgcttccagacgcgggcgccgcctcctcctctcgcctacgccgccctctgcagacgctcgtgccgcctcctctcgcgcgcgccgccgctctcctgctccctccgttgacgcgccaccgggagccgccggctttgtgctgcccggcgcctgcaggcgtcgatgtgggcgtgggagatgtagttgcgtggccgggagcggggtaaccacggggaaaaattcaccgcgcggtgatcggggttggtgaaaatatagccccgtcgtgattgacgggggcggggacggtgaaattttatcaccgtggtgacggggacgcgggtgtgacccccgacggtgaattcaccgttgccatctctagctggtgtggaccagcatggcacatgcgttggcactggacacacggacatggccaagaggggacgttcctagcatggggttgatcgacgggggcgtcgatctctcttaagggggtgaggatatgacatctcggcctaataggatactcatatcaacaagttacaacttcttttccagaagccgatctctaaagaactctaagattaagcgtgcttggcctggagcaatttagggatgggtgaccgattgggaaattcttcccgagtgcgcacgagtgaggacaaagtgtgcagaaaagacatgtgttggtctgtgagggcagtctatgacctatgaaagctgccagatgtaagtggacccggcctgggaaaggctggtcgttacaaaaggccagttcacacggccacgtggctagataggaaggttacttccctctactgtgcgtacccccgggcccatatcaccaacagtagccctcggcactacgtctgaccgcgacccctccagggcggtctagcgtggtgcctcataacttccgtcttgtgataatgggtcccgtggggagttcgaggagctatcattggcgcgctcgactcaagcgcccactatgaagattatccgactgccaataaatgcgccacgcgtgggggcgcgtagggcagaaagactggggggggggtctgtcaaaccgcgcccggtatcattactggccgttgcatcaactgcctgattgtgaggcgtgtgcgaaaaatgggattatcggtgggcccgaccggccatgaccgtaatcattgcacgtcccgcgtcaattatgctgctgacagatgcgttcaacacggggcgtggatttagtggggcgagtggttcgagagggtgcgaaagacgaggaggcggctgcggttgcggggaacgaggaggcgggcgctagcgaggcgagaataaaaagggaggagggaggagagttcgtctccttcctctcgccattcttactctcgcacacacgctcctcagcccccaacgttcctctttcggattactgcacctcgcgcacccaatcttcccgctcgcactcacccaccgccatgactcaagacgccggcgacgccgttctcctggcctcgcgcatcacgatggatagacacttgagtctcgtccacaagttcatgccggagggcgccgtcgtgagggcgggggagtcgcggccaaggccgcggtacccggatcggtccgtgcacctcctgtccttcgccatggcggggttgattccacccttctccagcttcttccatgaggtcctggatttctacaggatccacgccttgcatctcgcctccaacgctatgatgacactggccccactaaaacctcctcgcctccgccctcctgccaccttttctttttcaagaaattctcatgttgtagcttaagataggccaaaatttctcagttggacatgcttgctaacatagatgcaaaaagaattttgacaaaaacccccaaagagtactgataacttctatatcagtataaacccaacaactggcagtaccgtcaaggaaagccccaatttgttgtttcagaaataaaaccttatttcgttttttcttgattgcaacaagtgaggctgttgcgttaggtctgatgtcccaatcttaataactaaataaactaacttatcaatcatatagatttcaacatatgtcatactcatacacctgagccaggttggatacagaataaaatacattgcaccatactgtatgcggcaaatgcgatgcaactgacgacgataacaacaaccaacatgaacatctggcaccaaccagtcattacactatcaatcatattttttcataagagtgtgctactatttaactggcagttctttatcatgtaaaacctaatcgccaaacaatattatccattgtccattataccaaaaagcatggaggatggaatcggaaaaacacataattggtaaaacagacagaacatgtgaacaagggagagacgcatataactctgccaggttggcaaccaaccacatttatacatggatacaaagagagggaaaattattgtgccatttgttccttgatgatactgtaaaggtgataagaaacatgaacttcaatgcatccttagtaggtgacatacataatcaatcttcacacacacaagagctcatgccaacaagaaattactctgttgccaagctcagatgtatgtatttttcttaacaaatcccaataatagtaacaatttgttcctacaaggtccctgagtcatcaccaaattgcagacaaattggaaccaattttaccttctacagaatcacaaattggaagcatttacttgcacaactcaagtggaacatcaggtagaaatccagcaaattactacacaccagagaataagcctctgagataatcccaaacaacatcaacaaaaatgcatcaatcaaacacatctatggacggagcggcggccgagcgagcagctcaggccacctctccggccgccgcggaggccgggggcgcgcctgcggcggaggagcgggacctgacgaacgcgaggaggcggttgctcacctccctggagtagagctgcagcgtctcgatgccgtcctccacggaggacgaggaggatgacgaggcggaggcggcgtcgaaggcctgggcctcgacggcgcgcgcggcgcgctcggcgtcggcggcggggacggcgccgtagcggtagcgcttgcggagggcggtggtggtgtcgccggagaggacggcgacgaggcggcgcaccacggcgtcgcgcgtgcggcgcgtgggaggccagacggcgaaggagaagggaggtggcggcgaggccgagccggcgcgggggagctcgtggccatgtgttggtgtcggggagcagagtagtaaagcagtttgatgcgctgcgtcggctgcaaggagtcttttacacacgttttggagagaaacggtcatacggataaaatgatgggctacactacacatgagtagatccttttgtcatgtgactagttgacttgactaatgccacaaagcccacaagagcgtggctacccatcaagacgccttcttcctcgagctgagttcaaaggcgagtatacgtagggctgtacacacggatggttggttgtcattggcgacagtggcacgtacaccttgacctaaggtgacttgggaggtggggatgtcgaaagatggaggcggagcgtcttatgactcttcatccttgctgcaccaccaccagtcaatggcaaataagagacatccgagagaagattggtcgatgactaggaagagccctctcctctttctctctctcctagtttcaacaccagccaacagcgatgatggggtcagtcagagcagatcagcgataaggaagaacccatagatcctgtaacgatgagattggaattggtcgattgatagtagatgtagtggcaacagcttgtggagatggatgtccatcgacaaaagatgcttgaggtcatgctgacagtggccactccgcttgaggttgccctctctccctcacccaactcttcccatcggctatttggttggatctattgtcaggaaagggcctccttttgcaccctccattgagcacccaccggcttccctccctcccttcacttggctagaggaggaacatgacctgacggatgagcctcacaaaggatgccatgccgacacgcctatgtgccatgccacgtaagaaaaaaatgtttgtaaatattttaagaagctgtcctttcttgacaaatttataaaacccaagataaaagtggcatttgaagttttatgtgaagaataattttttctactatatttgtattatgaagtttgctatctcattatcatgtcacccaagttggcagcgagaaaaattggaaaaatcaacagtattgaaaatgttttaaaaagtatttgaacctcaaatatattattaaaatatgccactatgttttaaaaaagtatttgctcaagagtatgaatttataagatattttaagaaaatatacatatattttaatagaattataataaaaccagacatttaaaacaaatatattacaaaaactacatatttaacactaaatgtaggtcccgtttggcataactcctgatctcatatttacactagatttagactttataagttaaattaaagattttgattttttttcttaagtaagaacaaaatgattcatttaaatattatcaatattatcacatatctagatttgtggatttattaagctagagatacctagctccaagaaatcctggatttagagctgtgccaaacagcggtatattacaagcctacatatttcacaaactaatgcaaacctctttgatttggagaaaaattttctacgaagacttctaaataaaggattgaatcctatggaatggactggattttggaggaaagttaaccgaaactccaactaatttcattagactatctctcacctgattccttctttttttttttccttcagtctactcaaacaatagttcatgtattttatgtgtatttatttttatagaaaaatcctatgtttttctattcctccaatttttaaacttgtgtttcaaaggagctagggatatgtttgtgataacttccttaccaaattcataatttgtgatactctcacttatctttattttttacaataaatttgatgccagttctatttaataataccatcagattattgaaatggactatttgcttcatgttttttaaaaatatattttctcaaaaatattattttactgctacttataccacttgctttaatctatttgtaaagtttatttattaaatatttaatttgcctcataatgtttcatagtaataatctgttcaataatctaagcaaacaaagttttaggttgcgtttgtttcaagaaacaaacacaataaagagaaaagttattcgttttccacgcgcacgcttactaaacagcaaatggcactttttttaaaaaaaatctataaacgattactttaaaacatattaatctattttttaaatttaaaataattacaacttaattaattataagttaatgtctcatctctaatttacgtacctcaatatctcacacccaaaatctctaatttactcaaatcttttcgttgcaagaaaaaaaagggcactctcaagtctctagcctttcaaggacctttgtgtaaaagtggactcaccagatcggcgcccgtttaagccgaagagagcaaacccagagatatacagtcaagggccaacaaggatcggatccctcgccgccgcggcggacgacggcgaggcctccgaatctgactaggtactccacctgcctcttctctccctgttcgtgtgtgctgcccgtgtctgcgtgtggcggggtctccatttcacactaggggttgcggctccgcgaatcttgggggtgagtttcttttcttgtgtgcaagaacttttgggatttatatgcttttgaatccacactgagatgtgtagaccactcgatatagtcgctgctggattctgattgaggtaagtttgtgcaatggggggcaagagcgtttttttttttttttggatatgattggagcgtccttttccagttaggttttggattagtgctctggtgtgttgttggtgaaacgaactctgtagaatcctacaaccttggacactgtaaatcagctcgcctgtaatcctgttagaatgcacgcacgagtaggtatgtgtgatgtgtcggtattgtgtttgatattcttagctggcatttgctaattagaaacaccagtatgtgctgattagaagcaccagtatgccaatttaagagagattgttgtgagagcatggcagcatgagttatacaacattagcacatatttttgtaccgcatgtttaattaccttcaatctgatttagaattacaaaattgtacagagtttgcgtccctatataatttccagttcttagagtttttctttttttggtgttgcttgttgatatcaaagttcctcactaggctgcattgagttctaatgcaataggtgcatcagaaaccggagggttttacattaacttctgcccttttacatgttattaatgaatattgagttgaactggacttttttttcttctaaaacactaaaacaatgctaaccggtagtccggtatttctaatgcatttgtaatggtttattgctcttccgatttttgtttgaactattagatttggtttgctggtttgcatctaatgcaggtgatgttctgtatttcaggcttttcatatcttcctaacagaagttgtccttgtcagcaagatggtttcctttaagatgaatgaccttcaaagtatgaacatcatctatccctgtttccatcatctgaaatttccattgaacactaaaatagcaatatattgttctatgcatcattttcctttcattgaggttgaacctttcaatggttgcagaaattatatttctctaattatggtagtaaccttgaccatgtttaaagatgtttgaacttttgaagttcacagtaattttgtaaaagttgtcctttcttgcatatgctttgtgtttatttggcttttgacgatcccagaattgacaaccttctcttgcatactgtacaatatgctctgcttgccatttaagttgttactctgcttcttgttatgttagaatttaggaatacgttataccgcagcagagaagcaaatcctttgctgttgtggctatctaagtataaaggcacacttttgccgttccttcatcacagccagtaattttctttcgacggttgagattcctagtctttcaatgccctaccaggcccattcctagcctttgcacggttgtgacaaaaccttgcatgctcacacttgctgtgtttgtgttttcctgctagattttctactaatgcagtcaaacactactgttggtaacttgatcatgctgcttgtcaccgctcttgcttgctgtgtagccagagctgtgcacaacaaatgtctgtactattatgaacaataaaaaagtatatgtgagctgtagttatatttaggacctgttcgaatgtgctattggataaagattgtcactggcacgcaaaatgagacgagccattatattaactattacgaacttgaaaatggatttatttggtttttaaaagaaacttgtacttagaaactttttgcacgaaacacaacatttaacagacaatttgggaaacgtgctaacggaaaacaagggaaaagctccatccagatgctacatcgaccgcagccttagttgacatgatctagttgaagagttgcatacttgcaatcattagatacagaaccttgttctatattgttctgtattagtcgtggcttgtaaggaccttgggtagtgtaatgggattaatctcatagaggttgtagccagtgtccaaatgtggcaccactacaagattaagcagaatggggaagaaactttaagagaaaattccctgtgtacccctgaaactttctctaatcctgtccatgccccaaaattttgctcattcccttgtatacctctaaattttagtttggatcccttccataccctttttgttagttgaccgtgagttgatcgttaaattcctatcaagtagtccattttgccctttggtatgaacaaacatataaaattatggagtatattgttcaagggtagaaatttgctatatgagactattatctcaatgagtttgttatgcgagatattattaatcataaaatttatttatagatatgaaacaaaaaattaatattaatttattatttattaaaaaatatttatgtataaatagatttgtcttatacaacaaatatgttgtacaatactatctacaaaataagctacacatacaatgtttaattattaaaaaataaatattaatttttatgtcatatctaaaaataaactgtcataaataatatcttgcattagaaactcataaatataaaagtctcatacaacaattttctaatactccattaatatatatgtttttcataccatagggcaaaatggactttttcataagaatttaacggttaactaactgtcaactaacagaaagggtatggaagggatccaaactaaaattcgggggtatacaaggaaatgagaaaaattcaggggcatggaagggattgggcaaagttttaggagtacactaggaattttctcaacgtttaagcagtgtgttatatgcaattatgcatcatataccactccaatagagttaggcatagagcagattttggaagctaggatgctagtatgttacaatgtattacttgtggcaatcaatttttcatgaaggaatacattttttctgtcaaatattttcgtcagtattttttttccctgaaaatctatactttcctggcacgatcttgagttgaatttaattgattgcctacctcatgccattggcaattggcacttcgttgctcatccccctgtagctattctggagcatttttctatttttgcgataacaaatgcattatgcaccctgctacattttttcaatttttttcatctcatgcttggaactatgctcttcagggcatagagcactgtttatcctggatgggatcacatttcccatccccacaaggtattattccattggttggattttcttttatgctttcttgctatgccacatcatcgttatacccatacccacttcaattggtaatttgtgaatctcatcttgcagagattgggatagggctgacaggctttggagtattcttctcatttctggggatcattttcttctttgacaaggggctacttgcaatgggcaatgtaagcttgcttgaaacttttgctgaattttttgaagatctaagccaatgaaatgtgtatgcatgtggaacatttcagattctcttcctgtcaggcttaggtttgactattggattgaaatcgactctgcaattcttcactaagcccaagaactataaggtttgtaaatttactgtagcttatcagagcttttgcccatggactatatgttatttaatcaactaactgtaactggcagggtactatctcatttggtgctggccttttgcttgttctaattggatggcccttttttggcatgctattagaggcatatggttttattgtacttttcaggtttgtttctcattgcttgtccattgaccaatccttcttttccactatttaatgctgagataataaagaatgtcttatatttgaaaagatttctgcacagtgcatgcttgacaattgtcaggtttaacatttgtcttgtatgtgacactgaaattgcagtggattctggccaactcttgtggttttcttgcaaaagattcctttcattggttggatatttcagcagccatttgttgcatcggtacagattttcccaacagaaaaatattctctatatggacactgattactgcatgtgctaactgaaaaaaatattttatttgcagtaccttggaagctatcgaggaaaaagagttccagtgtaggtcttaccccaagtagtgacacagcaattcgaggtttacatggcaacctcaattggttttgtaacgcgccttccacatttctgcccttctctaccttttcaatcaccaaatctttacaaatgcacatgaatcagggtctttttttttttgtaaattgattttgcctccccttggcttttaatgacacaatactctctttagtaagccagattctaggaaaattcatgtttagaaccgccttgttgaagcagaaactgcatgctcgttgtgcttctgtaatatagttccagcaaatggcctctgatatagaaaatcttgctatgggcacacatttttgtgccagaaattgctggaaccggaacttgctgaaatgactattgtgaactactgtgatccatgaactagctaacccatctgctcaagatgtctatgaaaccttttttcctgacattcaaaatgtctttaatccactggactaaccttttatgactagcttgtttgcattcataggaacggagaatgaaattcacaacagttgttaaagtgaattaacgattgattagttcaaataatgggaaacagttattaaagtgaattaataacggatataattcaaatcagtacaaatgtacaataccaaacgatgagattaatattctgttctatcaggcttgtagtttcctcgttgtgattacctgagttttctcctctcccggcttaatttatgaaaatgaaaagcttataaaattcaacttagatacgggtaaaagatctatagcatatgggtgtctaaattttgcatatgaaaaaggggctctagcaaaacaaactgttgaaagaatgccatccgtcaaatgtatcccatggtcaaccatgcaggttgagcacggagagtacaaaactgagtgcaagagagcaaattagagcagtacagcagctaaacccaatatgaggcaattgtcttggctggaacagatattggtcacaattgcaacaacactactacttctaaccagtaacaggtcagtaaatcctacagcccattcacaactagcagcacagcaaatgactagctagctaaacctggtgtttgtaagaaatctttcagatgttggcaagttcagatcggctgccatttctcgcctaccggaattgaggatggcattggcccaattggacgaccggtgcacgatctttgacgggatgcgatcactttcctcgcctcccgaggcctcgtacccaccactcgtcgaccttgaaagtgcaatgctttttggagcagtggattctgatgctgcgagtgacatgaaactgcggagttcgtctgctcctgacattgaaacacggaatgggtgaagatcaggtgagtccaggctgctctgaggtgatgaggtgaggtttctgatcgacgatgcgatgcttggttggaaaacgctcctcgcttcatgttgcaatggggctaaactgccacatgtttccatgtccatgtcgctgcagttgctgtcggtgcagctatcagatgtcctcgtagtgtgatcgacggaaagttcaggtagaaactgccctctcttgtcgggtcgcctcttgtcatgtttaggatcttcatgtctcgcgattggctgaagaactttggacttctttttcgcctctgcagctgccttcgaaacttcctccgcgttaaggcgagctagtgtccagggactgattttcacaggtcctgatggttttcgtttggttacatcagcatgctttgccttcttgcttgaggagttctgtggcatttctgggggaatgacatgctgcagaaacagcataacaataagtgccaaaaataacccagaaaaaaaaatctatgaaacatggtcatcctgacacctgaattcagacttcagagcatgctagccactacaaatgagtacaatcaagtgtagaacagtagctacacaagaaaagttctaaaagataatacaaaccaaactctagaagtgagctatttctaactattctacaactaaatttcagacatccattttttttaagtagtagctgacaaatatctcaaacacaaactttcttctttttcccacaacaatcagaaaatgtgcatgatctgatattctgtatacctgatcttcaaggaataaacgtggcggagtacaccatgacccacgttgaagaggagcaaatgagctagttgtgctaaaccctgtcacagagctaataatagacatctgcgggctttgatgctcagtaacctcttgctgctcttcttgttctctcaaagctacaatataatcatacgtacttatgccctgcatacacgtggatagaaagtagaatacgtaaatcaactttaccataagagatagcttgaaaagctaagcatattatctcttccagaaaaagactataaacataattcggtaataacataagactaagcatgttcaacacgttatataatattatttccaagaattaacttcaagaaagagagagctattgtccttcctttccaacatataacttgttgtatcaaggtttagtataaatattatcttaatttcataagagttctattgacagtgaaggattgctttgctgtacaggccatattcctgcatttgtcatctacttagctctagaataagtaaacgactctttgcaaattccctgcactgtagttagcgatcatcaaaagttttgcgccagtgtttccttcttccagcaagggttttccacattaaattatgtgtttgtcgttcctaagaatctctgtacttgccttgatgtttttaacaattcacattttacaatttgatgtcagtctgtaggggccaatgtgtaactatgagtctgactgatatctgaacagacttgtcaaaatagtgaactgttattacttaacaggaggaagaaactcacttaagtttattaaaactattgcacactgcagagtagacagaaaaatgagtgtcactttaatttgttacagttatgatcttttcagataagagcgaaaagaggaaaattgagtgtcgttgcaaccaatatgaattagtatgttaagaaaacagggcaacaatcattaataacacttctatctatgctgtgttaaaactgatcttggtacatatcatctgcaggtaaagctattgcttactttcttaataagcagaacatggaagcagaaaagttgggcaaggggtattgttgcaagcattgctagtaaagtacatgtcatctgcaaaagtaatttgtgttagaaagaaataggatggattctcaatagtgctttataagcaacagtaattctacgctaaatatagcttcccattcacactttaatgttgtaaactagtaaagcaaaattcaaatttccaaaccagcaactatgccagactgtccattatatagcacacggttaatatgacattagacaacatcttttccatcatctcacataaccaattatccttttaattttttaccgagagtttaagttctagttcgaaacatccaatcaaaacagtgttgaccaaaatgtatccgttaggttctcacaccaaaataaaatgcacatttacagggttcatactgttcaagtcttaatacttatggtctttttcataaattctgagtattttgatactgcaactcaggaaacaaaagctatttaaaacattatatgagaatttttttttctcaaatagctgcaaattccagagaactaaccacaacaattacaaaagcagctgttgagaagctacttcctaactttgagatgatctgtccggagaactcccctcgcttcagtaaacagagtatcagcacaagaatgcccactaaccactgcattataagctgaatgtgcacaatcatggagagctgtcaatggtcaaccagaaaaagtggatatggaatagcagcactttctagatgtaaagcctacaggattgcagtttttatttattgattcttgagtgataaatttaaaggcacgaggaataatacaaaaataacagagtttctttttaggatactgtaaattgaataattcttaaattttagatgctcatcaaaggttgtagtggaggtttttacttaccaagagaacagctgaagccattagaatgaagaatcttttgtagtttctttttcctatgcaattattgagccactgtggacaaatcaaagcagaaggtatgctaagaataatatttcttaaagaaaaacataatttccaaaaaaaaacattaagagaaaaagagagaaaattaccctgcagtggtgatcaaaaccatcaacacacttgtcgcaaactctacaatgcttactatgctgcaacacctacacagtagtcatacatttttaaacagataaagtaaaactgtccagataagaacattttgatgcattagaaggtatcatccttttgttgaggcatgtgatttttgaacatattcacataattttttctgcagtattacagcacttttagattttattaagaagaaaatgtgttttccctgaatatatgtataataagccagattgcaagtgtttgtaaattatagctcctgtgtttctgatgttaacaacttaacatactagacaatggtctcatatctaaaattacatggcaggtcactgcataactgagtattttaagaggagaattttaatcctcatttttaactcaatgggttatagtttaaagagattctccagttttttcaaaaagtagatgtaaagttcagcataagcagacatcagcttgtaacatacctctacttcacataagctgcaaaagaacatgccttcttcgctcatgtgctgttccgaagattggtcatctgagtgaaagaatcttttccataagcagaagaatgggttgcatatcaagcaaagaactccatgtaacccaggccgagaagatgaatcattcccttcaaacatattgcttaatctctcactgttattaacaatgctacagccatcgctgaacgactttcctccctggcatgattcgtgctctgaaatttcttgtatttgctttccatccttgcctaattttggatgtttctttgctttaaaaatgcctggatcaccaggattagttgctgcacaccatatgtataatgtgacaacacaagtaatctgcaagaaaaacttatctgtcattcatcattttgttgacaatacaagagcacatcgatgtgctgttatatcaatgtgcagttactcttaagtatacagttacgaattgcaatgaaaatcatgttggttgaagatataaaatttatgttttgatgcatagtcatttgatcaaagtgaaagctacatcgttgatgatttcatggaatttttatatatcaagagcaaggcaaatggactgtatcgtaatttttaattaagctatttacccctgttacgattcagtggatttatccaatccttccagtgttgaatgtcttctctctattagttctacccatccgattacatcatataaaggattcgaatccttggtcctcatcacatcgtaaggattgaatgcttcagagaagaaaaaaaggtaattactctgtcttctaaaatagctttggcagaagcataggcatattagtggcatcaaagattttcaccatggcatgtcgtcagtcttgatttataaaaaactgacctatattagcctaaactactccgaagcacaaactactctgcagtttatccctgtctctatgtcatggaccttacataatgtagtatttctcctaaacattctccacatattataccgaccaaaacacagaagggagtagtgcaaaagaagtcaccccaaactgaaaggagatgcagatctatctgccatgaagaattaacacaacaggttagaaacacattaaagagggcaaagttgtttcagctactcaccagtggagtgtagagacccatgagcacatactggagctcactcctccccacaaatggcacaaagaacacatagaacgcaaaacccagtgccagaaaaaccgctatcgccaccacctgcatatgcacataccaatcagcaacaaaaacaagtatacaccagaaaaagataccaaacgaaaacaccaaaagaaataaacaagaactggacctgaagagggtggtaaggtagctgccacccatgcctcctcatcgccaagaacccctcccaaatcggggcccaagaaacggaaccaagaatcaatcaccaaagcagaaatgaatcaagaaaccataaggttttgttttgcccccttctccggctccgtggatcacaatgcgaacttggagcagccaagaactctggtgctcaggttgtttctttttttttctttttctattgaactgcctgcatttgatccctccctcccttgcagtaataactcaggtattaaatgcccataagaaaaggctgcatcagtgctcagcagcagcaagcacaccaaccatcgttcagagagagagagagagagagagagatgttgaatgaggcttgcgacttgcgagtagaatactagtatagccgtacagtctgtcgttggatttattattgggaggaatatataggggctaggtggagacgaggcaaaagtgaattgtgacaactttggctcgagggatttgtttttgttttttacacttcaatcttggaactttttacacttcaatcgatcgggtattttataatttgtgggttctgggtaaatgtcacccgaaataactaaaatggcattcataccacttcaagggtctgaaatgcagaaatttcgtgttaattgttgacaaaaacaattacatgtcagatacatcgagggtagaagcaatttcgttgttaaaaagaaaaaaaacacgctttaaaagaggcctaaaatatcccagtttattttttttttaagtttgtgagtattttttttcttttgaaactacacaggcacctaccgggtccttgtagaatcgtgacgtcaatggttagtaaggccatgtttagttcccacgtaaaacttgtacaccctattatatcgaacgtttaaagacttgcacgaagtattaaatataggctaaaaataactaattgcacatattgtgactaatttatgagacgaattttttaagcctaattgctgcatgatttgacaatgtggtattacagtaaacatttgctaatgacgaattaattaggcttaataaattcgtctcgcggtttactaacggattttgtaattagttgaacacccgatgtgacacgccaaaactttacacccctagatctaaacaccccctaacttttcattgataatttagtgaggctagagtagtgtattcaatgggtatacttgatatatgtatgtatgttcacctttcatataattcgaagttttaaacataccaaatatttctactattataaaaatttaaaatgttttcaccggaattttggtgcatcatgcgtgttttgagttgatttttagttggttatatatcgtttgtatccaatttgacgtgagtttaatataactattatacaacctatcccagcccaacccctctcccttctagcacaatccaaccgccccacgccatcctgcaaacttaccctgatcgatgtattttttttctctcttattttttttcctttttttatccaatatttatgataatctctctctccttccaatctcatatatttcctcctttttccctatttcctttttttatctttcaaatttctttcttgataaatatttttctcattgtttaagatgtttatgtgacaagtttattattttgcaaatgtttttcatataaaatatttttttactaattgaataattaaaatttcaatctttgatcgatgaggtataaccaaatgcgcatgcgccaacttatgaaatagtcacccgatcaatttgtgaggctatggaaaggtgtagataagagattcttcgtgtgatgagacatgaagcaagcacaaccgggatcaatgctatatatgatttctaacttttttttgctattattttgtttgtcttgttccggtttgtcatttaaattgatagagtttttatcgatcttgaaagttatcttcacctgttgtaaaacaccagtatttttttctagtataactaaaatatatttgaaagtcacttttcagtttattaggaataaggaaaaagatgtgctccttagccaaacataacattagtaaaagaaagtgtaattttcatattttccaaaaatattgaaagatacacactcgtttctttttttttagaactcacactcgtttcttcaaccgtgtaaccacgtcatatgggcacaaccacaagcagatacaacgattgatatgcacagccattacagatataaataatactaactggtccttttaagacatcactggtgatgacatgttagaagatgcgaggattttttaagtcgtcatctacgttacaaattaaatatcacaaaattacaaatttgtataaattgtagtactccctcctttccaaaatataataatttttggttggatacgacatttgttagtactgtctaaattcgtaatactaggatatatatgtcccatccaactaaaaattactatatattttaggacaaaggaagtagcagtcttactataaagacatttaagcactcctactaggacgttgccgcataaaccggtcgtgccacgaattacccacaaccatcgagccccacgaaaacgctatggccatcactgatcatcatccggagactgccacaagcccacaacaccgccagccgggagactcgaacgcctcgtgtaaactaatttggcgcacaaacataattcttttagcatttatagttacaaccaatcaaacctaaaacttgatatataaacatacaacatcattatccacaagtaacattatttatcaaaactcatacaaatatttgtaacatcatctacattttattaaaccctacaaatctatatattataagcatatccaatcatcatctctcataccattttcacaatatttgaacatatgtatctattactcttataatacataacattttattcacatattctacaacaaagcatgaggtgaggttcatttagtttgtctccgaattagtacaaacaaaaacctgatttgtcatcaattcttttccacttttcactttttgcgatacaaatcttcaccaacaatctaatatttcatctataatatcctatacggtctactaaatttatctctagttttatttgatgttaataactaatatatacatttcttactactatctagattgttataaaataaattaaaattactaatttcatatttaaaatgcgcgtagtatttatatttactcgtacatacgacgactgtaccggcgaccggattttgtaacgcagggatgtaaaaaaatatataaaagtactctctctctctctctcattgccatttgccactatgcctgccatagttgattcttttctgcccaccggcctcaaaagatgcaaggctctctccctgatctcttctctctctctggtgcatgatcgatcacatgagcggtcaaagaatgtgacattgactctccctcccccactttcctctctctctatataatctatctatcattcactgcaactacgtgttgtacgtagttagtttaataatcaaggttttgtcccctgttaaaattaatagatgagagagagggggatggatgaagagaggtttcctgtctaggtatcacgtcacatgctaccaatgctgcctttgacaattatctttagagaaccaaagcatttggtttctgcaccaaaaacagacactcacggggctagccggccgataagttacttgacttaaaacaagttaattggtagaaaatccaggataaattaataggtatcaaacaatgctagaaaaatgattttagtagacgatatgccctctactttgtaggtgagtcactttttcttttgcacca

SEQ ID NO: 69374 - DNA, 12350 bp, Oryza sativa
caaatattgtattatcctaggcggatgtcttaaagctacacctgtgaagttatattttcgtagacggcaccttatgctgtctgctctatataattcacacaaagttggtctctccaataacaagcaaaatatagggggaggttttgaactcaaaattttcggtggatttttcttcagtggttagatccatacatttcctctcttatgattttcttttatttttgtaggtattaattgtgatggatctatgcatgaaaaatagtgaaagcaccatgtgcaattttttttcttttatgcttttctatgctatgattgtgatggatctatgtatacaccttgatgccatgttgttctatcattcccttgtggttaaatgtgatgctttcattattaaaattatatgtataatattgcccacttcccaatcacctagatctagataggagagagagagagaatatgtattttccccactcaccacatagtagaaaaactatatctatgttatatttatagatcaccatcccctaattatttatatttttcattcccatagtaagcaaagttaagtttgtttataaatatgtaattttttcagaaaatttagtttttttaatataattgtaaacacaatatttttagagatatggacagaaaatggccatgaaatataattgatacatggatttttgaagggctacatgaaatggatccatcatggcgagcgacaagtggatcctgatgacaaagaagatcggctggatgtcaatcacacatggaggatgctgatggtgatagttgtggtgataatatcattgagttagaggaaatgctacattgtgtagaacctgaggtgctaatggggtcagctaggggtttagacaattttgaagctttacagaaggcaacgaaggatcttgtgtacgatgagccaaagagttgtgacagggagttctcaacattatgatcagtgcttgaacttataaggttgaaggccatatatggttggtctgatagtagtttcaataacttactacattgaaaatgatgctaccaaagcctaactcattaccttccaacacatgtcaagcgaaaaaattcatctatcccttttctcttggtctagaaaagattcatgcgtgtgtgaatcactacatcctatacatgaaagagtacacttcgttggataaatgcccattatgcagtgctagccggtagaaatcaactaacaacactaccctagatgttgattttttttaataaaagaagaggctgactcattcgaggaaaacaaggaaaaaccccctagctggtgatgtggtacctttctatgaaagatcacattaagcgtttgtactcaaacacccgagatgcagaactaatgagttggtattaagaagggcacaagaaagataggatgctccgacacccaatggatgctcgtcattggaaaaacataggtgcactgaacctataatttgctaaaaacccacgaaatattagatttgcactgagtattgatggagtgaacccttaaagagacatgagcagctcacatagcactttgccagttcttctgaccatatacatcttcatacctgctttgttataagtgaaagtacgttctactatgtgtcctaatacaaggcccccggtagcctggtattgatattgatgtattttttgaaccattgatggaagatatagaacatcaggtgatttgtctccatgaaagtttatttgatatccggttataattcacacgaatggcatgtcatgctcatcgtgtttctcgctattcctataacactactacaaaatatcaaataggtgtcaccactataggtgccagaagtgctaaaaccggcacctataagccttttcccacctccacgggttgaaattgcaaaaaaccggcacctttaagcagttataggtgtcggttctaaataaaaaccggcacctattctatatgtgtcggtttttaataaaaaccagcacctacgaattgagccgagccagtgggagccaaggcggtgggccccaccacgacgcggggaggagataagtccgctgctgagtcgcgcgaggagataaggctcgctcggctctcgttctgtctgctctctcttgttctttctcgtctcctctcgatctttctcgttctctcgccagtcgccactctatctctttcgccggcccggcggagcaacggaggcaacggccctgtggcgcgccctcccctccgccagatctggccggaggggaggcagtggcgagtgggggcggcgtcagcgggcggtggcggggagcggggccatggggaggcggaggttgcgtcggaggcggaggcggaggcggccgcgccctcccctctgccagatccggccggaggggaactctggtgtgggggaaaagagagcaagactgagtactacccactgtattcagcaaatcatgccagaagaggaggtatgatgcaggatatatccaagggaggctaaaggttcttttgcataaagctagcatttaaaagcaatagttgaaagcagtaaaacagcggtagtaattaatccatattaaccaatcactgctcaacgcttcaccacgttgagacaggcccaaaccaccacctgaactaaccagttccattagctaactaggggtgagactaatcacggtgaatctggtcgaccgcccataaccgcgggtacggctattcgaatagttttactctgatcagaggtgtacaactgtacccacaagacacagccccacaacacatttccgtgcgccgacatgccaccacgacataccggaaagaggccgtgacaggacccttcgcataaccccctctaaccgatcgcaccacacctcagggttcacccccgtccccagcaggcaacgggcagcccccctctcgtgccgcagtgaatccggaagccgatcaaccgaacaccccggccgacccaactccatcacgcctaccctcacctgggtacgtcggctagaggaaagctacactacaagcccagccgttgcccacactggcttgtggtaagcacgataaattcttccagggtttcccgcgaatcggtccttaatcgccatgggcacaactagcaaaactatgcacccacagcccaccatgtagtgtattttaattaactaacaccattacggtggctctattccaaagctatgccagtaatcaaagtctatgccttaaggtaattccccctctgtgtactagctgaactaagcatggctaagcattccctaaaccaacatctaatcattttaatacccaagttatcaatggcataaggtaaacaagatatggctgagtagtaggacccatcccacatgatattgtaaaacaatgcaacatttaatagaaatgtgggacatttgtaaattgggtacaatatgatcaatcgtaatgcatgacttgccttgctctcgcactaatgagaccacagcaacgtcttcgagaaaccgcggatcgacgaaacggccaaaatctacgcgacaaacaaagcacacaagcaaaacatgctgtaagtctactgaaacagagaacaaaactatttttaatggattctatgcatttttatgaatttactgagacttgaatggacttaaacagagctcggatgaattagatatgaattttagaagattaaatgtgtttttactataaaagaaaatgccttaatggattttattgcgcaataaaggtccctgctgacatcatcaaggggggttggcgccgacagatgggccccacttgtcatagactcaagggcgccggtctactgtggaccgagtccacgggaccgcggagaggagcaccacgtggcgcacacgtggtgccgacgtggcggccacgtggacggccacgcgggcggcagccgaacggccccgatctaccgagcggtagatcagacggctgtagcggctcgcggctgggcagtgcacgggtggctcaagccggcccgggcatggcgtgcggcggcacggcacggacaccggcggctcgcggcggcgcaagacggtgagcggcgaggagtggcggtatgcggcgacgcggcggcgcgacaaagagagagagagggagaggaagggagggagaccgatcctcaccgaggggctcggccggcgcgggggaggagcgacggtgaacggcgacgacgagcgacgggagaacgatggcgacgggcggacgagctccgggaccacctagggaacaaaatgggagggattagagggagaagggtggtccacggcgagcggatttgccagccgaagatggcggcaatggtggtgctcaccggagcgcgaggagaacggagctacggcgacgatttgtgtcaaccgagtgttggacggggtagccctcgcaacggcgaagctagtggcggtggttgcgcggcgtggcgacgacactagcagtggcggcaggcggccggagagtggcggcgacggcggcgctaggggagagcggcgcggcggtgatagagggctcaagagagtgcggcgacgaaaggaaaaagagagagggaggtgcggcggtgcttaaataggagtgagggaggcgagtcgtggccgggagggggccctattgcgccggcgaaatggggaaggtggaggagaagagagagtggggttggggatttcaaatcccccgccatttgcgggcgtgcgggcttgcggaaggcgtgggaaaggtgggcggcgctgtgggtgcggagcacgggcggagtggggcacggaaaggcgggaaggccacggcgtggtcggcggttgcctgcttggcccggccgcgtgggcggctgggggtggaagaaggggctgacaggtgggccccacctgtcggtgaccttgagaggggaggaaggcggctcggactgggccatggccacgggccggcccaagaagaaggggggggggggcgcgcgcgcgggaggagagttgggccgacggcccaacaaaggaaaaaggaagaaaaagagagaaaaggaaaaggggaattttccagggatccaaatatttggttaaaattatttctaaggctctgaaaattccactaaaaaatcctgttagcatattttgacatgtagaatctaagaaaaattccacatgtcgattccgattattatttgcatttattaattaaggaattagctctaggttaaattaaactaatttcttcggacgatttatttaacaaattttaaagcaaggaggggaacttcagagcgtgacatgctgtatctttttattgttaaccaaatacttgttgacacattgttcccatattttttttaaagtttaaaatgtcacgtagatgtcatgtcagttgaaactaccgttcaaaccattttaaaatcttatcttcattgatttttaggagttgagggcggttcaggatgaatttcaacgataaattgagggaagcgagtacgcagcaacggcctcgcccaaggcctctgagcggcttggactgggctgtgtctaggccggcccggcacgaacagcccaaatgtgccattccgccgtgctcggcccgcacccctcactccgagtctctgacaagatagctcgatgggccttgggacagcccgttttgtcaagatgcacgatgggccttggtacggcacgaagtacagatcaatgcaaaggggaaaaagtacaccgaaggtccctcaacttgtcatcgagttacaaaatcgtcccctaaccgcaaaaccacatgccggacgtccctcaactaacaaaaccgttcactttaatcctccagtggttttggccctagttttatcttacgtgacggctgagtcagcgtgggacccacgtgggctccacatgtcagcattgccacatcagtcttctctctcttttcctctcttctctcccatcctcatctctctccgttctctccgattgcgacaggcgacacggcgcgtcggtgaccggctgccggcgaccagccacgcggcgaaacggcggcgggggaaggggcggtgcgcgaccggccggtgaaggcgcggcgcgcgggcggtcgggggcggagcggcgacgcggcggcggggaaaggggcggtcggtgtactttttccatgcaaaggaatcgccatttcatttgcttcacgttgcatacgcatcagaaatttcttctaacttcaaagtaagaaatagcgtgacattcttcatctagctaatgacgatttcgcgagattgtactgaactactgatcgcctgatctggaggctggagcttaacttccaatactaaaaggctatgttcagaacaattatctactcctacagtcctacgtgacagcttgctaacggtatgtgacaccggcaaaaatgctcatgtacttctggttggatgagatattgtaagaaattcttatatttgaatgagaaaggtaatcgatctataatctcttctacaccccatggaaacctttgctgttggatgcatgcatgctcaatgcgtctttcctttcttgctgccatgtaatgtacagtgatgccgtgttaatcataccacacatttctgactttaaacattaaatagttaatgttcaaacatttcatacgattgatttaaaatatcgtctaccattcacttatacaaataacgtaccaagtcttgtattaccgccacttacactgaacaaagataaaattcctcgaatttagattcgcatacctcctttatgccactcaattctttcactacctcattcattctcattctctgacttgcagagtccctgcaacacgctaaaccaattcttgaaataggagcaataaaccaatctacaatatcttgagaatttccgtcctgtggtattgcgttgtccataatttccaacaaattatcaggataggccatctcaacatactttggaagactcatatcatcatgaaacattgtgtcagttggtcttctaccagtaagcatttccagcagtagaacaccgtagctgtatatgtcaccttctctagaaatttctgtccccatgccatattcttcagaccaaaaaaaaaaaaaagggagaggattaaatcagttttgtaatggaccgaatgctacaaatcaattattggtgcactttcagactaaacgaaagataactatctatgaactgagtttaccagttcagaactgtagaggtaaaaatacctaaaataactggtgcaaacaaaacggagcaggaacagaaattaagacagtagaattcgaattacatcctgtagttacatacctggtgctaagtacccaatagtgcctttaattccaactgagctactctcacccaagcattggccttctgcttctgcactcattattcttgctaaactgaagtcaccaatatgtgcagtcatatccttatcaagaagaacattacttggtttaatatcgcagtgagcaatggaaggactaatgtgatggtgaagatactccagtgcctctgcaacatcaagagcaatgtttaatctttgcatcaagcttagcttcccaggtatgtaggaagtattttctgtgcttggatgtagccatgtgtcaaggtttccattggagataaactctaatacaagtgccttaaattcatcaccattgttgtccaagctatcacaaacagtgataatcctgactaggttccgatgtcgaatccgttttagggcattgcactcggacatgaagctcctggctgctctggtctgatggagatcaagaaccttcactgctacagtgattacatttgaaccacaagttaagtttcctctatatacactaccaaagcttccacggccgatcaaattttccgcagagaatgaacccgttgcgacatttaactcattatacgatatcctctgatacatctcatcgataaatttgctaccttgatcttgattaactttggatgacttttcccttagcctcttgatgcagtagcatgtagcaatgcaaacaataacaaagacgaatgctcccacaatcagaaagatcaagatatgcaccaccgaacgatgcgcaggcttatcggaagattgaaatgggcatggcgggaaatgaaagaacatagggcctccacatagcatatcattacttacaagtgatacagcacttgcattagagaatatccccttatctggcaccataccagataggttattgaatgaaaggttcagattcttcagaagctggaagctctcaaggaattcagggatgggtcctgaaaatttgttgttagagagatccaacacttctaagcccctaagtttattgagctcttttgggattagtccgtggaggagatttgcttgcaagtataaaaattgcaatgcaaggcaattaccaagggtgcttgggatctgaccagacaatttatttgatgagagatcaattatgccaacattgaccaagttcccaatatacggagaaatggggccacttaatgcattgttcgagagattaagtgcttcagtcagggaagaaattctgataatctcttctgggatttgcccactcaaaagattacttgaaaggtccatagaagttaacttgcttaggttgccaatagttgctggaattctaccctcaagatagttaccagacagaagaagctgatttagttgtgtcatgttgcctatggatgatggaatctctccctggaatccatttgaaaacagaagcaactcatggagattagtgagctttccaatatctgaaggtatagtgccattgaaaaggttatctgcaaactcaaggcttgtgagtttggcatacctccctattcctttaggtaaaatcccagaaatttgatttcctcccaatctaatgctctggagctctagtgagagattagcaattgtatttggcaaaatgcctgacaggttattcagttgaagattgatgtagattagattgctgcagttagccaaggatgttaaaaattcccaatccctcggctctgtagcttgaagctcattgttacccacttcaaatactgttaattggccattgataccactatttggtggaattcggcctcggaatctatttctgtggaggatgaatttttcaaggacagagatgtttgaaaaggaggctggaatttgtccttcaagtctattgtagaaggcaataaaataccttagattgggaagtgtaaggccaatatctgtaggcagagaacctgatatgatgttggacccaagattaaacaccttaagggaggacaaattaaacaatgatgcaggaatctcaccttctaatccgtttccagatatagtcaaagcttcaaggtttgtaagctgagatatagcctcaggaacactgcccctcatcatattacccgcaatgttaaaactttctagcgcggtcaaattgcccagccatgatgggatttgtccatgaacatagttatcagcaatactgaacatggtgagggcagtaagatttgcaaatgtagatggtacataacccgagatattgttatggcgaatattcagaacctcaagctttgacagctgaccaatggatggagggatcacaccagacaagaaattgacactcaagttgagcctctgcagtgccaagcatcttgcaaggctaggagggatctcaccttcaagcttgttgtctgacagatcgagctctcggagtccggtgaggttgccaacaagaggtgagatggtgccaacgaggccaagaccctgcacgcgcaaagagacgacacgacgatggcgcgcaccactggagcacgtcacgcctctccatgagcagaagccattggtgccatcagaggtgccattgctgacaacactccaggaagacagtgcatccgaatgatcctttgctatgtgggatctgaatgataggagagcgtggaggtcatcaccggcgtcgatggagcgggaagccggggcgagaaagaggaagatgacagtggagggaagagcaagcagctggaggagcaaacgtgtgatcgccatggatgtgatgggcaaagagaactaaaaaaggacgtggagattttgttgtggtggaggccatgcagtcttgaacgatcagttacttctagtttaacttttgcaatggaattttcatctcatcgatgactagtcagtggtcagcaattgctgctagtaccctctatatgcaacgccacgttgcaaactacttcctataatatactgatagcatagaaagatcgttgctgtgcatccatttttctttgacatctctgcaatgcaaccaacacatggatacctggtagcgtaaagaagtcgctgctgtgctgacaacctcgagaaacatctgagaataaaaaatattatcccaatctgatgcccatgctgaccaaatgtcacaaatttcttcccctgtttataccgggttgactctgcatctgagaagccttcctccatattcccattatcccaccaagaagcaaattagtatcagtaagtaggtgggtaaaaggcattgatgaaataaatttttttatttgcgaaccaagagcagataagaaagtagaagataatttatttttgggacaaagtttgaatttcagaaaatgatttattttgggatagagggagtacgcatcaaggacccaatagcatctctagccgatgctccatctgatcctccatctaagaaatagcggacggaagtaaaaaaataacctcgggtggatacgccatcggctacgcaaaaaatagcgcattcactaaataggtgaaaggaatgccaaatgacaagcaccttccagcaaaaatataataaaatataggatgatataatatggacgatataaaatagatgatttattggagtgaaaagaagtacagaagagaatattttttagacgaccatccaaatgggaatatggaggatgaaatttggatgagctcatgggatgctctaaggtcccagatatttgtactgagaaagtgaggattaaggccaagtttggatagtttatcataaattactaaaacccttctactctgaatcgattccgtgtgggaagagataagtagtagttttccattttacaagattgcatttcaaaattcaaaatattttgctcccagaaatttaagggaaagagctcaggctgaaatttgtttgaattttaaagggttcaaacctaattgtataaattcaggaaaaaactatattaattcaagataaacaatctagtttttgaataaattaaaacatctctaaactttatttttgtgcacatttaacacttttcgcaacaaaccgattaaagtgtggttttggttcgatttgatgcagcatgtatactcgaagtatagaaaaaaaatcatacactctaccttgagaaaaaaaacacactagggcggacagcttctccgcttctatgtcgtcgtccggcaatttatcggtgctgagaaaatctgtaagtggtgaacaccaatcttgcgcaatttcaatgtccgccacgatactgtttgacttgcactgtagcccccgaggcccgagcctacatcggtgatgttgtcagtgttgtgttttggagtacccttgacggaaggtttgattaatccttcaaagaacgtgaccagttccaccggttcttgtctggaagtgcgtcgggcaaggttgttggcatcaacattgtgcttgcgatggacatggcgcacttcgaaaccgtcaaacctttgctccaactttctgacttctacaaggtatttggatgactcggggttgaaacatatgtagtccttatgcacatggttgccaactaattctgaatcccctttcagaatgagtcgtttgctgccaagtgatacgactactcttaacccgacaagtagtccttcgtactcggtagtgttgtttgtggcccgaaaatcaagttatattgcatgtcaaaactgatctccttttagagatgtaaggataaatccaacgcctgctccttggatgctgaatgctccattgaaggccattgttgatcgctcgttgttcgtatgcccaactttgccgtcctcggcaacagtccagttggcaacgaaatcggagagtacttgagacttgatggttgttcgtggtatgaagtggacatcaaattgcccaagcttggtgacccatttaggatgtgtcctgcgacctgaaagaaatggcacacctttcgggatgtcatgaccatggcatagagcagcttatgatcgtagataatccgtaaacatatggaataccgttgtaggacgacggcgcgacgacgacggacgagctcgaaggtgaccccgacaggtggggtccacctgtcggtggctggggaggggaggg

SEQ ID NO: 69375 - DNA, 25469 bp, Oryza sativa
ccctcaagaatcggagcaaatggttgagtatcttgcccgaatcgaactcgttttcgagtttatctctaaaaccgagtttttgattttccgagtcgatttcttgcgggaggagtccgatctcttcaatccaaggctttaaataggaccccctagtcctcccctttcgtttgccccctctcccgtcctctcccgtgacccgtagagccgtcgccgcgtgaaaccatccgccgccgccgccggccgaactccggttgcgccgccacgccgcctccgccgtcgccgtcgcttgccgtcgccgccattggttttgccaagaggtggagaagctcggccgccacctctccttcgccgccggccgccgtagcccgtccccaccggccaacccgagccgccgccgtcgtctcctcgtcgccggccgtcgtcggtcgtcgtttggcacgagggtgagtatcgttgggttcgtctcgtcgtcctctacgtgtagatgtcctccaaaatcccggccgaccaccctagctccggcgaggtcgccatccgagccggccgcctttgatgacgtcatcatgacatcatcggtttttctttttcccgtttttctaatagattaaatcttctgaaaatcataactaaataaccgtagatccgtttcaggtggttcaagttgctaaatttttctaaaatcaagatctacatgttaaaaatatccacatgtactgtttatgcttgtttttgtactgttttgttaatttttgtttaattgctttagtttccgacgttccggaggagagcgtttccgttgaggaaggttctgaagcgtttgcggaagcccaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttattttcctatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctagttaaggtgggttgtgagcatatggttttgatggttgtgctcatgacaattaaggaccggttcgcgagctactgttgtgaaacatttaccgtgccaaccacaagccagcatgggcaacggctttaccttttgtatagcagggttcattatagtgtgccagactgtgaagcggcgagaagtccgtgggggtcgctggggagtccatgccttgtttataagggggtgactatgatccgggaacggtgcactgttttgagttgtgttgtgcaaagagtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttaattcctggtttggaggtttgatctgtacgaccggggttggttgttcaggtttggttgggcctgagcagcatgggtgtgctgttcagtgttgattaaaattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcatcacacctcagttgaagataaaggatccagaaggagaagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacaactaaggacttgtgtttcctggctctaggctggggattaggaatgtccacccgagaattaacagaagctgaaaaggggagagccctagccactgtctaaccatacctggtgactttctgagcaaaagattatctaacctacactctctgctttctaactgcaatgagatcctgttgctactcgacaaattggtagagcaaagacctcttgccttgtaggaatggaacttcagactgattttaaaggagcacattctaagcctgttcaaatacaaaaatgaattctggaaaaaagtttgtacgattagatgggcaaatttggagatgagaacaccaaattttttcaggcctctactccagacagtcacagaaggaataaaatctcacatttaaaacttgaggataaaagacagaaagaggggtgtcctcccatgaggaaaaggctcatgctttatacacaacttataaaaatagaatggggattgatggtcactcagacatggttctcactctagcaaacctatttcaaccagtagatatcttacattttcaaagttcaatgccatcaaaagaggaaatggacaatatcataaaaaatatgcccacagatagaggccctgggccgcatggttttaatgggatgtttcttactaaatgttggcccatcatctgtaatgacttctatgagattgcttctcaattcttcaccaagatcatggccaatagaattcaatcaattatacatgagctcatccatgaaaatcgcttcatcagaaacagaactatacaagactgtcttgtttggagctttgaatatgttcatcagtgccacctaagcaaaaatgaattagccattctaaaagttgacttttaaaaagcttttgatctagtagaacatgaggcaatccttcagattcttcaggccaatggttttgatcaagcttggatcgcctagactaaaaatgtcctgtcatctgcaaccacttttgtgttgttaaatggagttctaggtaaagatttcaaatgcaagagaggcgttcggcaaggtgatcctttatcaccacttcttttgttctagcagcggatcttctccaatctattatcaacaggccttatgagatggggctattatcatttccaatccctcaagacagagggaagtttccaattattcaatatgtagatgacacccttcttatcatgaaggctgattagagagagttattttgccacagaactctgatgaacacctataccctgtgcactgggttgaaaattaattatcacaaatcttgcatgattcccattagtactaatgtagaaaatgatacaagttctggttggtacatttggttgcatggtgggaactatgccttttacctacttaggtttgccaatgggaaccactgaacctaaaatcattaatttttgcccctttgattgaatgagttgaaagaagattgctctccatcacaactttcctaaatcatggacaaaggttaacaatggtcaactttgtgttatcttctctacccacatattacatgtctgctcttaaactaccgaaaaaggtcacacaacacattaattgtgcaagaggggggggggggggggcttggagtcatcaatctgtaattgcctgggacctagtttgtaaaccaaacaaagggtggggggcttggagttatcaatttgtaattccaaaacattccttgcttctcaaacacttaagttttttttaacaagaaggaccttcctttggtacatttaatttggaacaaatattattagcactctgatctccctccacatgcacacagagaaaaaaaggttcattccggtggagagatattttcaagctaattcccttgttcagagcattcactaaagtgacaattggcataggggactctactatgttgtggaaagataattggaatgacaatctcttggaattagaatatccaatagttttctccaatacaaggttagaagatatttctgtccaagcctttttgtcccttactgaatttgaatagtacttccacacacccttatctgttcaagctatgcaacaattgaaagcccttcagaatgtgttactcaccataggtacaaccagtgaacatgacaaatggatatatcactggaattcagaacaataccagtcaaataggttatatgaaatgttttttgagcactttcaagtggatatcccaatctccatgatatggaaaagcaaatgcacaatgaagttaaaagtatttctctagctactgccgatggatagactcaatacaaaagatacgcttcaaagaaaaaatttcaacacataaggaggaaccagatgtgttatgtgtaattaagtagtatctgaagacatgcttcatctcttctaagacatgcttcatctcttctattcgtgcacttttgcacaacaatactggcagtacattggaatacagtggaatgtgagaatggtgttcataaatatgataaccacagccaacaacctttttggacaaccttttttcattgaagttctagcgttgggatgttggaccatttggagtagaagaaacaatctcatcttgaagagggattttggaaagtggaaggatgatttcaagagggattttgttctgtatatgcacagggcgaaagaaattgacaaacccaagtggtaatcatggattaacaactttgtatagccttttctttgtatttttcctctgctttgtaattatctgtaaatattctctatttatatgaatatgatttaatatagatatagtgcagttggagcctctccttctgtttcttattaaaaaaaggtgactttgctagatcttgaagttatgcgatataaaggtgtctgtatataactctctctgcaaacatagaggataattttcatttacccctttctcattaagcttttcaagagctgaactctttgtcaactttgaatgatgtgaccctgtctcaagagaatgatatctgggctatttggggaattctgaagtattcctcttagaaattttatgctctcaattttagagctttacagccaccatcacattttctttggttatggaagagtaaagcaacttcaaaagttaaagtcttggggtggttgttactgatgaacagattgaatacaaagtaaatgttggaccatagatattgtgctccacctgattgtgacttaagttgtgtgctttgttcagttaactctatggaggatctgtttcatctcttctttcaatgctcttttgcacagagttgttggaatgctcttggtttttcttgggatacttcactgagcatggatagtatgatgattcaggcaaaatctctctatcagggacaatgctttatggaaaattttttgtatggtgcatggaatatctagaagcagaggaaaggcttcatttttgaaaaaaaaaactccttcctgtctttctggagacaactcttaaagggtgacctcctccttttgttgtttagaataagtgatagagataaggatgtaatcttaaattggattagtttgttgtaatttttctctttcttcctttcattaataaagttctttaacagcgggggcctcccctgatgtgtttcttttaaaaaaatgctagtagttaaattgtgtacgtatatatactaacttggcgcctcacttgcagtaaaaaaaattaccaacattccgccacataacttcgaagaaattagagaggaactagctgccttcatacttgtggaaatcgtatctccaaaaggaagctttagattaaagtagctcgtccaaaattcgttgaacatttttcagtgcttgcaaaaaaaatgtgactatgcaatatttatgtatatattatatgcaataaaatctctgatgtaaatgtatacatttgcaatatgctaattacacactttgtttccaaatataactcggttttgcaggttttattgcttaactcttgaagatgcatatcggtgatttggtgattgtgaatatggatggatgtgtgaatggggtctctaggaatgagaacgtatgtgtgtgtgtgtgtgtatatatatatatatatatatatatatatatatatatatatatatatatatgtatgtatatatatatatatgtatgtatgtatgtatgtatgtatgtatgtatgtatgtatgtatgtatgtatgtttctgttattttgcagcgggcatggctagcaaaggcctgaggctgtaaataatatttttttttgtgtaaattactcatcggtgatgggtaagaaaaaatcaccgatgccgatgcgtatcaaagacgtcgggtctaacatagaggctgccactgataagtcatttgtgacggtctccaaaacataccgacaaaggtgagctagtcatctttgttggtttatattaggggccggtcacggatgattcatcggtgatagggtctagtttgactcctctgttggatcaaacctattggtgacggggtttaatattttcctgacaaagataaaagtcatcggtgatggcaaccggcccaacaaagatgacttttcacatcactaaccattagttcatgacggagcatctcgccaacacagatgacggtttctgtctgacatggatgacctgctccaattgtattttcttcaaaaacttaatatatgtgaaacaaactataataactttctttgtggatggagggagtatacgcttctgatgaatcaaactcattttacatatattatgcatttgcaccgtactttaatatacgaggactaaaattgtctttagtttcgagcactaaaacatatacaaattatacatttgtttatattatttgggcggcacacacaacatatatagcaaagtgaagaaattacatcaaagcatcgagcattcactttatgcatctgaaacatatatgctcatgaacattatttattttgtaggggctaaaagtaactgaaccaagtacatcagtcctttgggaaaagttggatatgaaaaccttcgagaaatcgtaggccgggagaaagcaccattcttcctcctttgatcgctttccaactgacaagtgtagacagaaggtcatttttttttttgcagggtacttcagcatccatgtatatatagagaataacttatcttcttaagtatactcattacatgcagaacaaaatgtgtgagaaatcagtgtatacatgttttaatacagatgaaaataatctcgaagctcctagatggattctgaactaggtatacctttgcaacagtaggcttcaatacacttaagtagggtgtgtttagttcacaccaaaattagaaatttggttgaaattggaatgatgtgacggaaaagttggaagtttatgtgtagaaaagttttgatgtgatagaaaagttagaagtttaaagaaaaagttgggaactaaaccaggcctagatagaaacaaatgggagtgcagatttaagcagtggacgaagactgccatctgcagcttggcaaaatgtgcaccaacacacaaacgcagtccccctccaaagggcatgaaatccttggaggcaccaccagcaggttcagcaatatcctgtacagagcaacatggatgcaacaaatcagaactttggagacacaattctacatagctctcgcacttcagaattgctcaatagtggcttttagtaggacctagaagaaacgtaccctatacacaaggctaggtgtgcacacaccttacaccactaacatattttataaaaaaatgaaaaaattgtacatgttatttttagtagtattaaattaataatgtgtcccatctttgaaatttatcatacacagggggcaataaataaaaagacaaaattctaacagatatatacccttaaaactgttatagcttttaactttttgttagggctaaaatacaacgaatttaagattatgactttacacataggtgtaatacaactgaaagtatatgtacatattttctatatttttttggtaatatttattagtcatatgtatggtatgtgcacgtgaagcttatgtgcaaaatatgttcacaaaccttccatctcaagggattgaatgtattgggtcctcatagaccacggggtttaggtgaacagtagaaggacaaatcataatttttgattcttttggaatagcaaaacctgcacaaattatacaaatatatttaagaagaaacattgtaaaatattcttttacaaattttctactattccctatatgtccatattataatatgatattcggattttttcctagctaagtcaaatttcttcaagttaaccaacttcataaaaaaatgtggcagcatttccaagacaaaacaaatatattataaatatattttcagtgctttatttaataaataaatccaatgtgttatgtttttcaataaacctgtcaaacttcttataatataatgtggaacagacaggatatatacatcttttacatcgcgttgtactacatgtgaaaagcaacggctacaacaaaaataccttgtagagacatttctctaatactataaagatgttctagtgaattatctctatataaatgaagaggcactttacaaaatgtttgtatgctcttggacacttttacagaggcattttttttttgtctataagagagtataggcattttcggaaggcattaactctgccacaaccatagtaaaccaatgtaaaaatttaaaaaaaaatataacttcccttgcaattgtccatccttgaactctagacctcttgaatatttcattttctacttgaatgttttaaccatatcaacctcatgttattacttgtacatatgtgcttcgtgtttcttttattgagttaattagctgagattaaaattccagtaagtgccccaatggagattgaaatgtcttaaaaaaatgcctttatatatcaagcaaattttaaagtgcggtaaaagtgcctctacaaggtaaatttaacaaattgtgctaaaagtgtctctagattaaaagtttttaggcaatatttaacgtgcctctaacactgtctctacactttataactcttgattttaaagccattttaaaaattacctctacaagaatgcaactacatgagatttttgttgtagcgtgtttttaccttttatatgaacatcctctatggcttctctaaacatcatcggagtaatgctagcaagcctcaaagcttcgtgtataacctacaaataattaagtagatgagtgagcgtatatattgtgagaggatttgacattaaccatatacatatacatgtgtaaattgttaattttttatatgtagaaagttaaagaaattgaaggaatatacgtgagatgtaaatttcatagacttgtattcctcccatgtgatttcggagttcagatcggcccttcttctccgtatgttattgtgctcctcctaaaaagaccagatatcatttacagcaaaatgtatcctggattatttggaaatatatagcatttccacagtaacttttacggggaagtatgcattcatataaaaaaaaaatcaaactttacattgctagtatagttcttatgtacgttgctgttctaattaaataggttttatgtattagttgtcacatatatgagggcgcaatcctaagcatgtagtagtgaagaaatttaaacattcctattattgtattacttgtatgaatttgtgaaaggaattcatatgacttgtactagcacttactgtcagttctcgcaaggcctcaggattatctgtcaaaaatttgagcatcccagttattccggatgatgtggtgtcgaagctgccaaacagaagcgaaaagagcaagttcaatgctgtattctcggtcattgaaggattatcctccttaacttcctctatcaggacatcaaggaagtcaatgctttcatggcgtccttctatcttcttcctctcattgagtatttctttcaacatcttcatgacattctttcgcccctgcatgataaatccagtccatgatgaacggggccatttttatttattttaatttacatgatgacggttagttataataaaaaagtagtaatacaatgttgctgactactgaatcacaaacttgttatatatataggttaatttctttgtatcaaactacataactaattattttaaaaaaacattgtaaagtacatccatgacagattataatgacgcctggaggtattcatcataaaaatctttcacggtgaaaaatatgtcaatcacaaacattagggatttttttcattataagatgcagctatcacactatgacaaagtatttcatcatagaacttggtaggcagggtaattatagaaccacagtaaattggtcccgtttgtaagtatcagtttgcattaaaaggttcatcctaaacgaggcataattcatcataaagagtcaggttggcatacagtaatgaagtattttcgtcatggtactaacaatagttgccaggaggtcataatataagtgtgagaaaatgtaaaggagatagtttatcctgtgcaaacatgtattgtgtgcattgttgaacgattgttttccaaatcagtgtgcgtacgtttggtagagctccaactcctaaatttaactccaagatcggagttgggtctggagtgcagttgtggagctgcccaaacccagctccacctctctagtttattttgtgagagagctccacccagctccactcacatttttggtggagctgaaattgtttgacggggctttagctctagaaaagatggagctggagttgaagctgtgtcaaacagacccgtatatcttgattttggacagtccacatgcaatactcggactggtgaccgcatcctatattgtggtgtagccatgttatgtcaacacgtatcaacaaactgtctatctccctatcctggtcaatggtggaagtcgatgagaatgcaggaggctacattgatcacgattggttgtctgaaatcatgttgcaagaaaaggcggcagatcattggaataggccgcatgatgggcctccacattatggatatcccatatctacacggcgatggtatttggactgaatacaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattacttcttgaataagaaggcctgaacctgtataaatcttttgtctccaaacccatacacttttccagcttgatagccaccccttttattattgccgaaatctagtttcgacagttggcgcgccaggtaggggttgcgtcaagcttttcgctgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatctcagtcccgtttggactcccaaacgcggctgaaagttacttcaagaccatctcaatcgagttggcttcaaaccactcgggtgagatcgcatcttctccaacgtcaccaggtcaagatgatggggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcatggtttcgacggatcagctggatggctactacagctctcccaccgtcgactcgcgccccaccgacatcgtggagtacgacgagtttagctctcgctacaacgacccggatctcgacgacttcgacgggagcctagatgacaactacacccctctctacttcggcgtcttcatggccgataacgagacggaggagcaacgccaagcccgggagaccgaagcacgtcgcgagactgagcgtcgccgactggaggaggagcgtcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcaacagaatgtggttgccgcgatcaccctcctcgacaccctcctcaaggaaaacgagctcaatcaatctgatcacgtcatcaacatcttgaaccagacgaagaccatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggtcacgacgagcggtccgttcactcacctcccgatcatcatagggagcgccgagtggaacggcctcgctcaccacctcgtcgccgccccgtcgatcttcgcgacacaatcatacagtgccgagcagctcgaggccatcatcattcaccggaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatgggttgccccgtggtacaattgaatcttgggccgaattacgcgaccacttcatcgccaacttccaaggcaccttcgagcgtcccggcacacaatacgacctctacaacgttattcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagctgaagacgccgtcaccgcatcaaagcagtcgggtcccagttggaagccaaacaagggtacgccggctacgggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccacaccatcctaactccaaccatgtggccaaagattgtttcgtctacaagcagttcgcggagcaatacaccaagactacacggaagaactccgacgaagaacaaagcacgtcgaggaagaaggacgacggtgacaccccggcaggatttcaagaccaccgcaaggagctcaaccatatcttcggcggccccctggcttatgagtccaaaaggaagcagaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattgtccgcaactccactcggccagatcaccctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagctgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagatttcaaaaagtggagaaagcgaagccaagactaaaaagattcccctagatccttctgattctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaagatgcgatcaaggaggaattaaccaagctgttagcggcaggcttcattaaagaagtccttcatcccgactggctggcaaacccggttctagttcggaagaaaacggggcaatggcgcatgtgtgttgattatacggacctcaacaaatgttgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcatattgctacgtcaccatgccgttcggactaaaaaacgcaggagcaacttatcaacgtatgatccagagatgcttctcaacgcagatcggccgcaacgttgaagcctatgtggatgatgtagtcgtcaagaccaagcaaaaggatgatttgatctcggatctagaagaaaccttcgcaagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccattggggacccgaagcacagaaggccttcgaagatttcaagaaactcctcaccgagccaccagtcttagcctcaccacacccgcaggagccgttgttgctgtatgtatcagccacctcccaggttgtgagcacagtcttggtcgttgagcgcgaggaagatggccatgtccagaaagtccagcgaccgatttactttgtcagcgaggtcctagccgactccaaaacgaggtaccctcaggttcagaagctgttatatggtattctaattactaccaggaagctatctcactactttcaaggtcacttggtaacggtggtcacatcatttccactcggtgatatactgcacaaccgcgaagcaaacggacgaattgctaagtgggctttggagttgatgtctttggacatatcattcaagccccgaatttcaatcaagtcccaagcgttagctgattttgtcgccgaatggaccgagtgccaggaggatacccctgcggagaaggtggagcactggaccatgcatttcgacggatcgaagcgactttcgggcactggagcaggagtggttttaatttccccaactggagaaagattaagctatgtgctttggatacatttttcggcgtcccacaacgtcgccgagtatgaggcgctccttcatggactgcggattgcaatttccctagggataaagcgtctaatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcggcacaataataaagccgccgacagacttgccaactttggatccaagcgcgaggtggcgccctccgatgtcttcgtcgaacacctttatgcgccgacagtacctcacaaagatactactcaagttgcgggcactcatgacgtagctatggttgaagccgactggcgagagcccctcatacgatttttgacttctcaagaactcccccaagacaaagatgaagccgagcggatttcaagacgaagcagactttatgttatgcatgaagctgagttgtacaagaaaagcccttcagggatcctgcaacgctgcgtatctttagaggaagggagacaattgctgaaagacatacattctgggatatgcggaaaccatgctgccgcacgcaccattgtcggcaaagcttaccggcagggtttcttttggcctactgcagtgtccgatgccgacaagattgtgcgcacgtgtgaaggttgccaatttttcgccagacaaattcatctaccagcccaagagttgcagaccatcccactgtcttggccgtttgcggtttgggggcttgacatggttggcccgtttaaaaaggcattcggcggttacacgcacctctttgtggccattgacaaattctccaagtggattgaggctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcatcagtggcgcatcccatgagcaatggacaggtggagcgagccaatggcatgatacttcaagggattaaagcgcgtgtttttgaccggctaaaaccttatgccggcaaatgggtggaacagctgccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaagaggaccgagtggatgatttgcaccgattggaagaagtccgcgaagcagctttgattcagtcggctcgatacttacaagggttgcgacgttatcataatcgcaatgttcgatcccgtgcctttctagtcggcgacctagttttaaggaaaattcaaactacacgagatcggcacaagttatctcctctatgggaagggccatttatcatctctgaagtcacccggccaggttcctatcgactcaagcgcgaagacggtacactcatcgacaattcttggaacatcgaacatcttcgtcgtttctacgcttaggcttatcattgtacttccctatcttgactgtcaacatcaagttttcttcttgaagttgtcagtcgggggctatcatcataataatggagtgtgattttttatcaattcaatttgcttacttggtctatcattgccttgcttgatttttctacttagtctgcgaggactgaaagtttttaatagcttctttgggttttaggctcaacagagcttgataaaagcttttaagaaatcaaagacttggctagaattatcaaacacagcataaatacaccagtattgtacaagttgagcctccatttgttacattcatactcagtcagaatcagttttttcatcatcagagttgttactactcggctgtaggtcggtattgcggaattgatctacaacgtcacttgcaattttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacactagcgacttcatctcttgctccttcaagcctcttgatcttgccaaccaggacgtcaaattgagcttgagatttgattttgcaatctacaaaacacatttatgataagaatctgctgcatttaaaagagagaagttcagattgttagctggcagtaccttcaatctccttcaaggccgagtccctttgcgcagccagttctaccttgtctcttttcagggcttcaatttgtttctccatttgagccatcctggtggcttgcgctgtttgaaatccaaatggttgaggatacagttatgacagcgtaaattaatgggacagatctagaagattaccttttgatgaacctctcagctcgaagtttgaatcctggagctgagcaatttggtccctcaattccttctctgtctttttggcaagctccttggcctcgtgtagctggtccctaactgcttcaagagttcccaaatgaggaaccagcttttctaaagttgcggtcttggcctcattgcgaagatggattctctgcatgatggttcatggtttagttctgctaaagagaaaacaaagtcatcaaaggcagtcacccggaagatttacattcacaatgcgagtggcttctccaagtgccttcttcagctggcacacttcctcatcttctttttgacgatttatgacgatgccagcagcttgtgagttctcgtcccaccatttgagtaagataggaggacgagagtcatcagccgcctttatgcggagaatttcttcttcgtcgtcgcctggtggttctgatgtatttccaagacattagacgaataagctggagttattcaaatcggcatcacttgaggagatgagttacctgaggatgttcctagctgagcgtgaggtgatccttgttctttatttggagacccaatcatcgagtcgttaccagcctctggtccttgagaagttatcgtccgtgcttcaacttcgggaatttcttgatctggacctacatccgactggtttccagccgggggctcttgggtcgttgtagtttcagttgctgccgactggtttccagtcggaggctggtcactcggataggccttgtcacctgaagtatgggcgccagccggctggctttcggcagtcggctcagaatccttggatgaacttggctctgtcacggccggatcaggatcttttccagctggatctatgtcggatggtttcctgcaaagtgttctttcaatattcagtattattttcatgagagaagcatgccgaaatgaaatggtaccaaaaggtttatacctggaagatgttctaatctttggcattggacggctagccagttttttcctgggtgtggtatgctttgggagtttattgggcaagcctttgttcccatatttgttgccatcgtcgccttcgtcgtcgctaagcaccagctttctcttgcgagaacctgtctgcccagtcggattggaagtttgaggttgcgggtctgatctgattgttggccctccacctccctgaacggtgtgctggcgaggagatcggcgctgagtgattggggggtcagacttcatcaatgcatattcctgaatgagatgcctccacggttagttaactcaacatgaagacaagattatgttttggtcatgggttgaaggtttcagatacatacctgcggaggtggattgaatgcgttatatggcacaactggcagctgatgtgagtagttgacgacaatagcatttgagaagattttatacattctctccttcatgattttaaaatccagagaatctggttcttcacgattaggatcatgcttgccgtacgggatctttctttaattggtgccaatcggcatttgatgaagtgccgagtaatctgctctccttgtaaaccttgttctttgagttttagcatgcgatccatcaatgccaaggcttgggctgcttcatccccaatcggaagagagttccaggtatcttggtacactggaggaagacaagagtactcaggaagagcaggctcaggattctgaatataaaaccagtttgcgtgccaccctttgtttgaggtcttgaagggcatagagaagtacttttggctcagagtccccctcagctgaaatccggcccctccgactacacatggcttactcttgttcggttggggcttgagaaagaagattcggcgaaacagagtgaagtggggcttaatccccaagaaggcttcacaaacatggacgaaattggcgatgtggactatggaatttaggtttaggtgatgcaagctgattccatagaagcttaatatcccgcggaaaaattttgaggtcggaagagcgaagccgccatagaagaaatgggagaagaccacaacctcgtgtgtatcgggggtcggaaaagcctcaccgcacgctggccgccacccgatgatctccttggcggggagaacgccgtgcgccaccatctccttcaggttctcctccgtcacgtcggatggcgcccattggccttcaaagctttccttctcttccgccattgattttacccgaatgcgctgatttgattcgagggatggcttgggagaagtgagggattgaggcggtggatcacgggaaggattttgatgaacttttcgaaggtagattcgagtggaatggtgaaccctagtttgccggcgcagctctgtactgtagcagggagtggagaaaatggcgagagttccggcggggaagacgaagcgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttagaatgacttgtttttaccatagtcatttccttggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagggtgctaaccactcggattccttttattatggctaaaaagcagtcggctagaatgcctctttaggcgccgcgtatgcttttgtcatacgatgcacgattgtgctgttattttgttctcaactatatgtttagtttgttaactaatcacatagttgggggctacacctaattaggtgcatctattcgatgcaccatattctttatcttttcgccctttacagtctttgtcttcgctactcggcagatcttggcatgaaaggtttgaagcactcggattattatctttgagaaggctatgatggttgactgcaaaggtctcgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcacatgttgattttctccaaatcatacaattaagaagacactcggcggattcatccccggacaggagtagggtattacttcttgaataagaaggcctgaacctgtataaatcttttgtctccaaacccatacaattttccagcttgatagccacccccttttattattgccgaaatctagtttcgacatccctatcctggtcaatggtggaagtcgatgagaatgcaggaggctacattgatcacgattggttgtctgaaatcatgttgcaagaaaaggcggcagatcattggaataggccgcatgatgggcctccacattagcacttgccaagtcacaatgtcacgaggcaaatcatcaaaattggccccaagtcgtcaaaatgggctggaaaattggcctccatatcagcacattcctgatcataacgttattccatggaggtgattggttcgaaggaaacatgaagccatatagacatataaagagaagactgaaatctactaaaaagctaaaaaactccggagtgatagcattgcactatgtccatactactaaatttggtagatcagttcactaagagactatcacatattgtgatagatagtgcatcgagtgagatgggcctgaggcctacttgagttacacaatagtgataaccagtcccgtgtgatcggagatcccgtgaattagaacggcgaaacaagctattggatgactatgatgagagacctttaaaaatgctcatttctttgatgtacttctctcattgtttgtatgacaagttgatgcacactttaatgtgatccgagtggctttctaaagtagagttgtcggcctatagaatatcttagaaggaacacacctatatgagtctaactactaatcatggtatatgagatttgggttatctctagatactcatggaaaggcatggaatatgacttatacgctttaaacaaagggtattttgacggcaacctagtatatgttaaggaattgagtaaatcctgactccacaagactaataatttaaggcatagtccattgttcaattgtggtcccgtgtagctccatttctagatggaagttgaacataatagccttcaccgaaacactagtataacaaacagaaacggaactgaaaacatatcttggaggccttgaaatttggtgggtattgttagaattaaatgggctaggtctaatttaatccttgtaattccaaagactcataattaatgttaagagattaatactccctccgtccgattttaagtgcagccatgagtttctgtgtccaattttgatgttacatattactaaattatgttattactgtttttttaagtgctattagtatgttcatgtttagtagtattacatagatcatccttttattcttttgtcatgtttaatattatgattttctgaattaaaatatgtcgaattatgactatatttttaacattgtagtctattgcaggaggcacctaaataataagattttggcgaacaactactgctaagtggcaaaggaagatttcatattatgattccagtcaatacgccaaattccacatttagattgagaattatgtgatcatgttttaggctacgtattgctagctaggtcataagaattttaggcccccacggaaattcaacatgcatatccatttgttcttgtcaaattaaagctagaatagagcagagaattacattggaggttaaattcattcaattatatatgaatgcaagcagatctattagcactaattatgcaggtctatattcttgtttcctttttggttaggatttaactgaactttttatcaaatctagctaaacacccttgcgtgtcaacggagttctaaaagagaacttcatcttttaaaattactgtgtcattcccgatgtacgagactatactcgcatcaattaaattttgttgtttagctcaagtcatgtacaaaataattgctaaccatgatcataatttaaatttgatactgattttccttgtggatttttcatgactttcatagcctggttaatgctgacctaaaattttcttaagaactaaaccagataagtgtagaccttttaccagttaatggacaaagatcagtttagaccttttaccagttaatacaaataaatgcccgtctgtttaaagttattcactgtacgtggcccccacataatagcatagcaggtataggtggtgatgttggcccgggccacataacaatggatatgtagtgagaccaccatcacaattgctgtcttttaattagagtatacatactatacatctactacctcaaggtgcatcaaatttatatgcatttacctgcatacatttgtagaacgcagtgccaggaatgcatagtggaagtgttataaggccctgagcgaaagcatcgtagtgtttccacatctttccgtcggaggtggaagaatcatagctgattaacttcttggctgtaacgctgaatatcatctgcaacaaattgtagtgatacgaagattcaattgtcttatgtaaagttacaacccactaaaaatctaagctcaacatacaagtatagcaattattagttgacatgcaggcacgctacatcaacccactcaacatgcagtcatcgcaagtattagttttttaggtaatagaacttatagagtattagttaatatgcaagcatgctgcatcaacccactaaacatcaaaagccaataacatgcaatcatgcaattatgccaattatattcgtatatacttcctccgtcgcattttaattgtagtcgtagttttctgcgtccaacatttgaccgtctgtcttatttaaaatattttatgattaatatttttattgttattagacgataaaacatgaacaatactttatgtgtggcttatttttttaatttttgcataaaattttcaaataagatagatgatcaaacgttggaaaaaaacccacaactacgtttaaaatgggatggagggagtactaaaactgaaaatataactatactacatcatctaaaattataaaatacaagcatgc

SEQ ID NO: 69376 - DNA, 587 bp, Oryza sativa
cctcagaacacttacatacatgtggctgggttgtagttcactctctagtttgactgtatagaaattgcggtcggacggcagttcattatcaaatccagttgcccaaactgttatgctcagatcatttgcgtgaaagctcttatctatctccaaacatagcctaaaaatttggtccaatgaaaaatttggttgtcagcaattgttatcctctctggactcaccgcaaagaggaaccaaattgcccacacaggcttaaacccttgtaaacatccccatcagggggcactactataattgcccacgtagaccaaaccctagggttgtaacccaggactacaaacctataaataaaccccaaaaggtgtataatagggatatgatttttgagaaatcaatatacaactactgtttcccgctctactcctcaagtgaagcatgtgcttcagcagaagtatttgtctttcgacagcataagtcatgtatgtttaatgttttgaaccagatttcaaaattttaactatcgattgctaaatctcaaaatttcaaaagcatgaccaatcgttgtcccaaacatcgaatatattttc

SEQ ID NO: 69377 - DNA, 2631 bp, Oryza sativa
actcttaccttgtttttcaatagatacaattatattttgtataaaactgtgtcaattaatctacatcaacacaatataattgttaatgtggtagtttgtaaacctcaagagttatctcgtactataatagggagatactaataacatatagtcagcagaggcagtttaattaattgctgcaagtgcaaccaaaaccattgggagtgcagggcagcatcagtacagtagcagcagggtcccaaggaggaagaattttggtggcattttgcgtggcacaatggtaatggaaagcatgaagtagttgccccatcgccattcacagcgactgccctggacctggacctggaactggatggatgtcaaattaagttgagctacaaaacaaaagctacacattatgtgcacaagacaaccgactgaccatccatatatccatcctattctattcctgcaaccaagcttcaggatatatcacacatctatagagtgtagtatttcacaatctatattgaacaaatctccaagaattttatccgtgtggtgtggtgtggtgtggcgttgctagctccacccggaactgaattaaatttggtatctgcctagcataataatgattaaataaccagaaaggtactggcagcataacgtagcatctgaacaaactgaactcagctgctcggtccatcttaatcagagtttcagctgaagaaagttaatcgatttgttaatcatgttgttagattctaaccaaaaactaaatgctcaagcctgctactgccagccgctttgcttgacctctgcagtatgcttacgcggattacagttaagagggaaaacaacaggttggagaaacgtaagtgaattaggcaggcgatcgatccagacgaaaggtggcctgagattagcacactgacacgacatctcggctgattgcatgcgtcactgagctgcacattttccatcctgatatcgataatgaatgtactactgttgtctctactcatctcacaaatgcagttggattatatcatctcttaaattaatggttagttggagaggctgatggagatatatatcttcttgtgcaagcagcctaggcaccaaaaaaagattccttgctttactctcatcaattcatctatctgatgatttggtttaagaactggcttaataattttcatcttaatttccagagcaaaggttaagtagttatgatttcattcagatgaagcaacacagacccgtcgatcaccacgaatgcgtcataaaagggggggattaatgaaatggaacacaccatatatatatatatatatatatatatatatatatatatatatatatatatatatataaaggacaaaaatatatggatgatgaatactatgttttgcactggtatgaaaatgtccatgcattattgattgaggtactgcttttgaatggcagcagcatatccaggtcactccatcgattgtatttggtcatcttctcctcctggaccagctacaacttaacttgatagctcaatccatatgttccacacatacttggggcttttggtttcgtatccgaccttgatcggcttctttttctttttcaacgcacaaaagtaaagaaaagaaaaaaaaatttgtttgatctgtatatcctgttgcgctgcaattttggtccggccatagaaagaaaaggctgaaagcgagacatgaaacacaagcacttactagagccacaagcttgagattggttgtaatagttccctctatctaatccgtccaagcatcaaaaagggaggagctcctgctgctgcagctagctagatagcaccatcgaacagtctgtgctcctctctattactagcaactaattagcacacgcaattactacgcaattagcagtagtgctctcttcaaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacctgcgcttctcttctcttctctgctgtgctttccatccatccactcccacgaaccgcacctcaccttctttctctttcat

SEQ ID NO: 69378 - DNA, 13597 bp, Oryza sativa
caaaagtacatacaaagcgtagggatatataaatgaatatatgttaaatgttacataaatagggatatttttttattgaaattttgtggaaatgatataaggaatgatgatctggcatgcttgtattttataattttagatgatgtagtatagttatattttcagttttagtactccctccgtcccattttaaatatagttgtgggttttttgtctaacgtttgaccatccatcttatttaaaaattttataaaaaaattaaaaaaattagtcacgcataatgtattgttcatgttttatcatctaataacaataaaaataccaatccatctgccctctcgctctccatttctccttcgccttcactctcaccctctcactctccgcctctccatactgacgactgccgctatgacgatgcaccaccagcggcctcccctcgccccaccccttcttcttagagctctccgctattatgcgccaccaacgttgttgtgccatttctcctcatatctaggccaccggatccggctacccagaggctggggtcgctggatccagccgctttgaggacaggggccaccagatccacggcgaaactgtggcggcggtgatggcctcagcctccagcgagtagtgacggcagtggttccacgacaagcggcggcggcagcaacaacctcatcctctgacgagaagcggcgggctcccctggtccttgatggccggatggcatgtgccattcgagggtgatgacgggtgcgagggagatcgaggatggcgtcggcagtgagtgcgttttgtttctattgctattctgttgaatgtctaatatggcagaaggttttttatctgtgatgtggttgtgcgattgttgatgatgttgatgaataattgaattaatgtaaaatagccatgttattggtttctgatatggttgttctcatctttgacctgtggatgtggagttcttgttcctaatctataaatgcggaaggggatttagtggtaaatgtggaagggatttggtggcatggatgtgaatattaggggcagccccaagcatcggctcatcgagctgattcgtcgagctagcctcttctttttttttttggcttggggaacacatcaataccggttcctcacccgcactgatgagcccccctcatcagtgccccaatcatattgccggttggagaaccggcattgatgagactttccaaccaaaactaatgataaattatgtagaggagcaccccttgggcctatgccaggtgtgtttgctcccacgtggcacacttggcaacccaattagcaaattcataaaaaacatgtcgttgtgttcatcttcttccccacttcccctctcaactttcatcccctctttcttgttgtcagctcagaggaggcctgcagatctgaccagttggtcagacggtggtgatggaccggaggcactaaggtcttcctgggaggcggcaggtgccacctgtggggataaactagcatcctagacgagggccactgatcagtgcggtaagaaaggaggcctatcgatgccgtgtgcgggtcgaagtgtccagcagcctagcaggggcatcgtgggggacccatgtgggggttggggaagtgttggacggcctcggccacaatggagatggtaggcagatatacctgtaggttggcggttggaggagaagcccgacgaatctacaacggccacagcccaagcgacaacgaccaacaggtggatgcaggaatttggggagggagtcgatcaaatggccgccgccaccatggtcctcttctcggatccaaggacacaaccacagggaatgccccttggagctgcagatctacgctgccacaagccccttccgtggcgccacccagtacatgcctcgaggaccctccgaaacgatcccaggtgcaagagagaaagagaggagagggagggtatggagtatgaagaaagaagaagatgggtactacatgtggggcccactaatttgttgctatgttggatgacacctaggatgaaaaccaccatgtatttgatagggtgtaatttgtccagcttaaaattaaaattgcctgatactaaaattgatggagtaatttacacttttatgatagttgaggaaggtaaatcagacaaccatattttcaaacatggaagtgtagtattttaggattaaaagattgaacatacacttgagattgcttccttgagttcgatgcttgggtgattaagccatgatgacaggctggcctctgctgttttgtgcatttcctggatgatttcttgcctgagatttccagggccgaaaattcggaggaccaagttcctgatatgcctgtgtaacaacgcatgtgtcgtgattatactctcggcgccggtgatacgcatgaatgaacccgggcaccatatctggaaaagcttctcctcttgttgtaacacgaaattgctcacctccggatctagggaaacaatcaggtcttccataatcatgtttgttttgaaaattggaccatacctgaaataggcgcaaatgaatgttaatatgcattttgtattatcccctctgtttctgtttacttgctgctgtctaacgaattacattcctacccttgtaaatcacacatattgctattatcattaaaattcacacatactaatcatctttccccaaaacaagcattaaaattcattatgagaagtactagtgctagtatgattacatttttaagaagattaggaggataaagacatgtcaaaaacaagtctacaaatccttttatgtctttgtaactcactataattatgctggattggggagaaacgcttctaacaagtgctctggagatgtaggctacaagtgaacctgtgagaggtctatggatggaagcgcgatgaggtgcgcaaggtggaggtttagggtttagggtccagggatagacatgtgtgcaaggtggagcatgacgacgataaacataatttgatcgatggattgaacactttaggcggtggtttaagccattcgatggctactttcaatagggagatgaccagacatggtgcttcgattgatggtggcagaagcgattggcaattgatggagtcagacacttcgggtggatggttcaaactttttggtgaggcactttcatcaaggagtcaatgaggcttgaccctggggttgattgatgctagaggcgatcagtgtacccgatcagtggagttgaacactccaggcagggtggcacgggtctttcagtaagctgcgttttgacaaggagtcgactagatatagcgctcgggtcattccatggctaggaagatggcatggcgatttgtcggcactcactcacgactagattgatggcattcaataggaagttgtagcgggtggaccctatatgatggtttgagaattgagaggtttcttcgacaaagtgtggtatgacaggactgcgccggtggcggcatatatgcagcagacagctaaattagggcaatgacggtgaggccgttatattgagtcaggccaatcgtgcaaggacctggatgaactatggatgtcgctggagatacattgacactcatgaggtctcatctcatggaggtgtgcacgttctgcatcgaggctgagccggtggtgactagggttgtgccgagccatggctaggctttgttcgagccattctcgcatgagagtcaaatctggacaagatcatgccgtttgtgatggaaactgacacaaatttgtgaggattctagaagagaaatgacacacactcgggagcaatcaaatatgtttcttgacgggtggacgtgatttgcagcgtcgagtagatcaggttgagtctacactgcttcggcgagtggtggtgcaagtggaggaagctcggtggcggctccccaccaatgggaccgatgtaggcaggggtggggcatggggaggatgtgtgtggacgggcctcctggcagtggtggcggcccttacaggagggtcccaggagacgatgttgtggaaggtcaattctcgtgcgtcgcggcgctccaagatgagcagtgttgacggtcgttagcgatcggtttcgaccgtcaatactaccaaaataaaggagaactagttatgcttgcaatgcatatttgtgttagaataataatattccactagtattgggattactgacctcttgcagagaataaacataaaatggaggagaatcgacatcaaaccagatgatcaatcaatcggacgatgtcgagaattagacttatgcatgaatgggccaagaactcagaattgacacgacaaattaggccaaaattcacaagtctgcggagaggagcaatagaggaggccacctgtcgaatttgggctaggctggccaagcccatggttcggccgatcccaccgtggctccgttcgatgcagggtttggatggacggcgtggatcactccccaatgacgttaggagggcaatgccgaccatttcaactaccacaaccgtcattggcagcctatttaaggagctcgtcttctcactttctccatacacttcaagcaaagttctctcatattctctcaagcttagtttactattctcaagctagcggaataggaatagaatagaaatcggagtccggaagtcttcggaagagttcgggtatggctctagtagctctcctttcttcttttgtaagacttgtactttttttagaatattcttctttatataattctggtattgaaatattttccgagtatatgaatgccaactttacttcatatttaagttatattgattatactgctagcttatctgggagatgcataggtacgggtataatgtttgcttatacaattactctatgtcatgacgatgatattagaatagtaactggtagtttaggcatggtgtctagattactgggtatcattatttggggttatatgctatggaagagaggtgggccgctgatggtgacagctcagtacgggtattcctccgcgcgtgtatatagtcctaagttaatttcctggggagggtactcctccatatttagccccggttgtatagtcatgacgagctgtcgtaaggaactcgacagtcaggggtgacttctcgaagtaccaggagggcatcggaaagagggtattagctaattaatcttataactaggatgtatgtataatatgtatactagaagtataggaatagattcttttctattttctttccatttagcttagatagtttaatatgagaatgagtagtcttatgcttgtgtgtcatgctaccctatggattatattaacccctgcttacactatgattattacaagtaacatataaattattagtacggtactctctactataatcttcccacaagattaaacaaatacgatacctttgaaatactctcgggtgaaatgttacaatggtatattcgtaagcttatataaactctgtaaccataatataccaggagtatttctgcgccattgcttggaattatatctctagtaatgtcgttaagaaataccaacaagcagcagtgttgggaaccaaagcgcatgctcgatggcaagacaacccttgctcggagtctgtggaggagagctggggacttctgttcatgatggtttgctcgaaactgagaaggagtatgcgtggaaggagaaagggaatcggccaacccttgatttcctgttgaatgggatttgaccagaagaaaccaagttgtggctttgaccagaagaaaccaagttgttttttttttgggaaaaataaaccggttttgttccagctggttagttggtgggctaaacaccaaggcagatcaatttaattagggtggcagctgtttttgttatcatccatttctaccgtgatagctcctatgtttgattcggtgaaattcgatagcaccataaatcttttctctggcagacagaggtgaaggatatgttggcttaactggggatatccaatgctcttgatgagatgaagccggccaagacggatgatgacaactgcgatgtaatcaagacacatgcagctgcgacgatatgattgcttggatttggtcatgtaccacatcatggaggaaaatttaccaaataaaatgttggacaagttgacaaggctatatatgtctaagtcggtgactagtcagttgtatctcaaacaacaattgtatggtttacagattcaagaggagtcagaccttagaaaacatgtggacatcttcaatcggttggtcatggatctaaggattagatgtgaaattggatgatcaagataaggccataatagttctgagctcacttccaccgtctttggagcatgtgactagcgtgacgtatggtgagcatactatcaagactgacgagataatttcatcattgtttgcatgggatttgataggataaaataaaaacaaggcaacataggcttctcatgctgaaagtttgctggtcaaggcaaagcatgacaatgaggtggagacatcgaaaggcaaggagaagcgggtacgttgctataattgtcatgattttgggcatataaggaggaattttccattaccaaagaaaaggaaaagtgcaactgcatgtttacaagctcatggtgatgacttagatagtagtagtcatgagatctcacggtgtctaacgagaagtctggtcaagcatagatattggacttggctagttcctatcacgtgacatcaaagcatgagtggttctcttgatacaaatctggtgagtgtggtcttgttaacttgggcaatgagccacatgctaggagtatggatgagtctgattttccctaggagcttacatgagactgtatcaagtggattataataggaagacaatgaatatcatgaaagacgggaaagctgtaatgatcggtgagaggatgataatgtttgcacaagctataagctacatggaagatggatatgttagtgtcgctgtacacgatcctgaaggaggtgagcctagcgtaggctcatcgggtggctcggcgtgagtagtgaaaggaaagtaactcaaagttcaggaacacggcggtacgcacaagtactaaattcagattggcatggcattttcagtaaggtgaagtttgttaaagtttatgtcgaatatttgtacaaagtcggttacaatttcagacttgaagttgtaccgggtattaagacagttgtagagtcggactctattttaagatctcttaaaaagagagaaacacctgttgtaactgcatggcaacatagcacatgcaagagggaaaggttgtcggcagcgtccagtctatggttgttgcaactttgatacactgtaattatgctagttcggggaggagcatctgtaatcagtgtcatggggttgtacgcttcggctgaaccttgttaataaatatctactataaatttggactttggataagcgaagtcttaatatttctacatgactttggatgaacacataaatatttatggaagtcgtatatttcaacgaggttaacttcacaaaattttcatttgagctcatcaatgatatgattacaagttgcaaacgagagtactcaaaagaacaacatcagtaacttaattagatatgaagtgcttggtaaatccgatgatagaagggttaattagattcatgccgtattgaaaaaatatcattactatttacaacatctgctgcatatgctactaaaagtttagaaaattcgaaccatgccacaccgtaactatttctgtcatcctccgttcatcgacgttctacttccctctctagctgcctgcttgaagtgagcggcgaaggcgtgcccagagaaggtcgtcgacgtgctcctcatggacacaagtggactcgcggtgggagcctgtgacatcccgacccaataaggattaggcctgtgtggcccatgtgagctgtgtgcgtatgtttagtaccaccttactagtttagcacgagtggaaccgacttataaggcctcttccctccaaccacatcactcccgggttaacccttttacacgaagcgaggacgaaagtgtaagtggggtggtgtgagtaagtgggcccgctcgtcgtttgggctgggctacgcggttctagaggaagggctattacagagccgtcgggaaggggaggggagactcgtaatgagatcgatcgggaagagaaaggaagaagtggtaggcggcctgggtccgtcgcgttgaaatcctccaatgcggcaatagactcgtaatgagatcgaccgggaagagaaagggagaagtggtaggcgaaggggaggggagactcgtaatgagatcgaccgggaagagaaaggaagaagtggtaggcggcctgggtccatcgcgttgaaatcctccaatgcggcagtagactcgtaatgagatcgaccgggaagagaaagggagaagtggtaggcggcctgggtctgtcaccttgaactcctccaatacggcaatgagccccctctttaggcccgttaatgtccatgtgcaaaataggcgatcgaacatggcctctcttttttggggcccatataaacatgacggcccacttctaattgcttagctatagcaatgcaagcctaatagatagatcgaccaacaagaccaagccaaggtgtggcactgccgggttgtgtgatcacataatttgatcctgctgctactgtgcgacaatcctaattccatgccgcgtgaccgccgagaccgagacgtcgatcccaattccacgcaagcgacgtgggaggcagcgatatagcttgctgcttgcaacaatagcacttgaaaaatgatatcttagacaagattgttagatggatctccctccccttgagcccaacggctcaagggggccttgacccgtgccctgatcgggggcgcccagcccaatggctggtgggcccccgtcacactgtgccatataaagaggggtggaggacgggacgggacaactacacaaggaacgaggttcgtcgccgccgccgccactccaccccataaaccctaaccgatcgagggggcgcagccagtgacgggaagactccaccgccgcgccacgacctcgccaggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaaccctaacaatggtatcagagctgtcctagcgtttagtttggttcggggatagacatccacagagaagaaagaaatccaaagcaaagaaaagcaaacgatccaacggatcgaaaagatcgaaaccctaaccctaatcttacctcgtcgccggccgtcgttgacgccggccacggagagggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcagcgtgagggcgtcggccatggcgccgcggcgcgaaggctgccggtgtcggcgacgccgctcggcacggcgcacgcccgcaagagaaagaaggagggggcgccgcggcacaaccgctcgacggcagcgcactcaccctcgagtgagtgcgcgcaccggcgatggggagtgcgacggcgccgccgtgtcgccgtgccgccgccggcgctgtgctagggtttcggcgacggcgacgccgctccgtgcaaccgcaagagaaagaagagaagaggagctagggtttcggcgccggcggtcgggggcggttttgtttgcccgatccgcccgcgcgaccgtccgatcgaaaccctagcgatcggacggccgacggcggccgggccgaaagcggcccaagtggggagcgcgcggcggcggctttcccggcccaggcccaggttgcggcctgggtgaggggagggggcgctcgcccgcgcgcaaggtggccatgggccaaccggcaaaggccggaaaagttcactttaggtccctccgaaggaagcattttcaatatgtttaatgattgtgtttatttctaagcaatttgaactaacgtgaaaattgtttagagaatagataaatgtgagaaatgcttctgaacatgtattttgtatattttcatgcaaattacaatagagttttgaattgtttttacatgttttacctctgtttaaatttgaaccaacgggagaatttttacagagagtaaacaatagagttttgttattgtttatatgaattgtatatagatcttccgctgcaaatagatgaaattgatgaaaattagtgtttctaaaattaaatttcgaaccaacgggagattttaattttaggagcattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatacgaaatggtccttagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacattgcaagaagacaagacattccaagaaagatcatcctgtcttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgccaatggagttgaagcaaaagttgaagctgttggagatcttcgcctagaactcgcgaatggcttcacacttttacttccagatgtttttatgtccattctttgcaaagaaacttgataataagtgtatccaaattggattctgatagatttgaaatggcaaatgtgaactatggtataataatgaatgtattggtcttgtgttgcaagatcagttttatttgttatctctttctgagaatgtgaatgttgtgtcctcgttgacaaaagaaaagaaagcgaactcctgatgtctcatcgaaattatggcactgttgtttaggccatatttcgagggggagaattgagagactgttaagaatgtagttcttcctccattggagttctcagttttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacgagacacgccgtcttcttggaagacgaaatgattagggggagctcggtaattcgagaaattgatcttgaggagaggcaggtgtctgtacccgctccgtcgactcaggaacctttcttctctctacctgctaatgttgtgccagcaatgtatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatggaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgactcgtggcaaaaggcttcacgcaacgagaagggattgattacaatgagactttttctccagtctcttgtaaagtttccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcaaagcttcgagacaatgctacttgaagtttgatggaacaataaagaaatttgggttttcaaaagaatgtagaggacaactgtattgattcaaagttaagaatgggagactcatttttctaattctgtatgtagatgacgttctactggctagtagtgatgtcaatctactgcaggaaatagagaaattcttgtcctcaaactttgacatgaaagacctcggtgaggcttcatatgttttgggcatagagattcaccgaaatagaacaaaagtatgcattgggattttctcaaaaggcatatatatagaaaaggtgttgaagaaattcaatatgtacagatgctgtgctacacctgctcctatagtcaaaggcgaaaagtatggggcatcgcaatgtcccagaaattcagtatgagctcaataaaatgaaaacaaagccatatgcgtcagctgtag

SEQ ID NO: 69379 - DNA, 1969 bp, Oryza sativa
ctaacatagccacataattatcaattatattaaataatagtatggttaaaaaatgctcttaatatgaacaggcccttaattaggaaccagatccagaaaccctgaaaggctaagcctagttaagttaattatgtttacacagaaaccaagcagtaggtcattgtcaaatgacaaattaacatggccaaatagatcaacgtcacttcttctgcctgttaaagatcattggttcaattgggatgtaacgtggcagtaactaggtttagttaaggttcacttagtttgacctctttgtcaaagcatccatgatccatgtggctccggcaggaagtacagcaagtgaacaccagttggtacgaaaagatgactacttagttatctaagctcttatttttacaatttaattagcatttgatggaaggcactatccctactggcaatcacgatgagatagaacctttaaactaatcacagagatcacaatcaatcgacgctctggtcaggagttagttatggggaatatagaagtacatgcatatgcagcaaccaattaagagaatcttgtgctttcttaatgctccctcttagacttctttatactctgcttattttttgtgtttttctttttttttctttcgaaacatgacatgttttatgttaaatgaaagagagagaaatattatttggtggccacctttttcaatttagtgctgaacaaaaatactattgtgttcctgataaatcattttcagagtggctgtgttctttgggtgactgtgagtgagtttgtttcgttttccgtatgcacgcttcccgaactactaaacggtgtgtgttttgcaaaaattttctataggaaagttgctttaaaaaatcatattaatctatttttgaagtttaaaatagttaatactcaattaatcatgcgctaatggctcaccttgttttgcgtatcttcccaatcttctctatctccttctcctcaaacacagacgtgtttacttacattaaaattttataaaaaaaaatattctgagttaagcagaaaatatatatttcccctatcactatggtgaaatggtgattaattactgaaaattgtgaaatactcctaccttttagtggatggagtttgaatttgttccatatgcaacaaattaaccaacaaacaaatgtttttagttccggtcttgatcaccctttcataattcagatgagcatccgctccaaagcagtctgagggcgccatcgttttgcagttgctgctgcttttcagcagtactagcctgatgcttataagcatcaacaattatattgttttgcttatggctgattactggatcttctgtgaactgatgcattgcctctgcttgcctacctctgtgtgcgttgtgtgctcgtcagcactgactatagatgcgtggccgtagatagatcccgacatgtatagagcccactaccaatagctgttcgcatttaggccgtaacagcgaaccgatgcgcttctgctgcaaaacagcaaccgcaaaagcgaaccgatggcagcctcacagttagtaagctcaacccttttcttaacaatcctattgtaacatggtcaagaagctttgcaaaattggaaagttctggaataatttcatacaagtagcggtagctgaaacatataaacaaccataacaaaggagcatgatgcaccctgaatttttaaaattctataagctggaaaattctaagcaagaaaaccataataagttaagaagaaaactgcagcagggaacaaaatgcattactcctgttatagggtttagctagtatgggacacagagaaagaaaagtatgaaattaaccccaaaccaacagtattgttagttttaaagacaaacgttgtaataagtaatatatttgatcatgtgactatatataccttcatatttaatagagattattggaaatataagcatttcaccac

SEQ ID NO: 69380 - DNA, 29470 bp, Oryza sativa
ggaggagcggcatttcgcggcggcgcggcggggggtttttgggtgaggcgcggcgcgcaccgcacgcacgcacgcgacgccggggggcggatttttctggtgacgcggggggtttcgcggggggtcgaggattttcgcgtgatttcgcgtggaattctcgcggtgtgcggtgtgcggatgccgtggggtaaggctggctgacaaccgtggtttaccaaacatttcgaagtaggttaccgtcgcccagcggttcgacggttatcgtaataaccacgtgattactgtaagttataccgtagtttcaaaaactgaaaatattattgtatattttataaaccctggctgatacggaccatgatatcggggtgcagggtgtatcattgatggggcggagctacaactagcaggatttacaggaacgttactagaccgaaagctatctttgcgatggagcataataaagctcctaaaccagatggtttcccagctgaattttaccaaaaattttgggatgttattaagcatgacctgatgaacctttttaatgtattccatactggtagcctcccaattttcggactaaattttggggtacttactctagttccaaaagttaaagaagcaaatcaaatccaacaatacagactcatatgcttcttaaatgtcagctataaaatattcactaaggtggctacaaaccgaattggctcggttgctgactatttagtgaacccgacccaaacagctttcatgcgtggacgaaatattttagatgaagtcgtcattatacatgaaacagttcatgaaatacataggaagaagttgagtggggtgatattcaaaattgacttcgaaaaggcgtatgacaaggttaaatggccttttctgctacaaactctgcgtatgaaaggtttttcgcccaagtggatatcttggattgagtctttcatttccgagggaagcgtggcagtcaaagtcaatgatgacgtcgggccttttttcagactaaaaagggccttcggcaaggagaccctctctccccaatcctattcaactttatcgctgatatgctagccacattgataaacagagccaaaacacaagggcaaattgatggagtcataccacatttgattgacgggggactctccattctacaatatgccgatgacacggtgatgtttatgaatcatgaccttgaaaaagctcataacataaaatcagtgcttctagctttcgagcagttgttgggccttaagatcaattttcataaaagtgaactatattgttttggtgaagcacttgattatagtgatcaatacaaccagctctttggctgccaggtcggcaacttcccattctgttatctgggcattccgatccattataggaagttgagaaatacggaatggaaagaagtggtcgagagatttgagaagaaattgagtagctggaaaggaaaacttctttcgttgggaggacgacttactttgattaactcagtacttagcagtctcccaatgtatatgatgtcattccttgcaattcctagtgaggtacttaaaaaacttgattaccttcgatctaggttttattggcaaggggatggacataagaagaaataccggcttgctaagtgggacattatttgtcgtcccaaagaacaaggggggctaggaattcatgacctcgagataaagaataaagcgttgattagtaagtggttatacaaactacttaccaccgatggaatatggcaacaaccgctacgcaataaatatttgggatcacaacatttatctcaagcctattggaaagcggggggattcacatttttgggctagtcttatgaaggtcaaacatgattttttccgttttggatccttcaagattagggacagctcccaagttaggttctgggaagacaaatggttgggtaatgcctcgttaagagaacagtatccgtgtctctataacatagttaggcataaacagtcgactatcgcacagattttccaaaccaatcccccgtgcttttcatggcgacgggatttaattggtgcaaaactagctgcttggcataacctattgcctcgcatagctgatttggttctggtacaggagcaagatgagtttcactggaacctcaccccgaatggggtcttctcagtcaaatctcattatctagctctaacacataccgaggttctgaatatcaatagacggatttggaaggtgaaagtacccctaaaagttaaaatcttcctttggtatttacgtcggggcgtaattctccccaaggacaaccttgctaacagaaattggaaaggcagcaagacatgttgtttctgtcacaaggatgaaactatccaacatttattctttcagtgccgcttatctcgcttggtgtggtctataattcatttggcttctaatctgaaacctcctcgcaatgttggtcatatgtttgggagttggctatcatgtgtccccaaagaaatgaggaatctgcttttgatgggtgcaacagctctgtgttggtccatttggctaagcaggaatggagtaatttttgataacaagatggtgtcttctcctttgcaggttatcaccttagttacccggtggctacgtacctgggctatcctccaccaaccgggactgcgggatactattatagtggtatctcgacgtttggaccaggtggcacaggagttttttacccaggagcatgggtggcagtttagtctatggattgatagccactaagatatacggtggtatctcgacagttggaccaggtggcacaggagttttttttacctaggagcatgggtggcggtctagcctacggattgatagccactaagatatatgtttccgttaaacttttgtgcttgggagatgttctagttatttctttcttcttttttggcggtgtgcattttatgcagaggccgggggtgactcagtttgattgtatcatcttgatgtaattaactgagtctaaataaagcttccattatctaaaagaccgaaagtcatgggtaaacaggcaaaaagttatgggtaaacaagcaaaaataaagggagaaaatttgggattgtgaaccttattgaatttgatcgggaaactgagtggtttgttttatctagaagttcggtcggtttttgttcggattgtgaaccctcgctagtattgtcacctctcgtagcttgaggtttaccatggccgttatctggtgggtggatggctgcatgggttatggcttttgagccaagcccatcggttggctgattggattgaagccattcaacccaaattaagctgctctattcgcttaagattctgagacgtagttggttgataagaatctggaaaatgtgggtttcccagcttatgacttcaagtttattttttagattctacaactacagcttctcaatatctagattaaaagttggactgtttggaggagcttctgattctgccagaagtttcaacagctagaatctccccccaagcaagcccttaatccactatggattccattactgtttcatataggtaccactttatttggaaccagctccttctaacttattgtactcgactctgattttaagtagctgacatgtgaatctcacgattctggggtcatatatcattaacccatgtcataggacagtaagtcaaagaagcttcttctccttatttatgtgctatctgtttctgctcaacaaagccaaatcaatatgtttcatttgatatgattgacatgatatcaaactttactcataagggcacccacaattagggtttgcaaaaccgccggtaaccacgcggttattgtgagggtacggtaagaagaaaaccgttgtaacctccttaaatttaaataaatttaaaaataatttgaaattttgataaattttacacggtttcatactgtttgccacggttaccgcggtagccgtgcttaccgtcggggtgcggtaactctagccccgacggtttgggaaactctacccacaatgttataaaaacccaagtagtaagcactaaatgactacttactacctggtattaaccattatgagagtggtacatagttacaaccaggtagtagcactactaccagtagcaaaggaaaaaaaatggcatgtgcacagtgtttttgacaacaaatttaaaactgcaagttgtcgttgctcctcccccagccaaccgttgcatggtatgtgcttcttgccatcttcatccttaacaaaaaaaaaacagggatggctcaagatttcttttcaacacaaacacatttctgtgaatctttgctagctgggatggatccctccaagagaagtttcatgaacttgttaaaccaaggctccccaaactttctcccaatcataatttccccaatccccacagtttacctatagtcgggtaacggagataatggcgtcggatgaagggatagcatcgcctagttgcagagaaggaagggtttgcagcgtcgatggtgggggtggagcggatgcggcatcgggtggcagatatagaggggattgcggcattgggtggcgggagaggaatccggtgttagtagaggggcggaggggtttgcgacatcaatttttgggtgaggggagtggattgccgcatggataggtggggacggaggggttggcagcgtcggtggaaacaacgagaggaattggggatcgatccagaactcgcgtgaaggaattgaggagtgccgattttttttaccttatggaccccaccttacttccatctcgccaaaataagtattgtggagggggtctcctcctactaccgcctgtcactttgttccacactatctagccacttagtcgcgctttgcgcgacactgagcgttaacctaacctacatatataattagatcattgatcctgacattaattgaaggtaccagtttcataagtacgataatttatttgttctcaaatatactccattaattcctatatataagtatttgtagtttgtttagtaaatagtaagattaagaaggaatgatctatttcagtcacttactattaaattttgaactacgattggctctttctaaacacatgatttggttaaaaatgcttaaatatgcattgaaattggtgtcctagaaatgcttagatttctatataaaatttgaatcatagaaatacttattttgagattgatgcagtagctagagatgtaaatggaggaatgctgtaattgattggcattaaaaagtaggcaaagaaattaaataggatatgactatgttggttaagatgggggagtagatgtagaaatagctatattttacgctaaatttgaatgttaaagatacctatattatattttagaacagagacagcaataacactaagtgctcgcaagtgtagggtgtgcatatgtgcattgtagtgcgtactactcagttgctgtgtgttgctccaataccaagcaaaagtagtataacagagcatttacatgtacactcccatacattataacttgcatataaattcaacacaaatttacgactaaggcctcatttgtttccctttatttagtcaggagattaattaagcaaacatatatatagtgttaaaaatacttttttgaatggtagtgttaaatagactaagcacatgagttctctgctttttgaggtctttagtctgaaagcatccagattggtccaatgtgtttccactgtcatagatgagcatgatgatctaactgtgcattttcatttaccagttcatccaacggtccataccattgtagatgatgtggctcatcctgcattcagaaagcatgttgctttcatatatttagatacccatgttgataatatacattgttgttgccctaacttaggtccttaatcattcattattcatttgcatttaactttcatctaagatattagatatgattgaccattccaccatccacaaacacattgtccaatcaatatatatatatccggcaaattttagccaaccaaaacaaaaacatgttattgtaacaaaaaacaaaatcttattcatcatatcattcgcccttcttgctgttactaataaaatttgaatccacaaacttagcccccgcggatttaactaattactcggcccctcgcgcgcgcgcgcgcggtacaggtacaatacaactagaagcacaagaagcagctgcatttcttgaaaaacaagaagccgcctcggcagtggccgccgttgttgagctccaggatgcacgccgccgtgcacagcgcctccaggcacggccccgtgtacagcgtcttctccatgcactcgctcatcgcctgcgcgccgccggccaccccgccgccttcccatggtggccgactgatgatcaacgcctcggcgacgacggcggtgctctcgccgccggccggctggtcactggtagttggtacgatttgcatgttgttattacctgcgacggcggcggcgagaggaaccacggcgacggcgacggcgaggagaatgatcgacacgcggcgtttcttggagccattttttttttggcactgtatattagtgatgaaggtgaagggtagtgttctaggggggcaatggtctgggatttataggagatttggatgatgatgttgcaggaatggatatattcatatgctcctagcaaaaaaaatgaaaaaaaaagtaggtgcacattaatacaagagaagaggagttttggattgccaaggcatttaaaaggactattaaatgggaaaatatacctgtggtttcaagcaaatcttccaaagaaattaattgttcgagtatgtgtagttgattcactggctaagtggtatcatatcatttatactagggttctactatactaaaaaccaaggacttcctgttgcagtagaaacgcatgttgctatggtaaaaatttggaggcccccactgttcaagttgctatagttgctcgacgcgccactgttcatggtgtggcaatactcatcgcaccgttgtcaagaaattgttttaaatatttagtgactggggttttgattttataattgaaataaaaaagggtaagaaaaactctgtctaccacagggccacagaaaattatgcatgcagacagctactcctccgtcccactcgataatataaaaattcatatttgatcaatagtattttattataaattaaattttatttgataaaaataatatcattgcaatgatattagaatttacttttatataatatgaatttattttatactttatttgagaattgtaaagttaaagattaattttaaagaccaagctaagtttaagcgagccttaatcagagggacggagagagtacgacttaaatgagtatggtaagaccatgggtttaatcaacttcatactactaatatgacatgcaaaagagaggaaattccatttgtacattctggatcataaatggcactagctgtgtgaatggtgtgatccagaatcaccaaaacaggagaacaccgtagcacaaagaagaaagataatagctataaacatgaaagagtgtctttgatttccgtcttttcatggctgagagtactttcaaggaaacatatgttacggagtacatgtttgaacaaaagtgtttcttaccaattcacatccatacatctttgttgtatcgcaacacataactcttgcaaataatagccagtgttcatgaagcattttagcattaaaaataaaaataactaacagtgacgggataaatcagtctagcaattcatgcagtattgttcactaagcatgcttaaatttattcaatcaaataataatacaaaaaaaactgaagagcactaactaaactgcctatcaaccaaagattctacatttgaaaatgaacaagggctacaaaatgtagaaacaggtcttaaaaaatacaaaagatttatcttggtgtaagtttctccagccatgacaagataatcccagctcctttatcccacgagcaatcaagcatcatatcatgggctatcccttcgatgcagactggttgcacattataaaatcttgcagtttctgaaagcccttcagcatcctaaatcaaggaaaatgaaacagtcaaggtggaatgcaaacaagtttacactatacaactgtaaagaaataaatacggtatctacagagagaaagagagttttttttttgggggggggggggtgcgtgtgtcccttacaacaatgaagtcactgctggcgcccacaacgaggatgtttactgtattatttggcacagaagctacaggcaatgatgcattgagcttccttaggtcaaatagtggtaactttgagctgtccttcattagcccttggtaccttcaagatattgacatagataatatgtcattattgaaaaaaaaaacacatttcaaatgtagaagctcttccatagatgtcattattaactggatctttggtgtgtaactaagcagatggcaggggattgatggttgcttatcgctgccaatacaccaaaacaatgtttgcatgttatagaatggaccaaactaaaagatcacctagttcagattctaatttattgattcttttttaatccatctaaaagtcattataataaaataccaggttaaccagttcaggtgacagtaataacaactacttcatctgtttcatattataagactttctagcattgcccacattcatatatatgttaatgaatctagacatatatgcgtgtctagattcattaacatctatataaatatgtgcaatgctagaaagtcttataacctgaaacggagatagtatcaagtaatgactaatgaccaattcactagtacattaccacccatataaaagattccctccaggtatatggcctaaatttacaaagatgaagtcatttactatgaagaatacctttggaccaggtcatcatccatctctggcgagaaaaatgtttccttacagagggacaacgaatttgcaaatcgttttgcagccaagctgagtgtcacctgattcaaagatgcttaagatttcacatatcatcaacaatgcataaaggaattgcaaacagcatgaggaggcatatacacttctgggtgtggatgaccataattgtgatatcaatagcagtcgactgcttattaacataataatttgtaaaatggaatgatgaatcaggggttcaaagctatgaaacaaggtgaacagattaccagcaagacgtaagcatggtactacatagccaaaccaatcacattaatatgacaaagtttatctaattataggttgcttatatttccttgaacaacaaggaggacacatgttgcatagtagtataagtagttaagtgactggcaggaagtttaaatatataaaaaagaggtgattggcaggaatggataaatgtttcagcataattccacgagaggataaaatgaatggaatttcaagagagccaagtgataaagatcaggttaatttaccttgatggcagcaactggtttggtcaaaaggtaacgccacaccaacccactgtagatagataacacaaaggagttaaacccagttatgtaagacaaagatgtaacattgcagtgagttagatgagaaatacctatttcctgagggaggcacagagcatacaagaacagcaccagcaagctttggatgcagaagttctgaaccttggaataaaaaagttaataatgattaacttttgcatgaaataaaacaactattactgccacaagctcagaccataagctgctacatcagaacataggtaccagtaccactaccactcattcccttcagttcacagaataactcacattttttattactaatttaagtaatcaagaatccattgagaaaccttatagtaattggcagtttggcatatctatgtgattggaacttttaaggctcttgatgatgaaaattcagttaagaagaactgaaaaatattaagaacacaaagaatcaccaggtttaatacataggttacaggaattttttcgatcattgagagggcatacctcccaaacaagatatatattgctgcacaatcaagcctccaaatgaatgtccaatcaatacaggtggcagggaaacctccttccggatgaaatcagcaatatcgccagtatgcgtctactgcaagttaatttaatattggaccaactatattgagatggtgaaatggaataccctaataaaaaaatatttgttacaacatactaattttctcaagtgacacatctatgcaactctgctgaatgtactagcttgatatctcctaatatatttatttcatatgatatttataattaacaaaaaacatctaatgaaaggtcagctgaaattaatcatatatcttagatatatgaaagttactccaaaggtggtggaaaacgaggatttgccagtttgccaccctatctcattgacaagtgtgtcctggtcccacaagtcaatagacacatgagtggcaaatccccaattgccacccagaggagtagaaaaatcctcaaatggcatgcatcaacattaaccatctagtacataacacatagcaatatttcagagttggagaattcagtccgattatgtttctcagaattacctcaagtgtgccagccactttttctggcggaacgctactttcaccctgcaacagcacaaccaagtcaatgaagcattacataccaaggaaaaacagtcggacaatcaaaaatcaagacatgcgatcagtcattactcaaaaactgaaagtgtcgaatgctctacagagcagagagcagtatcaagactgggcagcaacagacacgctatgattcatatccttaagattaaagtgcacacacatagaccccatagttgcataaactgcatttttttaactgaaatgtgagtaatgccacgctgttttacttggcttggctaatatataggcattctaaaagagcgctgctacaaaacgggatcccgttgcaacgggatagacatattaactattctcttgcacgagtatcacagatatcaggtcctagatatcatatgtaccgggtaacaggtatcagggtaccatgcagctagtaccacaataggtatcaggtattaggtactgtctcatagaagggtatcatattccaacgggataccggtgtctaggttttctgttctcaaaccgtaaaacgatcaatcaataggattattatttttttgtcaaatgtttttaactttcggtttaggagacggagatacgcgtgtttctgccagcgcctagaatggctagaagtaaaatagtccaacaccacagccatgagggccatgaagcaatgatcctcctccccattaagacatttcaacaaacactttcgcggggtgtacacaagtgactccacctgacctgggcgcggaggctgagcgcgtagcaggggaacccggcgctggagaagaaggggagccagtgctccgcccagcaccacgccgcgtggaagctcccgtgcacgaacaccagcggcggcctcgcggcggcgccgccaccgcccgtggccggggcaggcggctgctgggcgataacctcgaggtcgaggccgcagggcaggcggtggaaccgctgcgactgcccctcccggagcgcgtaggcgcacgacgcgcggaggaggaggggcctgctcctgctcgtccttgccggcggccgccgcgcgcgcagccgcattggcggcgaggcggggaggaggagggtgagggtggcggaggcggcgggggtcgccatggccatgggtggtggcatttttggtgaggaggatgtgccgatgcggatgacggctgctctgctcgcggggttgacgacccaaacataaatactttaatcattaaaaaaattaacatatgattaattacgtttttggcaaaatttacttcagaacactcaaaaagatatgtaattagctatgggacaccgaaaaaacgtaaattggctataggatatcgcaaaaaagtagtaattagctactagacacggaatacattattttattatttccaaacaacagggagagagaaacaatcgtaaaagactaaattgccctatgagtctagccaggtcaacgattatgtgggtcaaggatgtcagcctctcttctattttcttgttctcttcctcccgacgagacacaccgtgctgcagcgccgccgacgccgtccttttccgccgcaccgacgcacgcctcgccgtcacgcggttcgtctccgttgcatgaacggagcagacacaactttgggcgggccacatgacgacgaagaactgctgcccatcggctgtgccttgcacggcactgcaccgcgagctgctggccgctagccgctgcctgcacccacgcgccccatcgcggccacgagttgccgcaagctgctgcacacccggcgcggcgccatctcgcacggccagtgcactacctagccgagcagccccgcatgacgccgaccaccgtgcctgcgtcgcagcaaggccgtcgtcgccagccacaccgcaatcgcgccgtttccgcaccacgccgcgcacgggcccgtagtcggccgtgcctgcacccgaatccagcgccggcaaccccctcctcacccaggcatggtctctgcgcacccgcatcgtgccgcccggccgcggtgctcttttctcgcgcgcactgtccttctccgtcgcgccgtcacgcagcgtcgctccagctccaccttctcgttgtgctgtgccgcactctccgcctgctccctcgccaccgccgccgcggacacccgcgctgcgcagcagctcgacgtcaaggaccagaaactggagcaaaacgacacgggggcatttcggtacttttaccattctttaacttcccgtttccatcaaaaataataaaaataatgtcaccggtgtctagtagctaattatcatttttttcggtgtcctacagccaattcacgtttttacggtatcctacggttaattacacattttttgagtgtactatagcaaattttgcctaagttttaattataataaacttaaaaagtaaatttatctgatacttaaaacaacttcatacatatgggtgtatatatacgtagttttggttgttgctaactgatttaaattatcatatgtagaataatttttttccctcttttagaattataaattatttgattggtaatctggtgcaaaggactgtttgggtcgatcaactagggcaatgagaccgggtttacaaaaccgatggaatttcgtggggttttcgtaaaaccgctagatctcggtttgtgaaaatcgatcagtattagcccgttttcatacggtattgatggaaagttatcaatttttactggttttcggtcggatttcggtaaaccgctgaggagcggtttttctttgaaatcgaaaagtttaaccatgaggcaatgagtagcttgaaatcgaaaagtttaaccctgactgttccttctctctcattgtattttacttcctcatttcaatggctaggattgttccttgctattttgtcattttatggatccaactgccattatttaacagatgacgaagaatccttgctattttgtcattttatggatccaactgccattatttaacagatgacgtggctcgtcctggttgctattgagttttactttccaattagatagatgtgattgcaaaactaatgtaaactaatgttacatctcctatatcacgtgtaaatcaaatgaatagcctacagagcttgatgttacaatacgagcatgccaaacggcctcatggaagatcgcttcttcaatgtttcggaaacgagggcagctacacaatgggatcccgttgctacgggatactttaagtgacttatccctttcctttcttttgtataggtgagattccacgtgtgctcccctggtacctggtaccatgtactagaggtaccagaggcacgatacctatccggttcctactcggtatcgcgcgcgtgatacctctgttggaattaatgaatgggccttagcccactcgaagattaattctttggaaaatcacaaaagcccacctcatgggatggcatgcatgtggagtttagtaccaccttgcttattctaggagaggggaacctccttaaaagggaggatgccctcctagccacttgaagcatgtgtggtggagagaagaggggaaacacgcgcgcgcgctcgctcgcctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcaaaaatcaatctagggtttgcctcctactctgtactgcgccgccgctcgtagactactacatcccgctcgccggcgtgcaccagcgatcgggagagcaagtctccggaacctctgcctttgacgtcctgcaccgggagaaggcggcaataaggtttttgggaagcgcttcgcgcgactgctccctgttcgttcgcgacggctcgcctttctcttcgctcgcgtgtttcgtgccttcgtagacacctgcgaaaagtttcgaccaaacagccggtcttttggtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagattagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggagggttgatattggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaatttctaagttttacattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctaggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcaccgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgtattcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctagatggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcaaaaatcaatctagggtttgcctcctactctgtactgcgccgtcgctcgtagactactccatcccgctcgccggcgtgcaccagcgatcaggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaacctcatcgccggtgtcgctcctctgcagccggagcagcacagcacaggctggtacctggtacctgatacctaatactagctaccggatacctggtactcatacctgatacctggtacctgatacctggtatcagtatggtactaactgcatggggcatggtgtgtggtacttggtacctatagaattggaggattcaagatgataggacaggggaatcgatactgtccatataagctggagaaaaaatcagcaaggaaatcacaagcaaaaaaaatagaaaaatacacatgaggaagggatgcaaagcggctgtgaagcactgccaacgtggggggaggggggtggagaaatcagtcagagtggaatggagtgcgagaggtacctgcaggtatcgaaggaagggaagcaaagtagcggcgtagcactggcggcatgaggaggcggattgacggaggggagtgacgatggaaggtagagggacggaggagctcgcggtcctcgtcggcaggggcgcgacgacgcgagagctcgcacgctgctttgccgctgtgccgcacgttcttgagccggcgggagcagctccgcgcgacgccgtcttccctgtcgccggtggaggagggagagcaagacgccggcgaagcaccgccgcgcgtaagcgacggcgaggacgacggaagccgctggagattcgccgccgccgtgaatggcaacgacactgatgaagtcatctagaacgccaccatttttccaagagtcacgggtgggtggaggaaaatgaagcaggcactaaacgcttctgttcagaaaaacggtttatacactaattaatcgcgtcgctatcggtaattgcaagtttaagttctcccgttacaacggaaagccgtggagtagattctctgttcggaaatctcttctttttcttttcatttcatgcattcatggtctgcgcacagtatagcgcgcgtttattgctagttctgtttaaggcaaccatgcgcaggaatatgcccaagttcaagatttgaatgcaaaatgatcgagataaatgaagacctatctggttcaagctggacgctaaacatgaagacatggtgcttactgaagcagattgaaaaataaatacaacacctatctggttcaagctggacgctaatcatgaaagcatggtgtttattgcagcagatggcagactaagagggcttctgctggtggcataacagcttgacatctcatggtcaaggacgcattactggcccttgtcatttgggggcaaagacctccagattccagctaaaaggctaccatacaccgaatggcagacgctagaaacagcacagggaactgctgtgagaggatttccaaaatgcttgctcgcaagaactacacccagcaccgaattctgcaggcaggaaaatcatgcaaagaaaatgaactgatacatgaatgatggtaagagtatgacatttgttccataggttgcaatgggaaaatgataggacgtatatgtatgcgcgtatggctttctagcaatagttcattttaataatatcctaatacaagcatgagttgcaatctcaattgtaacatggtaagctaaatgtctgtgctttgctgcggataaaaggaaaaatatcacaatattttctaaaataaataaatcatattttccatgaaatatgttacccacattctccctatccacattaattttatatgtggccatctatttagatttagttgttatgtaatattaagaagttcaaggggtaacatgtaaaaattgcagcaggagtagatgaagtggcagattcactgccaccaccattggagtccttttaaaggagtacaaataatgagacttccgttatagaaatactccatccgtcccataacataagggattttggagggacgtgacacatcctagtacgaatatggacatggattagttgcaatgttaaaacaatctggacatgtttattccaaaggcatggcatgacaacaggacaaaattaatatctaagttagaaaaccatggcatggtttagcaacaagccactttttttaattaggaagagaaggaactgtaaatttgcttgtaagttgcaaacaaaaggaagaaattacctgcatgccaacctcaatagagattgttcgtgatgaagagatatcgatgccaatcgttctagaaagaacataaccaaagaaaaagccagatgcatgcaaccaacaaacagacataaccacttgtagaccggatgatagaatggctgaagcattctgtgcgatagcattgccacaaagaacagctacagttgccacagcaatgaatggcatcaagggagaaactaactgaactaaaccgttgcagtactgattaagtagagcaccaagtagcacaggtgctaggacaacctgcgttcatgtatatccaacttagctaggagtaaggaaattcagcagtataacatcagattgatttccagcacctgagatgttgacacaaacaatcccattggatctactgcaacatattgtcccgccagtttggatgtcagaagaggagttaagaactgcatcaggaagttacaaaagcataaaaaagagcttttggagttcagtttaaagataaaaacagatctgagagtggttcattaccgctgcagcaaaagtgcttgctgctgtcatcagtaccgaaagagcaacatttcccctgccacacagtgatgctaatttgtgttaattgtgtgcattttcatgatactaaaaagaacagaaagatgtcctctcatagtgccacaaatttgtccacatattgtgcagttaataatgcatcttctaatatttttgctatagaaatttgatgcaaatgctcaatttcatagaaaatacatttgtgtcaaaagtcaaaggagagaatgaactccagtctaattcaagatacacctgaaatttattactcagctagagaacaggttattttgtttacatttctgttttatgcatcacggggatccactaattcaaccatatagttaggatactggctgctggggtccacttgacagtaagagaggaagaagacagggatactttgggtaattcaagtgataatgtggcaaatgagaggatatccccctagttaccctcaaccatgtggcaaatctgcaaagcacctcaactttgtcgaattctggcaattttccctatttcataggcttgtgtcatagtcagcgtgaaaaattatcaacagattgacacattttccaacattttgtaacaaggccatgactaaatgaagattgctactccctctgtcccacaataagtgcacttctaggattcaaaaaacattatcaggggtgggaaatgacctagatgcccctcattaaatgaggtgattgggagccaagggtgcttgggggtaagatggggagaaatttgaatgatggatgattggaaggaaaagtagtactctagaagtacactctttttgggacaaaattcaaatactagaagtgcccttattgtgggatggagagagtacattaatattttttctcattaccttgctaaatatgtaacaatgttgcttgctgtgcctgcaaagagtatttgcctttctcagtttaaaatctggcaccaatataaacaaaaagactaaagtgtgtgcacacctccagggcaacaggacaccaatatcaatccagcagcataataggatggtaagtttaatagcttgctgatgagaaatcctgacagtggcatcacctgtacataaatcattagctctagacttttggatataacatggaaacagcaaaccacaaaaacatgcataatcacaatgaagtttaaatgtacgatcctctgcactggtagtgtacaaacaaataagaattcgatatggttttttctaaatgcatagcatgtcagctgcacatgataatcttgatgaatgtatagaacatctgtccattgattcaacaaaggatcttttttttgacgaaaatgattcaacaaaggttcctacacctctagtaataggcaagtccaaaactgcagctattttgttttttaattgaaatgatgatctcatggcctgtaaggttatgaaatgaagtggccagcaagtttgggaactgaccgagtattgaagtaaaaacccagatgctaactccttgggcatcaatagtgcagttttcaggtcatctaatgtcaatgtcattcccattcctgaacaaaataaattcaactatatatcagtcacaaaattcaactaacttaaaccgccatgcacaagaaaattcagttcacagcacccttctctcttcaagaataaaattgacaacaatataaggaaaagaatttcatgtctgtcaatgaccaatctatgtataaccagccatctctgatatttgatgtttcaggtgacatgtgctaaaaattactcccctccattccaaattgatctacatatagtttttttgaggttattcctaaatgatctacatatttgtgttcatttattaagtctattcgttatttgtgcattggagtaaatggacattgatgcatgcatccatgcacacaagtacttataacccacatgcaatatcttgatttgctattggctaggaaatattggggatggtgcatgcatcgagtttgttgctaaaataaatatagtatgagagagttattagcttttcttgatcttggtgtacctatgaaatatgtagatcaatttggaacggagggagtatattgaagaaaccttttatgcatatgtagtaaagctaacacttccatcttcaatgttagaaccatcacaaacaaaattgattttttgagtgcaggcatggtgatacaacaacacagaaggaaagtagaaactactaagtagtagaggggatgaatagtacagacccagcatggtaaaggaaatgccgacaatctgggccatgggactgacccagaggaaggccggtggccgccaaagcgcaacggcgcaagcggacgccacccacactgggaacccaagcgacagcacctcgccaacctgcaaaagcagatcccgccaacctacaactccagcctccaatgcaccgctgccacctcctggtatcttggagggcgccggatcagcagccgcatggcacctgctcgacggaatgccacaaaggtgtcgaaccgggttgctgctgctgtatcggatgcgaaggcaggtgacagggagagatgagacggtagctctatgacgggtgttgtgtgtactgaagaggtgaaggcgcttgtcatggtggatcggggtgcggtggggagcagccggcggccggcggaggagaggcatgacgtgggatgttgacctgtcaccttcaacgattactggaaacaaatgtgagtccaagattcagcaaagtatatgatataaatagtgaacatcttagagaaaatagtccatgttcaggttaagcattctcatagccacaaatgcaatgcataagtagtctacatgctcatttgctcgtcccgtcacatatagcatggttcaaatccaatgttcaaacatatgcaatcaaccaaccatccctcaatccctggattcaaatggtaaaaaaaaatgctcctaatccaaaatcacagcactacatacagtaggtcagtagcagtctagcaagacaatagttagtactagttacctttggccgttgggagttgggacttgggcgtctcggcctcttgggggcggcggcacggcgcggcgcggcgcggggtggattggatacgaggcgcgacggcgccacccaaaagacgcggcgagccggcgacgggtgacgggcgaccaccgacggcgcggcggcacgacgcgaaggcgggagggattggcggcggcggcgtcacggacgcacggcacgtcggcgtctcggcgtcggatgggcggcggcggcggcgcgtcttcctgtcgagcgtcgagaggaggtggagactggagagcgagtgagcgaccggggatctgggaatggggaggagttgggggcaaattctatttttggtctttctttttttttctttccctaattgggcttatttataagaatggatatttttttaaagcatatactcctactaatagtatatttataagaatggagtatattggaacatatcaggatataacatatcctatgtatacaatgtgcacaccacatgcacaccaattagcaaatatcacgaaaaattctaaaaaaaacatttactcctaatagtatacacatatatgcaaagtctcgtattcaaattcattatattttagccgtaataaaaaattaaaaatttgatagtttaaggcgtaaaaatttgtcagaattatatcttttttgttactgctaaaatataataaatttgaatataagattttacacgtaggtgtaatactattgaaaatatgtgtccaattttctgcgacatttgctagttaatgtacactggaagcttgtatgcataggatatgtttacatgtacatatgaaatatatatacttcattttcacgttgctgacttcatttaccatgtatcatgttcatggaacatcatgaaggaataggttaagccctctttgtttacgtttataagtcggcttatgagttaaaaagttcaagtctaaacaaataagcagttttttcgtttggttttttaaaagtcatcactcttacactatgaagctaaaagctaggttggagaagcttttttagcttatttgagatagaagtatgacaccacccttaaatttgggactttaaatccaccagcttataaatcatataagccaaaaaaaactaatataaagatttaagccaataagtctaagcctaaacaaagagaacctaaatagacgtcctattttagagtcttgttcttattggagaggagacgtaggaatttggtcaatgctaggagcttgctcttcatctttgtcatcagatgattgcacaaccagtttatgtttctttatctcggccttcttcatgctttgttcggaggccaacctattgttctcttggggggtggggggttgcctactgaaggtcctctagcagcctatccggcgccgctaatggttctccttggcgagtgatgagtaggcgtaggagggtcaaagattataagtttgttttcctgcacaagtgaattttgatggttcatatcgataaaaccgttgaaacatttggattatagacagggttcaaagctgcatactggaggaggagggttaaataagtgaaagggcaccactaggagtttgtgagaaacatctacggtgatcccagaggagaacaccttacatcctcttgcatacgagttcatagcctagttattctggatcttcttggtttggatccttttgaccctggtattcaaatgttgacttggctctgtctttgattggagccagtcgacacttgatgaagtgtcaagtgacttgttcttctactataccttttctcatttatggcatttattttggagaggaatcctttctgcttcggctttatcctggccttcaggcatggaattccaatcgaagttgtagattggaggaagaccgatgaaatcaaggcaagcaagaagagggttggagatgtagaaccaattttgtgccaaccattgttggtggacttcaagggaagagcgagataaaaatttccggaggtcaccacacaactagaatttggagctgcctagtacacaaggattttctttagtgggtcgggttttcagagagaacatataccggaagaggcagggccggctctacatattttagggccctaggccaactccatgacatgggctctcaggcatacactctcactatatatacacatatttgttttgaaacactctctctctatatacacatatgcactttggatttttaaagtatacttttaaagcattcatccgctaatcacgctgaaaataaatatcgataatatcctctatatatgttgctaaaaatacaaaaagagcattaaaatggaattactatggttaccttgaattcttgactaaggatcaagctccagggacttcattaataatacttgacaaaagataagatgacagacatccatttgcttctcataaaaaaatacttcttcgagcatttcttgatgcaaaatcattaatgacggtatcgagaccaatattgtccaagacattcttctcaatgcagcacatagccgagccatttaatctttcttgtgacatggttgatctcaaatagtttttcaataactttaattttgagaagctttttttttcagctgaggctactgtcacaggtacggttaagatagattcgataggcaactgaaacatttggatagcaatctgcagctgtaatgaattcaagaatctcaggtacactatggttgcagcacaacagtgcgcaagtacctgtaaattgaaacctgcagacactctggaagttgaggcagattcatgttgtgtcggccgatgtcgagggcgaacagagtcaacagacaaaggcataaagctgtgaagggctaaatgctgaagggatcgccaacggtccggcgtaggacgaacttgtggaggcgccatggagagcgctggaggcggattggcggagactgccgccggcagaggagaggagatgagaagacaaaagtttggaactcggacggtcgcgtatgcccggcgcttatgcgggcaacgattcgaccagaaacttgtatacatgcatatggtatacctaatacatacctaggtctggacccctacttttcctaggccctaggccatcgcacttcttgccgtagcccagagccggccctaagaggttaaaatgcgtcacgattctaagaaatatctcgcacaaatgaataaaaatggcgatatggagaattgaattgggatttagataataaattttt

SEQ ID NO: 69381 - DNA, 8561 bp, Oryza sativa
cgattgtggctgcaagcatctctgcccttaagcgtgtcttcccaggaagcctcggctgctctccaggggggtctatttttttccccaccggatgattcatcccccagcttctctttctgcatgcagtccacacgcttcctccgtcgatccatccagcgccgccgccggcatcgccgtctcccttgcccagtgtgtttttgcgccttctttggcttagctgtggacggccgcggtcttctgctcggtgatttcgtctccaccatctccattccatctgtccacggccgtcgccatccacgagctgcagcagcctctcctctcccagtgacagtccactcagttgcgccaccaccgacgaccttttgcttgaccggttggttctccggtggccatcgccatcacgtgagggagcaatgccctctttttcccacggcagtcctggcaagaaaatccttctatccccactgttgtacagaagaaacccttaggccccttggaaatgtcgttctttgatttattatgtaccaccatgacagatttcccttgacctgtatttttaatggtgcaagttacttattgtcaagcatgtgattcaataatccctactaattaagcattttctaattgaatttgacctgctacagtggttatgggatagttgcctgctgccccaagtccacaacatacacatattaaaggtgtccatatttagattcatgcttagctttccataatactccattgtgtactcatctgctggctttatgattttgttttgccattttgtataaatatctaggagtggtttggtgattgggatggatgtggtgcctgacactctaacaccaacaccattttctcagctaactaacttagggacaaatgagacagagaacaggctaggtgctactcctacgcattattcgcatattcaactttctttgcattttctcaattctcaactacagttttcttacgttgagcggaaaacttattgatgatttatttctttgtcttctaggtgctcctaacagtgaaagctctaatcataccatatcttttatctcaactcctgaaatagggatctccatgtcagtgtttcgtcatccatttcgatgacctattaacaggaggcttgcatttaaccctgtcaatcctgctactccaatagattaacactttgtctcctcattagatggcccaacagtgccaggtgttcagtcccttcctgcagtgcgcggtaaaggtaagcccctctattaagaattactctctatgtgattgtgctcaaacttgctatactaccattgtaccattttagattcataaatgccagttcaggtacctgtgccatagtatcatatatctatatagaagataataatcctacgtacaatttgcccatgttaatgtactaccttcgccccatattacttgttgccttgagttttttttaatgtttgattattcgtcttattcaaaataaacttagaattattatttattttatttgtgacttattttattattaaatgtagtttacttatcattttttatatttgcactaatttttcaaataaaacgaatggtcaatcattacaagtaaaaagtcaaaacgacaagtaatataggatggaggtagtattgttcctagctagggctaaaaatggtcggaccatataccatttttattttcatactgttttctcgaaaacggtatcagaatggtagacacaaaaatactaataatagtcatataaatactaatgatagttatatcggtatatcagaaacgggactgtcggaacagaatcttcggaagtcgaaaattcatgtcaaaataagcggagtatggcatagcacacatttaactatgcatgcatatgactttataatttcattcttgcatcatcacactacacgtgacaccgttatatgatgattaatgatattgatgataagttcgatgaataatataaacaaaattcaacgatacatcaacattgataagttgaggagaccaaagttcagcaaaatccacgtaccacgtcctaggtttaacagcattttcccgtggtcacttctgctttctaatgggctaaaagcttgccaggttttcatcattcataggtttccaataggttgggatggctgagccattcgggaactttcggcattttgatgaaaattaccagacaaatatggttactgacaaaacagtgagaaaaacctccatccatttccgctaccattttcgaataatattaagtttctatttccaacaccgatagttatcaatactgactgaaacgatcggtgtaaactggaaaccatagccgaaatctcggaaatttccgtaccgttttcacccctattcctagctaaagcacatcactatcgtccgtctgatccaccgcacaaagagcgaaggagcgatctagccatccgttatgagagcctacctctttcgtgtcgatcccctcctcccgtcgcagaaattgccactgctatggccacctccgccactgccactctttgccagcgtggtccttggttgctcctattcatcttctccgtcgaagcagtgtccatgccgaggggtcatcggcacgggcgatcccctccttcccttgcagaaattgcagcagccattattgctgcctccatgtcgtcccaatcgtctacccccacctccacggcgctaacgtccatctcctctaggccgtcgccatcttccgctcaaccctatggccgtggcctctaagactgccgctgggtccgtgctactgttccgcctgtaggacgaggacctcaaaaattggcacgctgacttcgtcaatgctgactagccagcctcttcgactcctcttggtcaatcctccaccataattacaattaggaaatgatgatttcattaacagtctgccacaatattgtagtttgtcttcttcgcaagcagactagctagaagaagctggacaagaggtcaataaataatatatgcaggagtgatataccaaacggtattatttgcatgtttgacactacaggttcaacatattattggataacgaccataaacatatgaaaagactgacttgcaaaaatggcgtgccaatgcgggtcacggacgacgttgaaccgaacgagagtacgagacaaagcacagcagattaattagttgtcatccactgctctggtggaatatccgagctagtacagctaatatgacaggaccaagtgaataaccggtcctagtattttttttcttaataatagaatgatttacaaacctactaccttcatctaaaaataaatcaacttttatagttcgtatacaatagttgaaaaggagtacaatgaattctgaaactgaaatgaaatatgtgaggttatctggcaaacctgctgtttgatgaaaacaaaacaatgaacacatagaaaatagggaaaccctgtattttattaatcatgattcattaacatgaatgtttacaaatacatgagggctcccgcaggagttcgccttttgccttcgcgaggaatgcttaatggaaatgtatgctgactggagattgcgtgtagtccgctgattcccggcgcctagcaatgagactaccggttaattacatccacaggagcgagcctatcgaacacctccgattaagctacgctttatgatcgtcgtcttcaaagttgtttgctcgccgaaggttgaggttagtgcagacttaatgttgaatatagtgaatgtggaacgggtggtttcgtttcgccaaaacctggtcacagtacactaccatcacgtcggtgtgcggagggaatttggtgaaggggtgacctttgcctcgtcggtgcccagtcatgtaccccggccttcatcaaacatggattttgtggttgctttgcctcgtcggtgcccagcaacggtgtatccggttcccgtccattttagacgtgttaataatgtagtgacctggccttgtcggcactcagccatggtttcgtctagcctcatcggttatagacaaatgaaatgagtgaatggctatagctttgttagctttggccaatatgtcgtccggcctcatcggtctcggacatagcataaataatgataaatcggccatttcatctcgtcaacattcggccatgatgtcgacgtgtgttttaaatctgcatgccccgccctcctggctagcattgtttttgttgtcttcaagaattttgagagtcaccccatgcatctgatagaatttagagagagaagaaattgctctcgtacatgacatgcacgaggcaaatctataactctttcggcatgaatataaatatatataaatcatggttggtccgatgccaataattaaggctcaaacttatcccaagtttatataaataaatatccacatccaatatttgatattgataatttagacggtccaaccctcacgagggtcaggctcgccttgtatttatttgcagctcatgttaatcgcttgacaaagatgacgtgtgcgtgtgcatgcgccgctggggatacttatatccatggctacaagttcacaacgcatccacgacatattcatcagtactccactttactgttttaccgtctcaactgtgcatctacacaatgctacggtgtatatttgctccctctaagagatgatgccgggctattaataatatctgcacagcactacggcgttgttgtgttatcttggataagcagcttgatggagaacgagatcagcttgttgctgaagactcgccgatagaggtgccatcagtgcatgcatcttgttgctgatctgcgatcacgcaccctgtgtcatgcgcatgcatcttctttctgatctctctgtgaatatatgtgggtgcgggtgtgtacctatagggcatattgctacttaatggcgcagcgcttgcgccctgtgtttctctccttctccttcacgagggacggagtcggtgccttttataggcagagctaacgatggatggatcaggctgagactctcaaccgcgtccgcaaatcttgggctaatcacgcttaaatatttgatctcctccggataatggacatgcttaacaaacatggtacttaattagcaagcaaataatacgctgatgacagtggccctggacatcatttgcacgccttgggtgtgcttgccgataatctaaatataatcgtcattaatctgacgtgattatcaaaagcaaccaaccaaccatatggctagcactagtcaattttctcccccatataatctttgatagctcatacttttcatatgatatatcctattcaaaatccgtttgtacttatggtctctactcaaaatatagaacaaaacgagtccaatattgattatatttggatgtagcgtgatatttgaatttttctggacccatacatcatagagacacgcctcacatgtattcagtaaaattgggctgcgaataatattctcatataaaattaatgcccaataatttattatttcttctatgaatttttagcacaaaaattcatcaaacacctggccccatctcccaccaaatggtaaccagctgagtcacttaaaataaaaactagagaaactcggcaagaaaattctatagaaataactactagaaaaataatttttaccgacgttggttttttacttttccggatggaaaaaaaatcctcttataaccgtttgcaaaaatagctaaagagcctctagatttagccccgcctgcgaaaatcatgcagcttctattcccatcaacccggagcttatttcggtatctatggagtcacttatcatagaataaatatgcagctgaagaagatccctggtcgtccagctttttcagcctcatgcattgctgtatttgatctcgtcctctctgtgtgactgtgtgcatgtgctgtctgtgggtacttggtttaatcctctatggtttccactgtctggacttggattgccatgtacttgtgtgtttgattgtgtgtactgctccagttatgcatgccattgggtggtgttggatgtagggtgtgttcagtattcgcctgcgtgagcatgaacaccactagtgctttgtattatacttttactttgtgctcttctcagtctgacatatatttgtcgatcacagaaaggcatttgatagtataaaaccaatctccccaacaaagatggatatccatttgatattgaagtagtgagtttaaaaaatgaatttattttgggataaataggagaggaaaaacaaacttattctcacacataggaagaactcatgaatacatgatagtaaacctagttatattttggattcatttttcttattcttgtgggcctggtcttataagtctcatcttctaattgaccatttggaattgttggaatttatacgcagacgatgcagcggtcttcatgaacacgaccaagagcgatgtaagggctttcattgaccttctgactcgcttcggcaaggtatcgggtctttgcacaaatctgcaaaaatcgcaggtagcgccaatcaggtgtgatggcctggaccttgatgacatcttggacggaatactagctactagagcctcctttccagtaaagtacctaggactccctctttccaccggaaggttgcgtaaatgtgacttccagccgctcttcgacaaatctatgaactatatagaaggatggcgagggaggcatgttggtctcgcaggtcgatcaaccttggtaaaagtcgtccttacgtcccaaccaatcttcctgctgacgggcttgaaagcatctaaggaatcccttgaaattctggacaaacaacgaaggcaatttctgtgggttgggaatgaaaccgtcactgggggaagtgcaaggtaaattggacgcgtacctgcctacctactgcctcgagagggcttggcatcctaaatctcaagaaatttgcaagggccctccgtctgaaatggctctagcacgaatggaagtcaccagaaaaggcttgggtggggttagaaacgccttgcgatgaaacagacatgctgttgtttgctgctgcaacaacaatacaagttggcgacggagcaaaagcaagtttctgggacttggcttggctataggggagaagactaaaggatgtcgcaccactagtctacgtagcctccagaaaaaagagcaggactctccaacaggccgctcagatggaccaatggctgcttgaccttgctctaccaacaaccgaagggtggacaacggagctaatcgaccaagtcattgccgtttggagcgccattcgaagtgtgcaatttacggatcaagaagactagatcacttggaagctaaacaaccacggtgaatacacagcctcctcagcctataaggcacaaatccttggtacaacatcgtcaaattttgacaacctgatttggagaccttgggcgccgcgcaagtgcaaaacctttgcctggttgattctccaaaacatagtgtggacttcggatagattagcaaccagaggctggccaaacggatccacatgcccgctatgtcgtcagacccaagagacggctcatcacctgctagtggattgcagatacactcggagaatttggaatgaaatagcacattggactgtcaatggacacctaagtcctcaactctggtgagcaacgtctacgttacatgagtggtgggaggccatcgtgagtacaagagaagcaccaaagaaggcactacgcacgttaactttgctaatggcctaggggatctagaacaaaagaaaccgaaggactttccaacacaaggagttgccggcatcaaatctattatccaagataaaagaggaagcaaaaacgtggagccttgcgggtgcgagaagcctcgctgcctggctggcactgtaattagccttttcggcagggttgcagccctgcttttgcttttgtaaagtttccttttgtacagtttccttcttctcttttcaatgaaattggcggcctcgatgattcgttcaaaaaaaaatctttcttaatatcaacttcttttgccaatctttttcagcctcttctggctgtagtggcaacagatcttcgctcgatgtacttattgtcaaggtctgatttttcaacttgaagctgtatacttttattgtgctctatccttttgatgtaattttgtagttcactcgtcctttgattcaccgtgtatcacaaaatatctccgtcttttatcattgttatactcagcttgcttcctttttttagtatagtttcatcagtacaatcttccagttgaggatctgttgttgtttaccaggtgtgcttgcttttatctcaccaagttttcttgacaatctttttcctctctttttggctgatatagttccatgcattgctattttctaattgagcatcaacttgtttttttagaaacgcttgctttttttctcaccaagatttctagtcaactttttccctatccttttgcatataatcatctattataacagcagataaaatagaaatacatataatcatccaatatttatagtgt

SEQ ID NO: 69382 - DNA, 737 bp, Oryza sativa
ttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaa

SEQ ID NO: 69383 - DNA, 1320 bp, Oryza sativa
caattgcgctgttgctggatttgcgtccgatccagaattcgcacactttcgagggtacggatgaagtggttttctctttggcctaggtggagggatctcaatcgcattattggaaccgggctcacgcaccacctgctaaataaagcccccgcattagaaacgtttgagcatgccatttcaagtttactgttaccaattctgctttacaagcacatgtaatatatatatagagaaaaatatagcatcggcagtgtagtaataaatcaatcagattgatcaattggtacatgaaggattattatatcacctttgagaaaaacttctgggcatggctccgaatttggacagcagtctttgtgccaatgtgctctagagaacagcttggacaaatcagacatactactcactgaacttgtttaaagcctaatgtaaggcaaaaatatgaagagagagagagagaggccaaaacgcaccttgtatctgacgccaagagcgaccatacagcttcaatgcctcaaggaacttgtcgtgctcttcttccgtccacttctcccgctgcttggtgatcgtgtaaggcttccgaacctgcttcaaacattgggttggagattgttaggtacagtgacaacgctgtaagctagaagtacaattttttctgttcctctctgccagtaagacatgctagtgaagaaggatcggcttgcatagatgtcaaaagtaccttgacagggaactcctccatcccctcgttgggctgcattgcagttacagttgcagatgcatcattcatcatcaagggagatttgacaagatccagcgacgggcctttgttgattgccaaatcggatgaatccttttcctagatggccaggagaggaacacaaagttcagtgctttagcaaaagcatacacaagtactcgtataatttgcaattgccgcagacagtttacaacaacaactccgtagttactagtaccacttaccgctgcaaagggagggataattactagtaaaaagtagtagtagaaacagaattgctacctagtgtagtgtagtactccagtaagcagaggcagaaggatttgttaattgaggattcgtgccgttattggagagagagagtataggaggagtattggccatcccatgtcgttctggaagcctctaaagatagataattatgacgtgtatccgccccagaaccaggagagaagcatctagaacactcccattttttaactaaaaaattgcaatacatttggttttttaggcaataataatggatcggtccaagaaaaatatatttttgcaaataaaat

SEQ ID NO: 69384 - DNA, 13703 bp, Oryza sativa
tgtcccttctcctcctcctcttgccctcttggctccagagggttccagacaataaaaataagagaaagatctgctgcatgctatcacgggcccaccctcaccttaccttggccttttctcatcttccttacaaaaaaaaaattgggttttgctgcccaaaaatccctggccacatgtttttaggaggctggcttggatcctactgtgcttcaattagtataatcccgagcgattaacaaatgattgcttctagttctgtgctcatctaatctgcctgtaatttttaaagatctataagctgcgtatcactatagcttttaccgcccaaaacttgcttatgccctagttcaccaattactagctccaagcaactccaaaattgctctaaacatgttctataaagctaaatatcgacaactaagtaaagtaccacgtctctaccaggtttccaaacagttggattgcctgcggtactggtgctctagcaaacacttccgcgtggccttagacccatatgttagtcatcgttattgtatcagtagtgttacagaggatatatgtctgtttttttaacacaattacgctattgtaagtaagaactagttggaagaggacctacctgccgatgttgtgccatatttcaaagtttttagaggaggggagattttttaacttttttttaaggatagccctgacctaaacttttgagagtcaaatgttatgtcaccactagttgagtttggagaggaaggcataaccaccaaggtcaactttttaattttaagaaaaataaaaattttactaagcatatgaatcaacactggagtattttcttagcaaatgaagctactggtaacaaaggtgactataatgggcaggagagttgagtgcacgtcagacatattaattccatggggcaatgcaaaaaaaaatcaacatatacatgtgtggcctacattatattgcgttgctttcagtattccttcttagtagtagtattaaacagggaaataacgacggcccggatggctttccttgaaagaaattagtggacaggagcatgaccaagttgctgactgtattgcacacaaaagctactacactagttgtattagggagctggctgagatttacgatatgcttgtcggaattgaacaaggtgctcatgacagggatgggtttgatgctaatcaacaataatatccaaccccctcaaacaaggtttccttctactatatctttttttttgggaaactaattgagccaagctcttttaaccactatgagtaagtaaagggatgaagtaggctaaatcatactcacagtgcactccagggagctaaatcaactgctaaactacagcacaaaaagcaataatactgtcaacgatctctcttttattttatcagtattggaagaaaaatactatcagtatgaagaaaggttgcagagtgtttgtatggtagcggaaatatctagcggctgatattgatcgagttaggcaagaaagagcgtgacgcggctgctacggataaacaaatgcaatgggccacccacaacacaagcaaaccacgcgtcccctctagaaaccaccctaaagattttcctccccgataatccaatccaatatgcgccagctgcaagctctcacgccagccactcgctcattttcttcccttcctgcatgccatgtcctcttctcttctcttccctctatgcttgatattattagtacagctcaccagcaacaggttcacttgaaaagaaactccactctactggattttcctaaggccccttctattcaaagaaaattcatagaaattttaaaggattttatttctatagaaatttttcctatatagccatttgaatcaaaggaatgaatcctatgtaatcgcatgaaattcctatggaatgcctcttcccatgtaagttttggaggaaatttagaatgaggttctacctcatgttaaaaatcctttgagtctttatctctcctcaaattcctgtgtttttcctacgactcaatcaaacggtcattcctatatttttcctgtgttttacaatcctctgttttatacttgtattcttgttagaattctatgtttttcctattcctcggtttttttattcctgtgattcaaagaggccctaagactatacttctactagcactcagttttcctttttgaaagcaaggcttaattggttaatcattattagtactcctgcctccaaagttatctgaataattaagctatttctaaactcatatatggatcccacttgacagtcgcgagccacatgaatgatggtgttggcccgttttctcaatggcggcagtaccagcaaggccgtgtttagtttcccacttatttctaattttctatcatatcatatcacatcaaaaacttttctacacatataaactttcaactttttttttaaactcttaactttcttcaaactttcaactttttttaagaactaaacacagaccacataatgggacgagatccgctaatttactacagaacgaacacagaggagaatgagagccacaaagtgcatcgtatcgtgctagcctctttctttttctgctcccacagtccacaccttgatttgttcttttactattttgatctctttttttctaattatagtttgtgtctactatgatctaatgtttcttccattttgcgtaggtgtgaacatcaggcgttttggataatgggttacaataaatagaaggtcaggaaaaagatggatggttcagattaaaactttttttaatggtaaaacccatgcattaaccaagcatgccctgtccttccaccagtggaacgtgaatttctgtaatgtgcttacactaacatttatgcttctccattttttttagcaaataagtcaccaccacttagctccaaacatgcatgtattgagcagtaagagcagtcaaaacaggcggtttagtaaccataccgtcatcagcgtagggctgtagcaatttagcggtgttagttggagttgtgggttcggtggttggtgcacttcatcaaagcagaaaaagaacatgtatgctatgcatacttggtcagcaatcgccgcgtacattaccacccactcaagcaaacagctttcccatttgtctgtatcacctgaaaacttagtatgtgcatttcctttttcttcttttcttggaggggagacacatgcatctgcctgccaatgatccatgctcacaagtcacaagccgttgcccaggagcatactccactttatagcttaatagtagctttgctctctttcttttttccctggaacacatgagcatcgtgcacaccacaagaacatcaaaaactgctctgatgccttaagagatgcaagagcaggatctttaaaacatgatttgctcccacaaacattcaatcaactctgttcaccagatatattactactaacccagaagacatctctaaattagatgctccgatttgctaatgagcgatagagatttacataatggagaggtgcgaatgttgtgaatctgcagatacactgaaacatgctgatacgctagcttagcgtacgcctcccccggtctctgaatctggtgacaatcagagcacacgcaaaactgggggcggatactcctactaggataatgcatactactacaacaattggtttggggggagccctcgccgctcagtctactccttgttccgggttgatcggtctttcttgtgcccgccaaggatacgggagatctgcagacctctgctgaaggcctggttgaagagcatcctggtctggaactcggacacgaaaggaaaccaagcaaggaacgctatgggtgtgaataacaggagtcccattaggatctcatagccccgggcaagagccttgattgatccccaaagcccaatagcctggacagcaggtttgatggcttgcgcaatctgatagtgtgttttatcaagtcagacattagaatttctttccaaaccaaaaaaaattgtaataataggaatgataggagacaggtttagttgctaaccagaagcaagccccatccagttggcatgaaagcaaggatgcaaacgaagatatcaagaactgtcatgtgagggatggcaattaatatcacaacaatggcgacaaatgttatgaatataaggcccttgatcaaccggaagacaagctggaactccgcactgaacctcctcctaccgactgaaacagtctggaaagaaaatcataactcagttttccagacaagaaaggtatcaagcactgatcagttaaacttcaaccgtaaaattctaatataagatacataaggagggcaaagtccatatggattcaccaagagctaaggaacaggttgttaccttcatgacaagtaaaattacgaaaatcacaacccatgaaaagcaataaacctgcaaattgcattaattagaagaactgagtatgaataaaacggatgtgaccaccaggattaaaaagaaaacaagggacaacttaccagtacactgcgagtatgcttggttatattcaaatgatacacaagcccatattggtagacaaagaagcgcaacgcgagcagaatttcaagaatagtaccacgctttccagagtatcgaagaggctcctgctctttttcccaccatgattcccaactttttgttggtgctactccaatacctccacggttgctgatccacttattccaatcagtccagtcatccacaatcttctgccactcaaatccagaaggattgaataggaatggtgcaaagagccaggtgcccaccataaaccacatggaaacagtgatgaaaatgtatgtgatagcccctctgtatgattgcccaaagatttcatacacaaccagcaaaatcatcagctcaatacccttgacaaaatggctgcgagaataaagtcggtagttgtcagcaaacttggcatgaaacaccacaaatccacgcccagtggctctatattcagctcctccgtggagtaatgtccttccgtaataatgagttttggtcccaagtgaaaatgtaaagaaaacagatgccaactgaagttgcataagtacaaagtcgcttagtgctgttctgaatcccctctccagaccaatttccatcatcatgggcaacgccatcaaaaatccaagttgaacaaaagactctgatgcaagagcaacttggaggggtgcattatgcacaaacttctttccagtggctagtgcttggtccagtccactgaggacaagatataagcgcccatagaggaaaacatatacagtccatactgtaatctataacaccaaacagagaaacctgggttaagatttgaccaacatatcaaacagagagaagtagagtttatatgccataccattgtactaaagtagaagccaattgttgtgtaatagcatgacagcattctgaagaaatcaaaccggtgccctagtcgataaatgtcacggctcagtgtttgttcaccattaccatttgctatctttgcctcaaacagagcaatttggttgagacccacatctcttcccttgccaacttgcatgtactcatgatgagtgacattgccttcacgcaatgttgaattgaaacctgcagcaacacaagtcacattaacaccagagcagttccagattccataaaataagcatcgatagggaataaatcggtaccggcaaatatatcttcactaagattgataattttggatgctttacttacaccaccccttgtgaggtggaaaagacgatcaaagatatcaggatggccatagtggaatcgaaccctgcagattgatgttcagaaagaataatgtcagagatgagcatcagcaaaccttgaatcatagttattgagactagaccagccatcgaaccggtcaggtcctcggttcgatggttcactggtttgaccggttgaaccgtaggttcaaagtggttcaataaggttaaatatataactgattcactccagacacaaacaacagcatggcttggtggttggtgcgccatgactccattcaacccatcctgggttcaactcccaccatacacccctttttcctatattctctcctccttctcatgcgtgcacgtggtctggcagagtagcagctcacggttgagcggtcgagtgctggttttctgaccggcttttaagcggaaaccgggcggcccaaccggtttataccgggtcatttgcacagacggtcttttaactggaccaaaccagcggaggccctggttccagttttttccggtccaaccgccggtccagtccagtcctaataactatgccttgaatcatgaataatagtacttcccacctcgctccttttgatttcacattttagaacccaactatcagtatgtataaaattatcaggactgattgtatgcaaattatattagtatgttcaccattaaaactgctttcagatattatgattttttagtatatgttagtgtaattttttttataaaaaaagaaggtaatgctcaagttacatctagagagccatgacaagtcaataatttcaaacaaaaagaatgggatggtaatatatttgaaaaaaaaatgaataagcaattaatgtggttatcatgccatgacaacgcaatacctcagggggttggcaagcacacgctgtccaatagtcacaaaactggtctcctgatttgacatgaaccatgcaagggatgaaacactgcacaaatttaacaaaatgaaaacaattgagcaaattgaaggctagataatccaaaatgatgacagaagcagttagttacaaatgaagcatgccaaattacctgccagtaaatatatgctctcttactccaagtattgatggatatctcacaccatcatgtttcttcagaaactcatccagcagatttctcattttcaaagcctcctccatataatgctcctgttcgatagtatgacataaatacggtaacaaaaagctaaaagaacacagttgcttgaagcagcaaacacaagaaacttacctgattcatatctatagtttggaggcattcaccacgagtaaaaataattgcatgattctgattttctggttttccttcacctaaaatagcattacctggaagttttatcttgtatatgacctacacaagaagtgatggcaattcatcaaattttgcaccaaagaggctgacaagagaattcccccaacagaaaaaaaaaagagcagtgtaaataagactaaggatatctaaacgatacaaagtatttctatactcctttaaaagaccccaatgctggtggagagtggtgaatctgcccacaacccatcaccactgccatgtgggtcccccaaacagtgaggtatatggaccttcccttccccaaactcaagccatcaaacaaggaaatttatttaaattgagataaaaatgatgacgaataatatgacctaaagatttttacaattagaataattttattttaatttttgaggcttcaaagtgtacggcggggttctcttttttaattcccgtcgcaaagcacgggcattcagctagttagaacaaaaaccgaaagatcagactccttccagcttccatacaatcaaaacaagtactccaatgaaaaaaggatcaacatcagttaattgtgcaaataggttcacctcagcacagcaaaaaaaaaaaaacaaaaaaaaaacataatttgtaaatgtgtgctgctaagctttagctctgcagagaacaaacatgggaattgtgtatcgaaaaagcgttttactatgccagagccaacatggggatcctttacaggctacagcgtgtatacttgatttagatttccttttattatacaagggaaaaaaaaggaagccttgactttatctccttccaaatgggataaaaaaagaggaattggtcaattaacctcaatcaaagtatactgtaccattttcacctaaaaaatacttcctccaatcattaatacatgcctttttaacactaattaatggccatagggagtacttattttacatggcattttgacttacctgatcaagactttgtcctggttcattaggttttgtaacggaagctttcaccaatgctgagtagtaaactttgtcagtcttcttgtttctatcttggctaggtgcttcaacctcatcaatataagcaactcgaagtgatggatatctgcaaaaaaggaccatttctacaagtgtctgacactgaatagacagcaaacggaacagtgataatattaagctgcggatgtttgtcctgactcctgagcaaatataatatctaacatgtcaagctttgttttttgttgtttcttcaatagatatgaaattagatgatacaaaatgttacacatggtactcccagcatagtaaataaacaaagcttacatttatttcattactcgctactaaaaataatgcacatggtactcattgttttaacccaattcacatatactcacagaaagacactcgattgcactgttgcactaagaacaatcatgtgtgctccaacttgattgcataaattataaaagaaataaagcaagaaaaaaaaggcaatttgtgctacatacagataacatatatccagatcattgcaatatttgattaaaacttacactatcacaacagctctcctgcgcattcaagggaaagaaaaacttacactgtcattagcctcaaaatatcatgcgcacaggcttcaccagaacgtttctggattccatattgctggcacgagacaacatatgtaaatttcatgtcagctatagctttgcattgagtcatcaattgcgagtcctcagacatcagttcagttgctctgtaaccttccataagatctaatggaaacaggaagatgagtcattgcataggtcacagaggaaagttcagaacatatagactgaactattagaaataccatcatctttggccatgtcaaggaaagcctgaagctccaacgcttttcggtaggacatcattcctctcactgtaaaaagagcaataatgacaacataaatgagaatagtacgaagtactttcactgaaccactacacatgatacctttgagttagattttcttgtgagaacaaaatataaaaggaaaacatgaggtggaaggaaaaagaatccagttcttgtcaatgtctgtcccctatatgatgcccaaaggcgaagctcctcttccaatgtttcatcctcacggagctcctcctcgctcttgcggtccaccctatcaaggaaatttttccattcatctttgaaaattcaaagagattaggaaacacgatattaattatgatggtcatcaggaaaccaaaggaaatgcacatgtaccttaatccaagaaaagaattgcataagggaggaaagaacctgggtagattttttgtaagtagaaaagtatggaaaccccatcctcatttggctcttccagattatgagaggagaaaagaacatcttccttgtaataaggagtcaagacactagcattgcagaaagttgtttcagcaatcaagaaacccaatcaaataattttatcaaacagtacagatgtctagttatcaaccaaataaaaaaaacataagatatgaatgtaccaacagcaagaacacatactaagcaaagaataagcatggagagtatgagatcaaaggagtcggtgccaatttgagcatgatattacaacacacttttgtctaaaaaatattacaacacacagaaaagtagtaatcaaaacttacgagaagggcaacatatgccgcacttttggagcattaggcatctccataaaaagagaatttgcaaagaacgatatccgtctcctagcatcaaggttcgtagggacatccatagcagactctttcacagtgagaagaaggtgaagcctctttatctgattaaaaatgaaacaaaagtatatatcattatagcaacaggaggaacacgagcatcatatcatgtattcacttcaattaggatataaatcaaaccttttccgtccatgcatttgattcctccacggggaacctaatagctttagtgaacaactgatcttgttgatcaagtgaagtcattccttcgtgttttctatttccaccatgtacagaatccaatagtctggaaggaaaggaaaacaataatatacataaaaccaccgcgcaaaataataataataataatatatatataaccagttaccagagtagttcaagcaaaatcaacaaataatctcaatcaccatactcttatcagcaaaaggaggtacattaatcaccaaagttcatttagagacgttaataagactcctagtattattaaacaaatacatggaaaaaatctgaacagtgctggcagagtatcaatcactccatacttccatagaacaatcagtattttcatttttctaagtgataaatttaggcagcaagcagatgtgttagacaacaacagaatggcattaactaaaaatatgaacgccaagaaagacaccatgctattatctctgtgaaaataaaaaaaaaaagataacatgctgttatgacagaaccaagctatcctcacccgcctagctggtcttgctcatccattatatcccttgtgaccacctcaagcatatcttggaataaaatgacaacttggcccaagtcttcttccttattcttttgctgtattcagaaaatggatacagtgagcgggtatcatctatgaacgcaaattatagccatgataacaaatttttataccagtaattcaagtagttcaatgaacttcttgctcagggcaggaaggctcctcatgttcaaatcctttattagacttcccccttctatgtgttcatcaacaattgtaaaaatctgctgtattactctggaatagcatgcacagattaagtcagaaattcaagagaaccaaatagaattttgcagtagaagcaaacaaaattgtcaccagataatattacatacattttctcacgttgaccaaacactaaagtattgatgatgtttttgaatgaaccatagcactctctgatagcataggaaaaatacggatctgatcccattctcttcttcagatcacgatcttttcctccactgtctgccgccatatccaatgctattggaatctaaaatccagtaaatataaacagtaaatgcctgaatgcaccaataaaacaagcacactttagaaaatggtagagaaaacaccttgctagcaagtaggaaaggtggccactggaatatattcaattcacggtctttacagtatgggacaagtagcaagtccatctccctgttatctataagatcttcctcacggaaacttgtgataattaggttccacatttgagcaaatcttgcggctattttctctttctcttgctcatcaccagaagtctaaaaagaggtatatgagatgaaacagatgatggtgatattacttcaatacttatctgtcaataatcaactcatgatgtcaagcttaagacacgaattccataccttagaaggtttaccagtaaaggcagcacgcaaacctttactcttgtgtgaatcagaaggaatcaagtgctcattgaaggcctcaggcagagattcaaaacgagatctcaacattcctaatgtccgtatctgatgtcatgaaacatgaaaggtgcctaccataagttcatgagttgatgacaattgataggccatagagcacagctaagctatacaccctccgtcccaaaaaagacttgatttctggctatgcaccttgacaaaaaagtcttttttttgggacggtggttgtacaccacaagataatgcttcaaatgagcaaaatataactggaaaaggtagcttaaacgtagagatgtcactgtgaataacatcagtccaagaacattgttttcttatacgctattggatgcagtacgcggtatattagacaagaaaactgttttatcagagaaagcaggtccaacaaatcaaaccagtcataaaatgacttaatgaatgcctgataacaaaacattttaccaacctcaccaagacgacgataagccccatagataccaccgatcaatgtagagaaaagtgcataccaaatttgggtgtccatgaagtagacctggacatatcaattgataaaactcaaaatattggctaatcaacttttgttaacaggaaacaatgaacaacactcacaagaattattggagcccacagcgcaataacaacaccaatgttattgttagctgcaaaatgcaaattgagattgaaataagtgtgccaaaaattccaaaaggtaaaaacatcagttttcaacttaagtaccacgagggaaaaattcatgccactggaaatcccggatcggctctttcattatatctttggttggctgtaccagaggcttgatctgcatggagatcatgagagtatgaatacacaccgcaaggtttcctttgatattttctaacacttaaccctccatcaagtagtttttatactttttaacataggtgctgatactcatcgatatgctggcatcttgaacattcaagaccaaggaaaatccctttttatactttatatttatgaataacaaaacataagtattgagaccacatttgggacgtaggaattttactaggttcctgcaagtattgaactgtttttaaagaaattcctacattcaaaataggatctgagaatacgccaacccataaagttaagatactgcagaaatgtaggcaatatattcacatttcaagttcgacacaagaacagctagtgatgaatgtggaataaagaataaatgagtagatacctctatatagaagcttactgtcaatttcattgctaaaaggaggacccagaacatggtatacctatcacaacacaactctaggtgattagaaaatgtgttatattagaacaatctgcaaagatatgtcaacaacttaacatacttgaagagggaaaatgcgccttcatgcattcctctgccaacaaatagtcgaggctgcagatacatttggcaaaacatataaacaactgtgaccacataaataccatcagaaaccaataggcagaaatttacctgagaccaccacatgatgaatgttatgaccttaacatttgaactctcaagaaaccttctgaggaacgggaaaagaaacagcatagcagcaagcatgtttggtgccaaatatatcacaacagccaaaatatacagtgatggctgattctgaccattgccaagccaacttttaattattcttgcaagacctgtaggactgtcccaggtatatgcataagtcacaggcaaaatcacaacccatgcagatgatgaaattaacttcaagacatatcgcagcttgactgcaaatgacatgcttcttcttgctttccagccaaatacaatgtccagaattgctgtattggttatacttgtcagtaagcatcactataagtattatatatacagggcataagaagtatgcatacagctagaagaacaaggtgttttttattacaaggaaagtagttaagcatatacagttcagttcaatgttatcaaaatttgttgttgttggggaagtatttgttaaggtacatgaacatgactatcaggctatcaattg

SEQ ID NO: 69385 - DNA, 2820 bp, Oryza sativa
agtggattatttttttcctatgtttttccttcaaaaatggaggaatggaaaactttcctatagttttcctatggtgcattcctatgaaacgaatggtagtttaaaacccattcctattcctatgcttttcttttgcaattcctttgaaatgaataagcccttaggcttattcgtttcaaaggatttgtaaaggagaagtacaggaatatccaatcctttggaatgagcattatactatcattcatttcaaaggaatgcatgaaaagaaaaattcatatcccttcacttttagggggaaaacaatggaaaaaaataatccactccaacccaatgttttcaatcatttggattgtttgcaacccaaccataggaaaatttctatgttttccaagcacatgcattcctatattgttcctatgttttccctgttcctacggtttgaaaattctacaaaccgaataagcccttagggggaaatcaaaggaaaaaaaacaatccactccaacccaatgttttcaatcctttggattgtttgcaacctaaccataggaaaatttccaatgtttttcaatccataggtttacacatgtattcccatattatttctatattttttctattcctacggtttgaaaatcctacaaaccgaataagcccttatactttaggatgaagggtttaacgtcggtttctgttatcacatttttcatactaataaatagtgcattttgtacgaaatctctctatataaaagttgtttcaaaatattagataaatttattgttaggtttaaaataattaaaacttaattaattatacatggatggttttatcattttaggtactcgtacctaatcatctccccctaaagaaacttgaatcttcattccagcaagttatacgatgcaatatgagtatacgagtatcttgtactactaggagtatccctacagtacacatgttcgttcttgtagaaaatccaccagatactaccgcacggaagaactgagagttaatgatggcggtgggctgggggcctatcgtaagcttgtggtgacatgggagagcagagcaggacagagaggcagccagtcgctcagaacgcgagagcgtgcgtgagaagttgtgcactgcagattactcctgtcttcctctctgcccctctctactacagggaacagatagtggtttgcaagaaaggagaagagagagatctgggctctggaggaagaagcgatcatcactgtgaggcgatcttctgctactcctacccaggatgaaaattgaaaaggcctgcccatatctccactagtcagatactagtactatcccagccactaatctaatcatgcgccagattccatcacaatatcacatcatacgcagagatggtactcatgcaagtgtttcttctctctctccatctctgtgatccaaacagccccttaacatccttcctttttttttttctttacgtccatctctcttggtctgtagtacgttctctctctttttctgtggtttaatttagccctttgcctttggcctctagctggagagtgtacttctgaggagtagcaatggagatcgagagagaagcagcaggcgcgcgcgcgcatgccatggggtggatcactgtagcaactctgcccacaagaaaaggcttgttgaattgttttgttgccttcttcccagaactctagccacacgctgcatcattgcatatgacacgcttgcgttgcgttgcatgcatgcgcatcctgcagcagcgttgcaaatatacgagagtatatgcgatagtataatactactactccactactcatggtactagtactagtactagtactagtagtaaattacgagtatactctcagtgaaggtggatttttcagtgccctgattgcaccattgaatggagacgaacgaagaacagagggaggcacaaggctccagcaaaaaggcgcttccagaacacggaggcgcatttcctgaggcttctcctctctctctctctcggtcctatcggagtactggtatgaaggagtacgtggggatgggtcttttttactcgctcgttccactcccatagtagcagcagactggggtgcactgttgggtccttgggatatactccctccgtccaaaaaaccgtaccaacgtttgattgttcgtcttatataaaaattttttataattagtatttttattgttgttagatgataaaatatgattaatactttatgcgtgacttatctttttaattattttcatatttttttaaataagacggacggtcaaacattgaacacgaaaaccagggtttgtctttttttttttcggaggggtatgggctgagcctgagcggatcttgttgctacagtgcccagatcgtgtgccgcattcattgtctacctgaagttggtgagctggcctgtgtgtgttgtttcatgccctgtccctgcaagcctcctgcaagccagtgtcctaccatgctagctatattgtgaaatatatactgcggtttacagtcactactaaaaaatgatttttagcgacattggtcttttattttttcaggcaagtataaccctcagagctaaatatctgcctacaaaaatataaaccgggatgaatttttatcatccgcttgcgaaaatcaatttttcaaagcggaccacttaataggttcgcatgcgaaaatcatacctaccctaaaaaaatatatcttaagtctttcttatcttctcctccacccctccccaccagccaccactcatttccctctcaacacacactctctctctctcactggcccgt

SEQ ID NO: 69386 - DNA, 546 bp, Oryza sativa
taatgatgataaagaccatgttaacctaaccagtgaaataaaaaattctgtgttccaaagtacccaaaataaaaactgggagctagtactagctggcttgaatggcgaatggcatggacagcaacatgtgaccgaacagcacagcgagacatgctaatctgatcctgcttcaccaacagcttcgctccacgctcgcacgcatcaaccgaaaaacgttagcatctcctaatcagatttacgagtaccatttttcttctgaaaggtcctaatcagatttgtgcacaagtgtcatggaatactacttggcgagcactcgaggcattctgattggcatcctttgcattctgttcgaggtgatctttcaaagaacgccgtgcaagtgcaagcaatcccgtgatagcgagaaatctgtcaaaaaaaagtgctgtcaaaagcaagcaagcggcgagctgtgtgttaggattttgctgcaaagtcaatggtgcagtgaaccttctgaattctgaacatctggctcggttcatacttcataggactttttatgat

SEQ ID NO: 69387 - DNA, 2036 bp, Oryza sativa
cctccctctcccagatccggcccctacgaggagagggcaggacggtgtcggtagcagacaccaccctccctcccagatccgacccgaggtgggaggggggcggcggtggccaccgcatgcaaaggagttcgccggcgacaacggcgttgtttttttctaaaaaaagttaacatgttcattgatgttaacttgcaagttgaagctgtgaatttgaatccaatgctttgtgttgatgtatggatgtttgtgattggattttgttttctggatgagatttatgagaatttgtgatttgtgatttgaaacctagggaggggtggggctagcgggaatttttttggcgctatgagtattttcgcaggtggggctactgtccgcttgtaaaaattagggatttttactgtagtttagatgcagacggaaggtttgtctgcctacaaaaacgtgttttgaccgtctggaaaaacttttttttttctagtagtgagtatgtactccggggtgatgtttggtgcaccattgccaaattactgattttagatttaaaagtttaattaagtatcaatggtaggggcctctacactttgttactgaactttttttatgattggctaaattaatcttaaaaaattaattgttttgagggctttttgaaaaataaatttaacactaattaaaaagtaaatttcacctactccaagtattatggcctaaattacacaaaatcacaggagttttgatacataatacataaccctagattttatggctataaaatttcacaaaactaaactagtaatcattttgattttgattaccatacttttgagttctacaatcacatatcaaatttatgagttatttattcatcatatgaatgaacatttatgtatgtaaagctttattaattttattataggagtaggcatgtcaatttggttaatgacgtggtttgtaaaacttcaataccataatacataggatggtagggttaggtgtcacgtgccaagatcctggtggtctgtgcaacttggaaaataataggtgaagttttataaaatttactcaaactaaaattagctttagtttttatgagaaagatgggacggacagatttttgaatttctaataatcatttcagaagatcgagataagtcgcccttcttgccagaaagaggagagagatgacatattttggtggcaaaccacatggacaaccatgtcaactgaggcaatatgtgacactttatgatattatggaatgctatttgacaagtttttcttgggagcgcctaaatatatattttcagtgtttaaggagctatacaccatttgacacttttaaattaaatgaccaccgttaaattaaatgaccacagtatataattatattgaagcatttctacgacaaatctacttttaatttttattttttctataaaaacttaacatttgtttatatgtattagagtttaaagaattgaatatttgattacactcaccttaaagcatactgtttgatgagcaatcgatgtcagattgggaggttgggactgataccatagcatccaagagagtgagagacgtcgcttctggttggtatcacttccacaaatcctttctcccgagctcctgtttgctgttagcaaattgaccttcataacttcattattctggtcatatatgatttttttgctctagatccaacgttgcacttatttaacactacttaaaaaaagccagtcacggagaaaaaaagttttctctgggtggcgccgtcggcggcatgcgagatccattcttcacatgcagctaggcttacgatggccgttagtgaaaaagaccttcacatgcgacgatattaagctgaccactaggtataaggattttttttttgggagggggaggggggaggggaatgaaataaaaaaagccatttgcaaaaatccccaaataaaccaaaacaaattcactggtcacaatcacaaattcatagcatcataaaaaatgaccaaaaagctgtgcgcatattagac

SEQ ID NO: 69388 - DNA, 737 bp, Oryza sativa
gagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtacccatgcaagcgtgcatgcggatgagaagggtacagctctgctcatttaatgcacatgcatgtgagtgtgaggcgccgcagacgcagtttcttgaagccgccagggagccagccaagccaaagtaggagtaggagataaaatacaaatactgtagcaagcacgggaaagccagggagaatgaaatggtcaaagttggcagtgccaaattgccaaacttgtgcaaatggagagtcaacccaggcctaccacgcctgtgcagggacagagcaccttattgatctaggacaaataatattcttctgcttgcttattgatcttcttgtcccacaaatatccagttttctattcttatcttgtgcatctactcgctccatccacaaaattaagctttatcatcttcgtttctcttctatgcttaagtagagaccatgcctccaattgtcagttgcaaatgtcccgtattagagcttggctatgccaaaagtttagccgagcgtcgaagcatagaaaacagtcttaatgaaaggcatgatca

SEQ ID NO: 69389 - DNA, 4554 bp, Oryza sativa
atttcacggtgaaggaaccgggatgacaggtggtggggcggcccgtgcggagacggcgccaggggggggggcatccctgtttcggcgatggcgtcaggtggcggcgggcggaggggcggcccgcgcggagatggcactaggcggcgaggcgtcctaagtcgggacggtgctgggcggcagggcgccacgagcgccaacggagccgggcgggggggacggcctgagcaacgacagtgccgggcggtggggcgtcccgaggggtgatggcaccgggcggcggggaggcgtcgggcgttccccgtggcgctcactggcagcccccgcatccgcggcgtgcccctcggccggaaggatgccatgacggcgagcatggagcgcgtcgacgccacgctcctggagagcttcctcggcattgacaccgctgtccctttcttttctcctctgttggacgtccccttcttttctcctctgttgtccagatccagatcgaagcagctcggcggcctctcctctctcccctccggctcccatgacagtcactcccctctcccatccggcgcccgcggtggcctctcccctctcccttccggctcccacggcggtctctcctctccggcgcggcgtccctctctggcatagatagggggaggcgggccgacgagttcggtggcgcgttgaggaggagaacgacgagctcgcagccaacccatttccaatgccagggtgtgggtggaggcgtcgcaagccacgtgcgcgaggccacaacctcacagtgcggctgcgccattctccctgctccgcacggcttcttttctcacgaagaacgcatgcccaatctgggctacacgaacttggtttggtcacgctgcaagctgagttggcgggaaatctcctagctatcatgggttgactaaatgccacatgtgtgcattggaatggccttacaatacaacccggtttcgatttcaggtatgcacgatttaaatgatacgtgggaaaagacgtccatcgtgcacatccacgaaaaagatggaagttgatgccgccggcctcatacatatactagccagtgtatatatacactcgcgcgcgtgcagtgcatatatatgaatctctccttgcttccgtggatttaccatcaaagttgagacgcggcatgcagcgcttggacggcgcgacgacgcaggggcccgggccgcgaccttgcacgccgcgcgcacggcaacgaaacaccaagcgtgcaagcaataatcgcgcgcgcttacgttggacgcaccggccggcgcgcagccaggcacacacgcactgcagcgccgtcgccgtccctccgtgcatgcatgcatggcctgacgaacgggccaggtagatctagagattctagaggcacctgagacgagcaggggccgggtggcacggcacggcatggcagaacgcaggcggccggcgagataaaacggcatgggcgcgcggtacgacagggcactgcgcaggcgcgcgcgggcacgtaagaccaaccgggctctagcgcagcgtgtgtatcagtatcgcgcatatgcgtgcaaggagcggatgaaccgatgaaattgcaggggcacgtactgtggcatgcagttcgtctggtgtccccgtaatcgtgtctaccgtctacggtgcgttttgtaatatatggctgttagggttagctagttagctgcacataaaacaacgtaagtcattagcttattattaattaactattatatctgatttttttaagagaaacttctccatgtaaattattaacaccaatcaaaccttgtttagcagtttgagaagcatgtcaactcatggtaaataagatattagcttagcccaaattaccttgttttcacagtatatgcgataaccgcgcggttttcacggtaaccacgcggttaccacgataatcgtcaaaccgtggggcgatgataacctcacctaaaatgatttggtaaaccatgaacgtcaatctgtcttattaatcctaaacgtcgatatgtgaaaaggtaatgttagtaaagatggcataagaaactatcatttgaagcagtggcggatccacggaggggtgaagggaggcctggcctcccccaaagagattaatttctttcagtaccagctaacaccggtgggaaagtgtttttagtcccagttcgtaacccccctctttagtcccggttggtgtgggagtaacaccaaccgggactaaagatattttttcttttttttctgtttttaatattgaatattgatttcacaccatcccctcccatatccaaattatcacatatcactgaacatctctaaatcctcaaatcctcaaataaatcatctcaaaatacatcacaaactcttaaaaaatagatcatctccaaatacatcacaaatgtcacgaccggaaataacccaacagacgttccttacgtgcgtgtattattccttgtcccaggaggcaaggtacacccaaaagttgatacatttcagagtttatcaagcggaagcgtaattaattaatctattacatgggcggcgaagacccagcacacaagaagacaaacgaaaaacagcggaagactagggcgacgaccacaggcgcttgacggcaggcacgagctagacaccaaagccttcatcttccaggaactcctcttctgagtttgggaaaaattgagcaagactgagtacaaccaccatactcaacaagacacacccacaagtgcagaataaatgcaagggagtacaaggggggttatagtataaagggttagggtttgcagtaaacagcattaaaagacacttagttgctcaaagctattttgtaaatacgatcctagagctatacaaggttattaatcaaggccgtgaatccacacgaacctgccttaacccaaggcctacgatgattcagaccgaactggcaatccgaccctgggtcccagctcatcccaagccaacccaggccaaccattccacattttagttgttaagcaggttttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccatcacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagcctttatttgccctagagatgtccatcgacccctgactttgtccatctccatccgtgtacttttgtttataagcagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatggagggggaggtgtgaatccaattccacaataatccaaccattccgtagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtaaacaaggaaataataacaataacaataataaggtcataacaaaggtacataggcatggctagataaaacagtgataacgcaggaatttaaataaagcgataatgcaataatttaaatcaaaataattttataaactgggatttaatatgttcaaggatgatgtgacttgccttgctcgctttcccaaacgtcggcttcaacctccacgaagagcggatcttccgaagctgcagcgtctacacgaccaatggaaaagaaaaggcttttactctaataaactctatataaccagcaagaacaaagcacaaaaatgggttcctgacttcttaaggaaaaattagagacttgaacggtccaattccgagttcaaatggccaagttatggccatttgaagtttatatgctatttaaatgaatatttacgaatttcttcatttaaattttaatttaaaaagggtttattgcgtcagccgaggggagagggcgcgcggaccgggtccacgggagtggggcccacgcggcagcctcacggtccacggtggaccgggtgcacccgggctcacaccggccggcgtcgtgggccccacgcgtcagccgcacccaagggcgcgggcggctgacggccgggccccacgcggcagacactcggcgcacccgagggcggtcactccggcgcggtcagtggaggcggcgcgcccgcgccccgatggtcgctgccggcgaccaccggcgcggcggagcggtggccgagagaggggaggtaagggtgaaaggaggcgacgg

SEQ ID NO: 69390 - DNA, 2495 bp, Oryza sativa
ccggtgaggttggtgtcctggaagacggagagggagacgacgcggccagagtcctggtcgcagtccacgtcgtaccagtcgcagcaggaggtgttgcgcgtccacgacgccaaattgtaggggttcccgagggcgtcgtcgatggccagaagcgccgcctcgtcgtcctcatggcattgcaccttctgctgctgctcatcgtcgtccttggccatggaggcagcagacaggaggaggacggacagcagcagcagcagcaggagcttcacatccatggtcatcatcatcatcatatatattggtcgtttaattttaccagcttgagctagctgcttaatcaattgccgactgatcgagtatgtatgtatgtatgtatgtttgtgcaattggagtgaggtcgcaagagatattgagatgcatatggtgcatgcaatgccgtgtatatatagcctcgcctgggccctgctctctctctcgactgaaaagagatcttctttttcaggtgttaaaaggttattaagttgggagcacctgcactactgagacagagataaagaagctaattaagatagataattttggattaaaatattgggaaaaagcgcaggcaagtgcgcgacaaagatacatggaggcaggccaggccatgcaacgccaatgcagtagcgacattcacttactaattgctcagatatttcacccagtagtagcatttgcattgcggacctaacctcatgtgatctgaatctgactgacatggatatgcatttactagtatttcgccggcctttccatcgatggatgcttacttgcgtggacagatagttgcagacggccaattgcaacaccagtattcacgcatgcttcacggattaacagcccttctagtgagggaggaggcactgaattctcatcactcagcacaggagtcaggaatcgtaatggccaaccaactggattgttattgcctgcagcacattaattgttccaacaggggcaaatgctctccatctttctttcttctattagacacaaaaggccttatgttttgtctacagtgtaaattaaatcctagcgatacctaaaattatgtagcccatcttatcctatcaaaacaaaacaacaatcctatggacaaaaaaacatcatggtttctggtcgaccaccggaagctacggtatcaccttccaggaccactgctctctctgtctccctccaatcgccatgatcaacgataatgcttcatttcagatggtttcagaccgtatcgctgctgaatgctccttcaaatgcaaaggggaggcttcaccaccaaattatatatgctctcctttcatgacgcatagcactgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagataagaccaacctgggagcaagtttgagttcaagagaaatattaacagtgcagaggcagaatagttcctcaaacagtcacatttcaatagaagacattggctgaaaaacaggaaatgattatgtttacctgcccttgacgatgatggtgcacccgggctctcagcattcgcaaaattgtatctgatgctagctgaagaggcatatcagcagataatctctggcaaaaataattatagctcaggcttcagaattcttgttctaataaaagtagcacaaaataggatgatcataccaatagcagcgataatataaacataaaagaacacggtgggatgcccctacaccagttttctattatccatgtattctttatttctttcaaagaccaatacacagagattaacaaacaggacatctcatttaccttttgttatatatcaactcctaaagagaagg

SEQ ID NO: 69391 - DNA, 1321 bp, Oryza sativa
caaagttgtgtatggattgaagccaaaatagcctaagttcaatattgaaatgacctattttcttaggtatgctaaaatttggcttcaaaccaaatagacataaaattaccaaatattagtaagcctaatttatgcctcataccaaaccagcccataaaatactcctctcaattcaaaacttgcactaaacggccaaaatcttccatcgtatagttacgtcacaccaaacacaaccgtgcaaaaatcacccaaaaaaaaaagagaggaaaaccccacattttgctccgctccccccaaaaaccctactccatcggcggcgatggcggagccagcggctgcggcggcggcggcggaggccccggcgacggtggggcaggcggtgatcccgctcgtcaacaggctgcaggacatcgtcgcgcggctggacggcggcggcggcggcggactggagctgccgcaggtggcggcgatcggcgggcagagcagcgggaagtcgagcgtgctggaggcgctcgtcggccgcgacttcctcccccggggccccgacatctgcacgcgccgccccctcgtgctccagctcgtgcgccactccgcccccgaggagtggggggagttcctccacgcacccgcccgccgcttccacgacttcgaccagatcaagcgcgagatccaggtcagccctgcagcttcgcttgtttgcttgcgtatagtactacttttggcgcaatgcttgagactttgagagatctttaatctgtgaaatgatgattgcaaggtggattagcttgcaatccagaagaaaaaaaatgtaggttgtagtttgcagttttagaaaaagggtctgttcactttgttgacttgatacattaccagcattagtccagaaaaaaaggatactccctccgtttcaaaatatttgacaccgttgactttttagcatatgttagaccgttcgtcttattcaaaaaaaaattgtgaaatatgtaaacactatatgtgtacatgaaagtatatttagcaatgagtctaatcatatgaaaataataaataattacttaaattttttgaatacagcgaatggtcaaacatgtactaaaaagtcatcggtgtcaaacattttgaaacggagggagtattatggtaaaaaaagcatttgggctaaatttagtgtatggagatcgtttggtacctttgctttgttcactgtattgtactgggcagtgggcactgatactttcgcgtacttataataatccttcttttttttggttgggggggggtgggtcttgttttatgctttcgtgattcttacgagatgaat

SEQ ID NO: 69392 - DNA, 1308 bp, Oryza sativa
gaattttgccaccattattaagccaatcctactaaagatttagcaatgttgtcattttcttaaaatttggaattgctaaattttggtaaggtttattttggtactaatctgagcaaacctttcagtttggttgctcattgatggctatatatcccagcttattctcaaacctggtggctcgcttgattggcagtcctgtaagctcatcttgcatacaaattttggggtactaaggctgcttgcatgcaccaagaacatttcttcccttatgtgtaagcttaaaactgaagattgtgaggtgttctactacataataagaaactttgagtcaaaaaacataataagaaactagaattagatcttgaaaacgatcgactccaatagatgctcatcatgagcttttttttttccctctattccaattgattggaagtatctggcagcactacgccagagtgacttccgaagcgctacggacgggacagctaacgtcaactacatactatgtcccaaaaataaaggactttaccaatacatatacattctcaaaatcttttatagtatttaaatacaaccgtttaaatttccaacgacacactacatattgcttgcaccagtctaccagttgagcatgaccatccagagggaaaatgcacaatattactcctcgagtgacagtcgttctgggttggtaaattactgcatccattcttaataactgactgtagtattatttattttgaaactttaaccacttctttttaaaaaaaaatcataaatacttcaaatgtctatattaccaaagtgtgtagtgctcacaaatataaccaaacaacttttcgttcatcatgatatcatattcgaatcatttaaaactaatttttgttcaaaataagatgccaatagtcaacaaagagtgttttcaggctttgtatttattatctaaaaagagtatttttcgtatttatcatcttatttgaagcatgttttacataagaaccaatacacgattctatagatctgcgatacctcatttcactatacatataagcagagttgagatattagtcactagtgaaaaaattgaaatgaatattatcttcgcctcatacataccaaatactctctctattcaaaaatataaagattactcgcattcaaaatttatgccacaatataagcatttcttagtcacttcatatgcacagaaattcatacattttcagcccaaccataagatacttgggaggggaatctaaataattcaaaactcataatttactcactgatatgtttgaaagaaaatat

SEQ ID NO: 69393 - DNA, 7203 bp, Oryza sativa
cgtgcccaagcacaaccctgtgtaccccaagttctcgtccttcttcaagagggtgacgattgcgctcgacccgtcgctgtacccggagaacccgctgatcatttgggagaatgcgcggtcggccgccccacaggaagggttcgaggtgaagaggaaaggggataaggagttctccgcgaatatccggctggagatgaactataaccctgagaagttcaagctctcgcagcctctgatggaggtgctcggggttgaggtggacactcgttcgagggtgattgctgccctctggcagtacatcaaagcgaagaagctgcagaatccaaccgatccttcgttctttatgtgtgatccacagttgaagaaggtctttggggaggataagctgaggtttgcgatgctatcgcagaagatatcacagcatctctctcctccgccgcccatcaacttggagcataagattaagctctctgggaatggcgcgcatgcgagtgcttgctatgatgtgattgtggatgttcctttccctctgcagaaggagatgtctgcatttcttgccaacactgagaagcacaaggacattgaggcatgtgatgaggtgatatctgcttcgatcaagaagatccatgagcaccgcaggaggagggcattcttccttggtttcagccagtccccagtggagttcatcaatgcactgatagcgtctcagagtaaagatttgaagctgatcgcaggagaagcaaataggaatattgaaagagaaagacgtgcagacttctataatcaaccatggtaagctcaagcaaatcttaaggctttactcattgtacttcctgcttgaaaccatatatcaatgtgctgactaataaattgttttccattccacaacgaaacagggttgaggatgctgtcataagatacctgaaccgcaaaccggctagcggtaatgagggcccaggcggtggtgctggtggttcatgaggaaaggggttggtattactgtagtgccattttggtgtagaaacaagctatctgttatgtactagtaaaaattcagatatgttagcgacaaccgatttgtttgctgctgtgaatgatcttggcaggtgtacctccattgtctgtccaaacgagttatctacttgtatgattatgtgataagtgatccctaactacggtggcagtatgaattgtcatgctaattgctaaatgctgaagggaaaatgctctgttctagttacctaacatataggtatcatatgtgggcacaagttttctctgtatgatgctgtgtgtggcttatcatttgtcccactggggaggttgtggagggggacctgagactccgagaaagctgtatcttttgtatttgaacatgcttattggagggaaaaggaaatggaaagagtccctatctttaagtgcctggaggatcaagtctcttttgggccagcagcatatgttctctcttttgctggatcatcgtgcctgtccactgttggctaacatgtgtgcatatacttgtggtgtggacatttatgctgaaaactgaaaaggcagtattgggctgtggtgcatttgttccctgctggttctatgcctgatgaagtgatgattggttgccccatttgatactttggtctgtcatatcttcatccatgcttggttgtcctatgtttggccactgcttcctggatctgtcaggtgttgtgattccagttgagttgagtttagagggcactaatcatttcactgtaaacactgcaggcctgcaatttcagagctgattgcaaggattcatgtgccatatctatctcccctcttctgtactgtagtagtgtgtaatttgagctatggattcagaatcatcaaacagtcggcaatggttgttgagcaatcgcgactacaggccgttattttatccccatattagaactatagaatagaataaacacgcacgtacttttcattgtaaactgtagcatcacggtcctaccaatattctactcctaatcacgaaatctaccaatattctaactcctaatcacgaaatccaggatctgaaactctgaatccagcaacaataatgaaatctcaagctctgaactctgaagcagatgtggagaaaagccagctcgatgtgtgtacgtactcctatgtaggagtatcaaatgtatgattgattgaagccgtgttctttgttcttatcctcttctttcgatggagtgcatattcggacattcagtttgatgtcacgggtgggcctctttttcgctttggaattgcatcaaccagctcagaatctgaacgaaacatgccaagaagaagcaggcgcatattacaaatggatggcgattttctctgaatctgccgcaactttgaggcccggtttagttaccaactttttctttaaactttcaacttttctattacattgaaattttcctacacacaaatttctaatttttccatcacatcgttttaatttcaatcaaacttctaattttggcgtgaactaaacacaccctgaacagctgaactgaattcgcgctcgtagagagagagagagagagaggggcacatggaagcaacatgtgccaaccattgcatcctatggtgagttaggtttagattgttactaatgtaagactcggttgattttattaccgttttcaaactagagttggacaaccgggcgaatcttttttgtagttgtatgcagcaattcttggagagatatacaaatatttgtgttgaactttgtttgtttatagcgttgtgctttgggtactacattttcctcttgtttcatcctaacacacttatgataagatcctttataatgtagtaagattttttaaagcaattttaacgggaactgaatcagtattgtgaatttttttgccataccactcctgtgtttcaagggaaaattaagatctatactatatttaaatgcatccccttgcagagtcaagtgtccctaaagtccattttcagcacttgaagtttttaatagcagatcagatgtagcttctgttggtgattactccctcagtcccataaaaaacaaatctagggctggatgtgatatattctagtacgatgaatctggacatatgtatgtccagattagtagtattaggatgtgtcaaatcccgtaataggttggttttttataggacggagggagtacgcattgtgtgtttttttctaccctgtaatttcaattcataagctgcaaattgacctaaacatatgctttcctctgttataaatatttaacgttcaagataagaattattcaaaatattaacatttcaaccataaaaaatatctcacatgtttagctcaaaaaaaaaataaactgcatataattacctcgaaaaatgctatcataacagtatcatgaactttactatactccctctgtttcaggttataaaatgttttgattttggtcaaaattaaattgtttcaaatttgtctaagtttatagacaaatatagtaatatttataatactaaattagtttcaccaaatcaataattgaatatattttcataacaaatttttgttatgaaaatatattcaattattctactttttctacgtgttgaaaatgttactactttttttctacaaacttttttgacgcgcttttttctacaaacttggtagaatttaaagcggcttgactttgactaaactcaaaacgtcttataacctgaaatggagggattacaagattaatggtaaaaataatcttaaagatttgagccaatcttgttccaagatgtcacggtaggaaatcatcaaaaatcataagattggatcagaaatcgcatgctttcctttcttctagtatcatttttcctccctttttatttattttttcgaacaatccgaaatccgatcatcattagctggttcccttccccatatcgagcggcttccttcttcttcgcttcctctcctctcttcgccatttttctactgcttttactgcgccccaaatcaacccaccctccgcggcggcggcgcgattactcccgtgctcgctcacttaaccctagctccctcgccgccgccggcgatgtcggcgccgcccgcgccgccccatccccagccggaggagctgaagttgccgaggaaccccccgccccggcgggaggagtggggaacgacaaggtgctcgcggcggcgcagcacatcgtgaagtcgctggccacgtcgaagaacgccgcggacgacatgatccgcatcctctccggcttcgaccaccgcttctcctccatcaccgccgacctcttcccctcgcccttgccgtcgtcgggcgccgggcccaccccgcctccgcttccgccgccgcggggggcgttcgaggccgcggagaggctcatccggcagtgggacgcgacctcggagctgctggtgttcgagggccccgagggggacgtcgccgactacctcgaggcggtcgacgtcgccgtcgaccagctgctctccggggtgggggccgccgccgccgacgccgaggccgaggcggcgggcgtcgtggtgcagctcgcgatggcgcggatggaggaggagctccgccacctcatggtccgccacgcggtgccgctggacgcgagcgggctcttctgctcgctgcgccgcctctccctcgagtccatggacgacctcgacacctcctccgagttcgatcccatcaccccgcacagcctggagggcggcccggacaccgctcgcagcgccagcctcgtggggaaccccttcgacgaccaggtgttcgacctggtgcgccctgaggccattgacgatctgcgctccatcgctcaaaggatggaccgcgcggggtatgccagtgagctcgagcaggtctactgtggcgtccgacgtgacctgctcgacgagtgcctcgcggtgctcggggtcgaacgcctcagcatcgatgaagtgcagcgcatggagtggaagcttctgaatgacaagatgaagaaatgggtgcatggggtcaagacggtcgtgcgttccctgctgaccggtgagcgccggatctgtgatcaggtgctcgccgtgtctgatgagctgcgtgatgagtgttttgttgaatctaccaagggttgcataatgcagattcttaactttggtgatgctgtggcggtgtgctctcgctcgccggagaagctctcccggattcttgacatgtatgaggcacttgctgaggtgatccctgaactgaaggagctgttctttgggaattctgggaatgatgtaatctgtgatttggagggggttcttgaaaggcttggggacgcagtgaagggcacacttctcgagtttgggaaagttcttcagcaggagtcatcacggcggcctatgatggctggtgagatccacccaatgacacgttacgtgatgaactatcttcggttgttggttgtttacagtgatacgcttgacaaactcttgggtgacgattctgctggagatgttgatcatagtgatacgcatagaggtggtgatgatgaggaggagtatttggagagcttgtccccacttggacgacatttagtgaagctgatatcttatctggaggcaaatttggaggaaaaatcaaaactgtacgaggatggtgcactgcaatgcatattttccatgaataatatactctatattgtccaaaaggtgaaggactctgaacttgggaggattttaggtgatcactggatacggaggcgccgtgggaagattcggcaaaattcaaagaactaccttaggatatcatggactaaggttttgtcttttctcaaggatgatgcacacggcggcagaagcggaagtggaagtggtagtgggaatagctctaggatcaaggagaaattcaagaacttcaacttggcctttgatgagatatacaggagtcaaacgctctggaaggtaccagatcctcagcttcgtgaagagctcaagatatctatctctgaaaatgtgataccagcataccgtgcttttctggaaagatatggtagtctagtggatagcggaaggaattcaggtagatacatcaaatacaccccagaggacttggagaatcagctgtctgatctatttgaaggttcactagggcctgccaaccattctaggagaagatagtagctcccatttgactaaatttggtgacaggtatgcttttgctacaagggatgctatgtgtccgaactgctgagtcatcacatggactgattggtgccttttgagtttagattgtccccttggttattacaatattgtaatactatacaaggatcccttcgtttttctccatcagattatatgtaccaagaagtgatgtacatacattgctttttcagtgtgttcatatccttgcacacttcatttccatgatccagtacctttgcactttgtagggtggccagttcttggaatagatcagacaagtaataggcatttgttgctggagcaatcttatctggcaagatactgatatgaattaaatacatttattgtcgattctgaaataaacgtaattttagtccatctgtaggctattgctaggaggtaatgatggtcttttgataatattctttgagtgtgattcatacatctgcattttggaaaagctatctcatttttttagttatattataagaaatagcattttgctatgtttacgggatctgtactcagggtgttgcacattttaagttccttttctttttctgatcatcttacacagtgttcttgttctagccctcttattcttatttaaaatgaaaacttgttattaccactgtccagactggtcaacatctaatttcatactactatgtcctttcacgttatcatttgaaaaggctatctaattaatacttgccttatcccaatactgttcataatttacattttgcgagtattattgaagtttctttggaatgtacaggggaaacaaaaagaggaatacacatccctggtcctcattagttggatgtcaattagtcagcaaaatttacacgcgtgacaactaaagaatgaaatatgaccttctatctaaacagttgcatgctaagtggattaaattccatgcattttccagctccagaattatgaaatgtaccactattagttgcttatatcaagtggctttcacatctgtgccaaattcagcagaacact

SEQ ID NO: 69394 - DNA, 7106 bp, Oryza sativa
ccatcagcagtctccaggtaaagattttgatttttggagccatacatttatcttttcttacctgtttcataatcggttttaacttgttcacttacctaggcatcttgaggagcttctctcttccagatttctttatatgcactttttgaattacattctccgttagatgtgaatttccagcaaagcctgtctgctatattatcttggataattggtacctgcaaaattttgttgactacctgttgctcaaagacggagttcaacttctgtatatcctagcatttgtcttatgtccagagatctgcaacattattaggcaattgaacttgcatagagtctagttttaagaaatcatggatatcagcatttagatcacaccaaggttagctccaaacagacacacttccatcagctaactgccaagacacagaatccttgagagttttcctgagattcagaatcgagctccaaaagatagatttgggagaattcttagaggctctccagaaggaagtatttgggaaatatttacctttcaggatttgagataccggctcatcaagcttactgactagtctccaggcagcatttagaatcaggctcctgttcgccatctgaatatctcttatacctaaaccaccatcctgaacaggtttgcaaatatcagaccaggatttaaggcagagaggcttcttgtcctgaccctccctcactcctgtccaccagaagattctgatgatagaagtgagtttggcaatgatctttttgggaaggagggtggtagccatgtaataaacaggaagggaggcaaaaacagttttgattaaggtaagcctaccagcatgggaaagtttgttagcctttagattagtaagcttggctttgaatttatccacaatgaattggtagacaaaaatttttgttctattagtgacaaagaggggatggcccaaatgtttggtattggaatcaacagaagcaacatggaagatggttttgatggaattctggatgtaaagaggagtggatttgctgaaaaggatggcagatttactccagttgggagtttggcctgatttgttgcaaaaatcctcaatgatttctttgatttttcttgcttcgatctcagtagcttcacctgtaatgattaaatcatctgcataaaggagagagtgaatggccggcccctgagggctaagtttaatgcctttcatctgattattaaggagatcctcattaagctgatcagaaagctcattaagagccaacacgaacagataaggagaaagaggacaaccctgtctaacacctctattagcattgaaagcatcataagattgaccattaaaggtcacataaaaggaagaggagctgatgcaaccctgaaccaaattgatgaaattagagtgaaagcccttctttttcatagcagaagcaatgaaatcccattccaatctatcaaaagctttggagagatcaattttcagcagaaaacctttgtttttgaaagagttaagaccaaaggaatgaacaatttcctgggcaataataatgttatttgcaattcttctcccaggaatgaaggcatgctaagagttaaagattaggtcaggaagtttacctttgattatgtttgcaatggatttggcaatgattttgtacatcacattacaaagactaatggacttgaaatctgcagggttagctggcctgtttttcttaggaatgaggacaatattggttttgttcagttctttgggaagattacctgtgttatagaagtcttcaacgagcttcatgacgtcatcttttatccatccccacgccgccttgaagaaggctacattcatcccatcaggctcaggagaggcattgctcttcatgtttctgatgatttgccaaacttcctgttagtccgggcattgccagtccatttgggctgggtcatcattacccgaagaatatgtactcggcctgttagttctgtctgaacaaaagagatcagtgaaataatcaatgaaaacattagcaatgtcatcagggttagtaaccaaatgattattagacatgatagaagtgattctatttttccttcttctcttgatggcggcttgatgaaaaaatgaggtgtttctgtctccatccttgacccaatgcttcttggctctttgcctatgatgatcagagagcttctgtaggagagagtcgtgtttggcaactagctctttctccttctccacctgctgatgtctgtcattggaagactaaatgtctaggatttcttgttcagtgttactacctccgtttcaggttataagactttctagcattgctcatattcatatagatattaatgaatctagacgtatgtgtgcttagattcattaacatatatatgaatgtgggtaatgctagaaagtcttataatatgaaacggaggaagtagcaatttgctgttgaagaggtttcttctttttgctccaagataagagattgagacctaatttctacgcttttaaaacaaaagaaccattaattttgtcccagctatttttggcaaagtcatgaaagtcattctcagttagccaccaattctcaaacttaaatgaattttttggttttctgtgagaaggattaagtaaaatcaaaataagagcatgatcaccataaatgaaagggagatgataaatagtagtattaggaaaattagcacaccattcaacattagccaggcatctatctagtctttcataaataagatctctacctgaccttttattagttcaagtgtaagcagggccattataacccatatccatcaagcccacatttctcagatgattacaaaacatggagatacgattaagatcagggagagcattaccatacttctcccaagggttcataatgtcattcaggtcacccatacaaatagtagcacggtgattactttgattaacaaaactactaatctcctgccaaattctgctagaactatgatgagtaggatcaccatatatacacaaaaggttaaataacatgagtggcctgggacctgagtctgccacttcagtagcatagttgaaaagaccggaccagtgagtgacccagtcaacctcctgttcaccggtccgatggttagatcgatggctaattgatactccatccgtaccaaaatataagagatttagaagggatatgatacttcctagtattacgaatctggacaaagagactgtctagatttgtagtactggtgttggtgacatgggggcgagggtatcgtgactagaggcttgggtagccgcggtcacccacgtggcctgaccccctcgggggggtcgggcccgaggatgatgtggccacccctccctctgtctcccctaggggtcaggccgcccctgtttcggccccaggggctggggcgccccgaccccccgtgattttggcgccacgtgtatgggttaggtgagcacagcggggctcacctaaccgcatttattgcgggttggacgagcgcgccacgccgcatttaatgcagcgcagcgcacgcttatccggtccgtgaccggtcgcagtgtgtgaccggtcacagaccggtcagatcgcgggttaggtggcaacaggcagcctgtcacacgccttgccccgtcccgtcggaatgatgagagcctccaggcactcgtccctagccggagccggcgtgctaactcctggagttggtgtgtcagtcccggccagattcattccaggcttcatcgcaaccatggcaaggaagtcattgtatgaagaagggcagacgtgcggcatgctaaactgacgcgcggtgaacaagaatgaccggtctgtgactggtctgacgccggtcacgtcatcggcagacaaccgtgttcccacgttgcatctgcttccggcggagtggaggtagatatgacccatcccatcggagggtcattcggacagcggccattgcaaatctccacccattaatgaaggaatgacagggttatcccctatgtcaggcgagtgacggcgctgggcctcactcaaggacaagttgtgatttagcttccaggcgaaggcgcgagccaagtcttggtcaagatagggtgggtccccacccaaaagaagagtaggtagaagtggtgcatgtggtatccccttgagatataaaaggaggaccttgcccaccgaagaagggggactctcagacgacactgaggatacctgaactcgtagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcaactgggtaatgtcacatctctccaaaatacattatattatgagtcggagggattacaaatgctttatatttccatatcagcactaacaacccaatgcttggatcgctacaggagtcaacttccaacccacccacttgagttcaactccccaccattcccccttttgttggtgatttttgcctaaatatctagttatttcgagcattcgagttaaatgggccttcttccggcttatttaaacaattcagatgtctaggccagtccgaccaagaccaatttatcacggttcagtaatcaatgccaactatgctcagtagtaatcaatgccaactcgtctctctcctatctctggcgtcaataacaagagtattaatttactggaaaagctacaaatctatcaacagttttttctctaaatatatttcgatttctagtccattgatcttgtgttaagatccgtgctagttgtatggagaaatagaaacacagcaaccacaagtgtggggattcgatcccaagaccatgatcacacacatcacttcttaacaaagtgagcaatcagacagtttatagaattaaaactagagtgaattccactttggactaggtttagttacatatgttacaaagtataccaggcataagtaagcctttttaactagaactaggtattgttaccaattttgcaccttgtaccggtggcccacattccagtagatctttctccttcttcctcctcaaaactccctgagcccaagtctatccataccggtgagcttgtctcttcagccagtagaagcaaatagcagccggccagctagccctctcgggcccactccaactcctgttacacggccggctgcggcctgcagaagtgccaggagcgcacaagacgaagaacaacgagattgaataattgaatcaatgcatgcatatggcatgagaatggtgcaggacaaccactgcattatcagctctcctccaattgtcttggacttaattatttccttcaaattgcaaatcgggagtgtcgcagccctcagcggaggtcgagcgtggctgcagcgctagtagagtttgagcgtgcttagtcttctcatccagcctctcctctctccacctcaagtttgtctagagcatctagaataaatggagatgaggcaggatagatcaagcgtgcgtcggcaggagttgttgagaacagcggcagtggaagaactggcccaaagtgaaacattaatatagacttccctggtccaaagtgaaaacttagtcctatctctagtccaagttacaatttagataaaaaatagtggtccgatatgaaatttactcttaaaactaaaattacacctaagttagttacatagcaattacagtataattatatacaaattatatttgaagacgaaacgagcatgtagttttcgagtaattgtgggacacatagctggagaatttatttatttattgagccgtctgtaacaacaaagtttgagccgtacgtacgaaagcacgcacgcaagtgatgcgagttggcgcgacgggcgacggcggtcgatcgcacaagcttttggttttgcttgaccggccccgcccggccgcacctattcgtacgctggtttggccgctgaaaacttccaaaagaaccaagctaaaggctaaagccgcttgcacgcacgtgtagacaggagaccacctttattagggtatgtacgatggttatcaacagtggtttaattctttgcattgctaattaggaatacctgttgtctgttgacatggaagaaagagaaagaggaagagacaaacatcgttgttatacataacaacggctcttaatcgagatttctaatgggtgaacgatcgttctaggcgattggtttttttttctttttctctcaaagtaagtttatacgcctaaagtttacacatctaaaatttatccacctaaagtttgtaaagcgaatgtttataagtcaaaagtttatatacccgattcaaattcaaatttgaattcaaatattttatattttcctcttttagtaagtttatacacctaaagtttacacatctaaagtttatccacctaaagtttgtagagcgaatgtttataagtcaaaagtttatatacccaattcaaattcaaattcggattcaaatattttatataaaaataatttctatacataaagtttatgtgtgcaaagtttacggtataaagtctatgcacataaatgagagtattagatttttttttctaattttatttactaactttgtgttttttttgaattttatgatgaaaggaaagaagggaaaggagtatagggggaggggcgggttgatcgcttccagcgatcacccacccattagcctcatccgctcttgatcactataatatagaaatatggttgcatgagggtaaaaaaatggaaagaatattaagaaaaggaatattttttgagataatgattagagtttttatcgtcttaactattgtaaagacatggtctctaaataatcttatagcattgtttaagagaccatagtcgtctctaccattgaacaaactcttaagctttctttgatatac

SEQ ID NO: 69395 - DNA, 16915 bp, Oryza sativa
taaaactatatgtttacataaaagtatatttaacaatgaatcaaatgataagaaaataattaataattacttaaattatttgaataagatgaacggtcaaacatgtttaaaaaagtcaacggcgttatttagggacggagggagtaacaattaagcgtgtcatcaagcgacgccggccataagctggctgctatatatactctacaaacacatgtatggtcagtatggatagccaattaagcaaggaataaatcgaacgaatgaataccatgggctggactggctaaaggttaggcgatgatctgttagctcgatccttcggtgatctcctttatttttgctaaagctggtacgtgcgtgtggtgcgtactactgaccggtacacctgaccaactcaattgcctttgttcccttggctgagttgcagtgcctgtagctacagagtacagactgggacaatggtacggaagcacaggagatcgatgcgcctcttgcgagtgcggctgtcacggaaagcggccataaacggccctcagaataaattaatcttgtataaggtatgatatattttaatacgtataaggtataatatattctaatacgtttttatccagatttatagtactaagataatttagtctgcatactgcagcggtctgagcaaatgctatatattacacgtaactgctttttaatagctgtagcccctgttttgctggttgttacagacgttgcaggggctgcgaggaggccagttgatgagctcccgaaaaagccgcatccctccattcctgtcgatacaaaggaggcagccagcgaacatccatcaccgccttgatcgccgctgcctggaaggcatcagagcggtcggggatgcggatttaggaggtgccgaagaagaggagatcggtaacggtggggttgaaaccaagataacgagtgggtgcaagccgactataaggaactgacccctcaatgtcgacgtttgcgagttcaggggccatacctcgtaagagggtcggacgacggcggcacaagctatgggctcgaggctcctcatcctctcgcctcgacaccgcggcagttgtgaagactataatgtgataaggatgggcggaggttatgacaacagggagggcgtgacctgatctggcgagccccgtcctctttggtgttgggagttggtggggccatcaggaaaagctctgggtgggtggcggtggagcagtaagcttgagtggtgggtggcggtggaacagtgagcttgagtggtgggtggcgacagagcgggagctgatagggctgctacgtccctgtatccaacgttggcctgccaccctggaggtcattggccggccgttccggagttcgttgatagggagaagaagaaaagaaaagaaggaagaagatagaaaacatgacattgctagcaaggttctaattttacaaaatcagcatcagctaactgatatcgtgaataatataatagtagtttcataaatcagcacatctacactgacatgaattcgattaagcctaataatataaaatagtcggtggacagcacgcaactacacgcacaacacaagagtccaaaattattcgttcctgcagccgggtggctagctatagtaggttgtggtatatgcataccttaagtgctcctcagatcgtcgccggcctgcatgcaaactttccagccaaccacgcgcctatacgctcgcgcgcacgcactctcgatcggtgaactttacggccggccgggccggccagccagctgcttgcattgtgcatggtcgtagcaacagggaagcttagcgacgaaggctaagcttagcttttctcataaacagtgcgtcccaggcagttagggagtccgaatcatgtcacttcttgcccttgcaaatcgcaatcctctgtagccatgaacagtacgagcaagagcacgtacgatgaaatttgcgcagctcagggtttttttttttctgaaaaaaaaacatcgtacgaacacacgcagacgcttgattacaatgcacgcatactcgtctctatgaatgcacacacgtacatcatcacaccatatccttataaatacctctgaatgactagagatattaacgattatctgtaggattataactgctcataaattttacaggatctttagggaatttgtttcaatcatataaaattctcataattaaaaaccatctgttccaactgtactgctgcccttagctttctccttcaccatatttaaggttttcggcgaattggctgcgtacataactcaacaatatggtattagagcaaaatatctttagccttggtgcagttagatgtttaaaacatcaaagaaaaaaggaaaagtactccctctttttaaattactcatcgtttcagctttgtaataaatcaaatatttttaactataaacaacattttctataaattttatatagtttaacatcataagtttatgttttagattcatcgtaaatattttactttcataatttgttaaactatataattaaatttctagatattgatggtaaatgttagaatttctaaaagcaaaaagaagtacaagagatatctctatgaaaatgcatgataaagtagcagcagctagctagccagcacacaattgtacaaagcaccttaattgataacgagcgcacaactgcttatagatatggaaataagcgcacaaacccacacacagattattaacatcatgctgtacatatacagtaccagagtacgatatcaaaaaaaggacaggctaacatgcacatcaccgaaaaaaaatcgaaagcacaaacatgggaactaaagcgatcccaacacatgaccaaaatcatcaataaccacatcgacaaatattgcgcacacgcacgcacgcttaatgccttgtttacatcaatcccataattgggggcttaatttgcaccacacacacaatgttagagcacaacacatacaccatcacttttactctctttctgccttaaaatctcaataatctctctctgtgtgtgtctctacaactttgcatgcatgcccatcaaataatcatctttagtgagttaccttttgctttcttgctgacagctagctacacactgcctttgttatattaccacatgcacacactctctctccttttatgtgatgtttccttagcattgtaaaccagctttcatgtgatgtttgaaacttgaaacttctagaccccacttggtcaccactcaccaccttattgcatctctataaatacccttgctatcccacattccaaactccatgtccaaccatccaattccaagcactactactcatcactagctcacacacaattgcatacacctagctcaaaagcctttctatttcactaattgtgtgtgttcattgctagttgcattgtggttttctagttaattaacaagctagctatacctagcttataattagctagagtgtgagcttataattagttagttagttgaaaacaagctaagatgaggagcaaggcgtccatgttcttgaagcagatggtgtcgacgatcgtggcggtggtgaaggcgaagtcgacggcggtgagggccaagacgagcgccatgaagacgcggctgctcatcttcggcgtcctccgcaaccggaagctcctcgccaccgccatcaaccacaagatccacgccatcatgggcggcgccgccgcccaggacaccaccaacgacggtggcgtcgccggagtggaggacgacgacggcggcggcagcaagaaggccgtggtgctgtacaacaccgcgccgagcttcctcacggagcgcggctactacgatcacgccggcgaggaggaagaggaggaggaggacagcgacgagtacctgacgcactcgttgttccaggaggaagacgacgaggacgacgagctggtgaacgcgccggggtcggtgatcgacctggtgcgcgacgccaaggaaggggaagtcgccgagttccggctgtaggacgagatcgaccacgtcgccgacgtgttcatccgccgcatccacaagcagctcaagctccagaagctcgactccttcaagaggttctgcgagatgctcgagaggagcgcctaagttcatacccagatcgccaaactttttggctcactgtgcatggtgaagaaaaaaaaaccttttttttaccgttaagccaaggttaattaattgattaattacacacacaacttggtgacttttgatccatgcacgcatgtaagtagagagaataaagtgacaaagatatatacttctcttgtagaaggggttcactactttacttaattagggagcagctgctcatgtactttataatttacttgtcttgttctttagttcttttgatcagggggaggtatatcgttaagcttccaagaaattattgagtaataaacaaataaaaaagttgtagattcctgacattcagttgggtctatatctcacttctgttccatgtagtctaaactagggatgtaaacggtcggaaatggtcgaaaacggtatcactattttattattttttcgaaaacgaacggtaacagtaggaaaatttctatatttatgaatttatctatttagtgtcaacttcaatatttatctatttagtgtcaacttcaatgccacgttgacagaaatttaaaaaactaaaatttaaaaacggtaaccatcggtaaaaatattattattatattagttttacggaaacggtataagtacggtcgggaaatttctataccgtattcacccctagtctaaactatatttgtctcgatcaatttctctcatactattaactagcatagatagtcgtgcatttgcacgactttaaccccctctatacaaaatgtgtctgcatttcgtggttttgaaacatactatttattactttttaaataattcatacataacaattaaatgtgtcagttagtgtaatagatatggttagggttcatattcaacttctctgtcatagttttcctctacttatttactcaaccataatcgtctatttttttgtttgtgccttagctgctgctttgccacttttccgccttagctgctgttttgccaccaaaggggctcatcttttcacttatgcttatgtttatcagtcaaaatttgaattttcaacattaaattttgagttgattttaaggttttttcatcgaagtttatttttcagcctttgcttttatatcactaaaaacacgtatataaaagttttattcacaaaacccttttcgtttgcaaatatatcggttcacttattccgcgaataagtgaaacgatggctccgcaaatcaccaatggccacctacattgttgtagtaggagccctttattttcctattatattctatccattgttcatttcagcaaaaaaaaaattacatacttggatacttgctaaaaaaacgtatttagcaagaaagcataacatagctaaatttatcttgatatgtaataaatatttttttcatgcaaattaatagtttacaatgattatgctaaatttgcgaaattactgttgtataattttactgttactcctctgttcataaatattataggtttaattttgaataaaattatgtatcatagtcacaaccataatataaactgttttgagatgttaggcttttttttcctttccattgttttgtaatatttaattttttttagagatcactttgatagtttatttatgcgcgttcagtggtggtctcgtggagcttcccggctcgcgagctttctgttggaagcttcttgaaggccagctcccgaagccgtattgcttgatctttggcttgtacagcagtacaggaatataatccaacggtttatatcacttgctgcatgcattggacggtgtttaatttgtagcttatgtggctcaatcaggttttgagaaagtttactacttccaattctactggtgggccttaatcccggcacatttgtggataggcccattttaattcatatctcaacccatccacatctaatgggccggaataccggcctgccaaacaattcaaggcttcaggggtgaggacagcttataacagcaaactcctattgaaagaaaaatatttacatatacgattctaaactagattaatggaacatgtaaaaaaaccttggcaggattacatgcctattctattaaggcggagcataaggaaaattatacagattggaatatttcctgtattcatacctaaagatagctttattttaagatggaaaactcaacccccatcattccgctgtagctgattataaaccgcaacatttattagcgataggaaaaatttatgtgaaaaacttttatatatgtgttcttagcgacttaaatgtcaatcctgaaaaacaaaaaaaacaacaaaattaattctagtgtaaatatcgtaaaactatatatactctgcacgatctatcacaaaactacagatttaagaacttgtttcacaagacaacatatttagtgtttttgtttaccacaaaactacaggtactttgcacaatatatcacaaactacatatttaataacttgtttcataaaactacagatttagtgtctttatttatcacaaaattacaggtttagtgtctattattatcgtagttttgtgataatagagacactaaacctgtagttttgtgataaatgaagacaccaaaattgtagttatgtgataaacgaatacactaaatctatagttttgtgaaacaagttcttaaatatatagttttgcgatagattgtgcaaggtatctatagttttgtgaaacaagctcttaaatctgtagttttgtgataatttgtgcaaaatacctgtagttttgttaaacttactcttaattctaaaactaagttctaaaattgaaattttgatcgtggctaataggctaacgatggagctgcgaaatggagcatagcttaactggttaaggacccctttgattcacaggatatgaaaaacacaggaattgaagtagcaggtttctcaaatcctaggaatgagcaaacatgctatgggaaaaataaaggaagattcacaaagaggtcacacctcttactatatttcctatgaaatgcaaagcataggaatacaatcctatgaaaagttttctttccttcctatgaatcaaaggaacatgtaggaaaaaatctataggaatttaaatcctatacaaatcatttctcagtcatatgaatcaaagggccctttctttatggtataactaacctgtccgaggttaagttatagttttgtgtatgttcatagggatgagaatgcatgcgttgtgagcatttctagaaggctacagtaacctacgcagagcagtattacctccgtcccaaaatacttgtcgctttcagtttttgtttgtaacttttgatcatttgtcttattaaaaaaattatagaattgttatttattttgtttgtgacttgctttattatcaaaagcactttaagtatgatttgtcattttttatatttgcactaatttttcaagtaagatgaatagtcaaacgttacaagaaaaaagtcaaagcgaccactattttagaacggaggtagtaacatctgcactgtcggttcaaaatcgtgtggctgagggggtgtttagatggggctaaaactttttagcccatgtcacatcggatgtttggacgctaatttggagtattaaacatagactagtaaaaaaactaattttataaatgagagctaatccgcgagacgaactttttaagcctaattaatccataattatcaaaagtttactgtagcatcacattgtcaaaatcatggcgtaattagactcaaaagattcgtcggagcgaattagtccaaggttatggaatgggttttgaaattaatgtatgtttaatactctaaattagtgtctaaacatccgatgtgacagggacttaaaataagtccctggaaacaaaacaggccctgagatcgatcaatccccgaacggaagccgtacaagtcaacgtaacatcaacaactgtttcgcgaacaaaaagagtacaactgtttcgaaaaaaaaaagagtaaacatccacagctatgggaaatcatactggccgtccgatcttgaattaatgagcgcgagagataagaagggtttttttttatatataacagagagataagaagagttaaacaaacatctcttttgtctctggaagattggggggacaaacggataagcattaggcactgccgatgacgatgcaggtgggcccatttgctctaatctgccgagatgaggatgcagatatgagatatttgtctttcttaacataaattatctcgtgcacatatcattcgtcccttgaaaaaagttatactaccaaagttgtttacacacgggcttttgattataataacaagtaaatcaagcatatgtccggcctactactgaaacagttaaaacagtattttgtgatcaatatgaaactctgtaaagtttattatagaataataaccggtattcaacgaaaaaattgtgtaacatagatatgtttatacgttaattaagttccttacgtttaatcatatgacaacaggattttgagcaactatttttcttttttaaaaaaagatctagtcatttttctcatccttggacggaaattaaaggttgaacaatgattactgtaactaaaacatccaacaaaattatataactagtaaaaaaaatcacaaactatacaagtacccagacttgcatagaacaccactttgaaaccatataaaataaactaaaaatgcacattatataggggtataattgctacgtgcaattttaggtgactagaaaattgtatgaatttccacatgactaaagtccagcaaatccttatcaaaattgatgttgtgataagaattttcccaaaaaattgtgacctatcgagttgctgtaatatttatggcctatttcaatttgctataaaaacagcaaagaagattatcccaaaattataactttatggacaccttaacattactaacccctggagccaacatgacatagaggtgatatccggcatgacgagacgactacgggatatgttagcatgacatatcaacatgtgcattggagcactatatcaccttagcagacaactaagccacctactttaatccggctgtaacttcacttgtacagtcggtgcagctggatcaaaatgcatcaagcttaaaaagggcaaaaagacaagatgagagggccatttatcctatccggggatgggtttttgacctaggtgcaccaatcaagtgacgtttcaagtagacttgattgcaatagtgtaaccggatcggagtgacgggccgagtagttttctaatgtggcatgccactacaatttatacattactaatgtatcaggctaacatgttccgctgtctcgcccatgctaggtatcatctctataacattccttaatatattatgttagggtattcatagagttgtttttttttttgataattttatttgctacccttgtaacaaactgaaatgtgtctctaaccttgcagcaagcacttttcttgtagctccaaaaaaaaaactccagttttcttgtgcctctagcattttgcagcttctacacgccgcccgccagctcagttcaccggatccccgggaattaaaatcacacgagatcgatcagatcgcacgctgagacgtatagacgacgtgggtcccgccaaagtactgggcccaccagtcattggaccaccgtacgacgacatgtgtgcacctaccgtggacttcgctggaaaaaccaccgaagccgccgccacgtcatgccccggctgcggttttctttaataaagcccagaacacaactgccacacccaccccacttctacccaccctcaatgacgagtgggccccacgccaaaaccgtccccaggacgttagtgtccgtagccgacgcgcgccgcgtcggctgacatgcgggccccacctcctcgcggtcggatcagcatttcgcctttcgtcgtcgtcgtcatcatccacttccacttccaccctcctctgcatttgcaaccacgcgcagacaagaacaagacgcgcagcaaagcgcagcagcagcagcagtattaatcgaggccaaggacaaggagcagtggcaattgttgttgggagaagagcgagttgttgggagggagaaaggccaagaagaggaggaggaggaggaggaggaggaggggatcaatggagatggagagcccgcggagcccggaggcggagatcgggcacagggtggaggacctgtgggaggtggcggagccgcagctgtcgccgtccgagaagctcaactcctgcttcgaggacatcgccgtcgcctccttcccccgcccccttggctcgcaaggtaggtaacttactaacgcctcttcttcctactttgctcctcgctgaccttgccatggcctctgctgctgctgctactctctgattaatcagttcttgatgcgagctgagctgacatgaccatttctgtgtggatttggagtgaactgtgtgctgttcctcttcagttggggtgatggatagatggtgaacaaatttaggcattcagaattcttgttggaattgatacggccagcagccagttagttcactgattgaggaatgcgtttgctgtttctcctgattggattgaagtcattaaactggtagcattagaacctatcttgtcactattgtgggttgagccatcagacatgtctctttcgtgtcctgtcctactatatataccactacatatatagtcatttcattcctttgtgcagttgctggggccatatttgcattcttttctgaagcaaatgttccttcgtgcgggttagtgccgatggcctacatcctacctccagcctggccaatttttgttcttgacgggttgaaaagggtggcactgttttatgcaatcagtgacaatgcaataggggattgtaggacttcggtcttatctgtatgatgaagctttttggttttagacagtgaactgtatgattgagtcagggggagcatggtgattgctcttgttgaagggtccttttcacttcttagacacgctaaagaagaacctttctggatttcctttttatttgtgccaatatgtgaacattcaatggcatataaggaatcttctctataaatatagatatctgcttactgacaaatgacttcgctctcatgattccaagagatgttctagaacggtgagggtccatattaccgtctgatttcttaattgtgatctttgctataagactaagcagaaaagttatttgggaaaataggacctgtttaaacttgtccttggctttcgtcttgttaatatctgtgttaaataatgtgcttttcgttggtggttcctggtggtcgatacagattgtacagataggtgtagcttttaccaatagtcagcattttgcctatctcggctcacagctatttttctatggccacatgatgttaacatggcaacctcaacttcaaaatcctaagttggacatctggtaataacaaaaatcatactccaaaattgttaactgaactggtttgttgtaccaatgccacattgagtgtgcttttattaaactcattgacattatacggatctgaagttttatacctgaaaattgacttcactatagaaatttgtcatgagggagaatgcaccttgacttgtacaaaatggatttccaaccatcaatatatattgacatgaactcattaattgccacaaaaggtcatatcttgttacaatgtcagttttatgagcataccatgtctgataagcagttcctatccactttgcttctttcagaacttatgttcttggcttcacagaccaacctctttggtatttcatctccatgcatctcgggatcgataaacctgttatccaatccatacagatattttagatgtgctttgcttgagttttggaaaaagtgtagtctttcatcatctttcggtcacacatgctttcacaaaatcattttttttaatcattgtactcaagcgaatgtgaaaaaacaattgattctgaaacatgctggacctgtgacatcatattatgcaccaagaggctagtatacttatatgcaccaagagattattctgaaatgctctaatactacatgtatatcataggctcaaaaagttgtcaggtttaattatgcaaaattgattactggaatattattcaagtaatacgaattgagtactttctatataccataggctcaaatagtttcctgtagaacacttttacttaatatggtttcctgtagagtgcctctttttttttgtgcaaagaatgcttttacagctacagttttaacaaagataaacattttttttcccaagaagaacctgtaatctatgattttggtattatctaatcatcaatttaagctacaacttttatgttctttttctgcagtaatcgagataccttcaaatgctagtctggctgatactgttgaaatattatccaaaaacaaaattttgagtgcacccataagaaatgttgatgctccagaagatgctagttggattgacaaatacattggcattgtggaatttgctggtattgctatgtggttgctctatcaggttagccaccttaatactagagcactacttagttcctctctgtttctttttcagaaaaatatttgtctaatattatgttgtatcatatcatgctatatttgtgcacgctgttgaattttagtatcataccacgctagttgaatttgatgtatcatatctagtccagctttaatgacatggtagattctgacatgcttaatatgtatcattaaattcaaccctaattatggtgttcacaatgagctttcagtttcttttctcaagtattgacagcattttcatttttttttggaattcaaatacccatgcatgggaagtacctcgatctaggcttagtatttgttggactgctcatcaattcattcacaactgctaaaccatgaaaacacatttttcagatattacttacatgcttgttctttgcaaaataacacttgaatctgattgaaacacaaaaatagttcgtttaaaagaaaaatactctgatatagggaaggtaattttatatttggtgatacaattataggaatttcatgaacatcccatctttctgacatgggttgctttttctgttcctacaatagtctgaggctgcagctaatggcacggctggttctgccgtagggtcaccagtagccaatctagtatctaggctaggctctttcacattcagaaggacatcatctggcagggtagaaaccaccactgacccagaatcagatgaaaccgcatcggtcggtgggagctttttcgaaacactcacttcctctgaattctacaagaacacaaaggtgattttcttttcctctcagttgaaagcagttgtattcaccatgatccattcttgacaccacctgtgccaccataggttggcgatatctcaggaagcttccgatgggcgccattcctggcactgcagacatctgacacattcctcaccatgttgctgctgctgtccaagtacaggatgaagagcctcccagtagtagacattgggggagataagattgagaacatcattacgcaatcttccgttgtgcacatgcttgcagagtgtgttggacttccttggtttgagagctggggaactaagaaactctccgagctggggcttcctctcatgaagccatgcaaactcgttaaggtacctccaaaacttcaatgggcttcactcgtaaatatatgttaggcaccttcatacgcatatatttatttcaagtaaatacaatgagaaatttaaactcctgttcaaaaagtatccaaaagcacattgcaaatgttgtattcgattattagcattgcttgcacaacagttcttatgtgttcgtgccgacggtgagtataaacagccatccgactgtttgtgtcaacaaggtttaagcaagataaaatttactagaagcatgctgctttaatagctagaaacaattgcctgtaactaacctccctgtgcaagcatgttatatttgatcttcaggttcggggcactagttacataggttcgacaataaactgttttgacacacctgtataatacaggggctgggggtttagaaggggaatattaaaccttatacagcgccatctacaatttttccttatttttctgctcccttccacatgagatctataactgttctctgttgtcaaccaggtaaatgaagaccaacctgtgttaaaagccttccaactgatgagggaaaaaggcgttggtggcctcccggttatggacacaagtggcacaaaagcaattggcaatatcagcatcagagatgtccaatatcttctaactgcccccaacatatacaaagattacaggtttgaagttcttaccacacttgctcctattcttttcccatgtttgttcaccaatgcaaaaaaaaacttggtgcttcaacttgcactcccaccacatgcatcaagacacacttcaaatgcattgtaggaagtaggaaaaccaactgcaacttttaacctttttgatccaaccacaggacaatcacggccaaggatttccttaccgcggtccggcaacaccttcaggagcaacacgaggcctcgccgttgctcggctccgtcatcacatgcagaagggatgatgaagtcaaggacatcatactgaagctggactcggagaagatccacaggatctacgtgatcgatgacaaggggaacaccgagggggtcatcacgctgagggacataatctccaagctggtgcacgagccacgccattactttggggatttcttcgatggtgttgttcccctgcctccaaacagcactgtatgacacggcccttgagatttcatcacgctggtgtgctcttgtaaattgtacattatgtccctttacgacaatggttccaaatggatgggaatagtgtacagtttgccttgtgtagttctttggcagtggaacaactaatggactaatggatagcacgggtgtacattcaataacttgaaataatatctgagctcccttctgtatgtttttatgatgagaatgacgtctctttcttatgttcaattgctcccttctttttttctttctttttcttttaaagaatattggctccatggtttcatcttcagcttatcagccataatcaaaatttgagtttttttgctgcctgaactcagaaccgaaatgctaaaactcagcatcctaattgctgtggaattctggagtcactgttatctctggcagtgtcaaaaaacagttaaggagtacagaagcggctccttgtttctacagcctattggaagcattctagttcggatgccgaagtgtgttcatccacttaaatgtcttgaaactgtgaccagagaaaaacaaaaacaaacggtgagtcaaacatcaaaataacaaaaggacatgaaaagcgagaaataacatgctactactaccaaataacaaatccagtatcaagtgaaattctgctcccctcctgagaaagttgctgtacctgctttttttttctttggtacgcatgggaacaactaaatttttgcctgtagcatagcaagttacttacaagtttgtggtctcttctgcaaaaaaaaaaagcatttaaattacttacaagcttgttctttacaaaatactccctctttaagacatctctttagccccacactctcaagacatgggcaaccacaattgagagccggtctctagtgcctgacagtaccaaggatcattccagcattccatgttgccttccactacatctgtcaacgccatgacattactgaaattaatggatctgcactgcttgattaagtatttgttgttttgtctgagtcagaaccgaaatgctaaaagttagcatcctaactgctgtagaattgtggtatcaatgtgatatatctgtgtacagcatataatcgctgactgtgtcatcattttgtcagcgaactcccgggttttgctctaaccaattttctgtctccaagacatggatattttgcagaaattgtgcttaatttgaaattttgaaaaacgttagtagctaatgcagagagtatgaagtctatgacatactcgcttctgtggaagacgtgctgaagtacagcggagttggatctggaccatcatagctgtatcacattgctaatctgcaaaattgtgtgaacgtactcttggagacatgatggacctgacaagaatggcaaaaaaagtcaaatcttgatggcatggatctggaaaacagaaacaatgaaacagctatgattttaataaacgttcttactggcacttgataaaatttacaaaatcgccattgttatcatcatactaaaacaacgctacaaaaataggtgcgacacagtggcatgcctactggtacattattgaagaaatagcttgctcgactgaatggtaggagtaccataaattaaaagcccaaaaataaaccaatgagtaaatttcacaaaactgcagttattttgcacaatttatcacaaaactacagatttaagagcttatttcacaaaactacagatttagtgtctacttttatcacaaaactacaggtattttgtataatttatcacaaaactacatatttaagaatttgttttataaaactatagatttagtgtattcgtttatcccagaactacacatttagtgtcttcttttatcacaaaactacaggtttagtgtctccattattccaaaa

SEQ ID NO: 69396 - DNA, 1234 bp, Oryza sativa
  unsure (1)..(1234): unsure at all n locations
tactaataagtcaacatagaaaagctaaaatcaaatcaaaacatagagaatgtaccaagaatactaacaagccaccatgtaataaatactgaagtgaggtaataacatactgaatataggcatcatctcgaccaatctctgcacagtactgctcagcagcttcactatcctccagtttccttcatcataaatgaagaagaaccaacaagaaagttagggaacagaacttgtaggggtgtacaagtccagttaaacaaaacattactgctgaaatttacaagtaacaacaaaccaataaaaaataaatgcagcacaggatcttacagcgctaatatctgaagtacaatgttctcttggcccatcttcctatacaaaatagcctgccagaaggaaagagatttttatgtcaaatatgtcagatataagcgatgaggactatcaagcaagcataaatttcaatgggtaggacacanaatgagctggcatggaacgcgagaaggaagaaataaattgtataatcaccttttccagccatagctcagattctgaaatcacatatagcacttcttctgggtcatacaaatctgacgattgcaaaaaaaattgcaccttttcccccaatagataaatgaactgcatatcagaatcaaattctttattgtttctctcttcattgttggatcccaaacggactgcgtccatggcagatctggagagggacaatgcatatgacgtgtgatagtgaggctcatcacattcctgttcctcaatcaaccattgcaaatatctgcaaaacttagcatattcagatttcataaaagctgaggaatttattcagcaagagtacaaaaggcatagaacacatagagctttcaaagaaacatgcaaatggtaactatatttgattaagaactacctaatataatacgcatatgatacagtagcttcaagtcataatatgttatttcattgagcctcattatgtttccttcgtatatatttagaatacgcttaggtcctgtttgatttataccccaattcaaccatgccaaataattggcaacaccaagaaatttgtcacccatttggtttgcaacctaaagaactgccattgccaaattatttggcatcactcttatgcccatacaaattagaacccactcattcttgccaaaatttttggcaatagacaaatcttgtcattgcccaaaaaaattggtaacactaggaatgg

SEQ ID NO: 69397 - DNA, 637 bp, Oryza sativa
aataagggaagcaatcacttatagcttcgacgttgatgctgtagacgagcaggcggttttgttcacggcagctggcgcggtaggccatggcgtcgtgtcggcgagcgcgagcgacatgaggaacatggcctgcagccccagcccggctcgtcaggcgccgcgccgaacaccacggccgccttggtgacgacgtagcacaccggacggagcggtggtcatgggagagcgtcccctcgccatcgccgccggccgtgaccccatgttcgtcaccgcctacgccgtgcacccggacgggcacgacagcgacttcctcgacttcctcctcgagctcatggccgtcggcaagatgaaggagcgggtcaacgtggtgaacatgccggagagaggatggggatgacggaaagattgacggggaggatggaaagagtgacggagtggcatggtttcaattttagaaatttacagtggcatccagcagataacgtgaatagtagtggtatatttttgatttgtcatatttgcagtggcataaatccaattaacccttactttttcaactatcttctttggcttttttgggagcataggaataggatcgactcctaacaattaatatactagccttattaattaattg

SEQ ID NO: 69398 - DNA, 760 bp, Oryza sativa
agaatagtgacgatgatactctagatgctatgatattttttgagatgtcgtattgtaggtttcatgttaatgggtgttctggataacttctgtcttcgacagatcggcttcgatggctatggcctatagcggctcagttactctctaacatcaatttttgttttggtttgatgcctgttctcgacaatgatgtgtgtggaattcgatcgacgcaacgatcaaagttgattttagacattctgatttttcaatatgagaaaaacacaaagactacatacaacttataaagcattgagaagaaaataatagttatgcgtattattgtcaattatagatagtaagtcactatctttaaggtattataagttgttttattggttttaatcaagcagtgatttaaaaaaacctaagtctactgtaaactgtaactaaatggtggtagaacatatatggcctcatcagatggccagatgctttggctgatcagccatttaagcaaaataagctaaccaatatacattgaaatttagctgaattagaggcagttttggctgatcagccaaaacatttggccatccgatgaggaccatattatacacctattataacacaaatcaaacacaatatcgttttgtctaagaaaaaccatattaatgtatactctcatagtagggtatgagtattggaaatatcaaaatcacttacctattcattcattttaaaatataaaaaaattttagttagatatgatgcatattag

SEQ ID NO: 69399 - DNA, 3688 bp, Oryza sativa
  unsure (1)..(3688): unsure at all n locations
ccaagctttagcacacaaataggacgatgattgattcatacttaccagtacttatctctacggttgtaaaaacagagtcctccttacatccccttgctcctccccccaacacacacctgagcgctgccccaccgtgaaaaaccaaaaaaaaaaagccattcatacctcagtttagttctaactcaaagaattataatttctttccatcaaggctcagatatgcagaacacaagatgcaccagtgtcaattttcaataacatgcatcatgtggtccctttccgcagtacatcgtagaataggatctgaactagcaattcaggagacagggaaacatattaccctgtgaattcgcctctcaatccatcatctgctccttgtacaattcacctgctcctcagggaaaaaaaagaaacggctaagcttaccatatcatacactattatcttaccgcttacagtagcaatcaaacaaaatctccccgagaacatcgcttgaagctaggtttaagccctatgcgaattacaatagacaacactcttacccttgacccatgacgggagatgaaatgagaaccaggcacaaaagggtgaatgtgctaaaatgatttaagatgtatcaaatctacacctctgattttaagtcagtcagctcaagcctgaccctagatgctcaactacagaaggcccaaatgacagatgatgccttagtctagttaatcccttagagtacattggagaaccttattaaacctgagagagtacattcttgtgaaaccaaattcaacaaaaaaaaggcgacaaaacagatttagcggctcttcttgctttcttttgcagcagaggattttgacgggcttgcaaccaggtagataaacacacccgccaaggaaacaacggagaccagcgacccatattttcccacaagtctctgcagatgacgttnggtaacacattagatcacaatgtctagccatatggttttcttttcttatcgcctatttcctacttagataaaacacataagtttacataaaacagagggcaatggcagtaccttagcctggaaaggtcaagtgcaaaagttgcatatccataagttgagtaccagcaccaaaaaagtaaggcgttgagacataagaatcaggaaaggttttactcttaatgaaagcaaatggtatgagataactaaccaattcaaacttctgttggggaggtctctcagcaagaatatcaagtggaaacatgggcgttgagtaagcctccttgagaaaaataattggcagtttaaactcaagaagagaatagtgcaggaatagtatggtgaaaatgataattagaacaccaagtactagggtcgtaatgagctatttaagctgagcaaagttagcccctttcactatgatccatggaataatgagatcgatcacactgcagtccttagaaaaggctcatccggtgctcaatactaaaggtatactcactcgattgtgatggcatgtgaaacaaagcatcacgaaacgaaaattcaagtttaacttgtgaaacaaagcatatgacaagcatcaaattgcatgagtacctgaagtgtaagtatgaaaattttgatgtacctgaagtgcggcctttgtgggaacacggtatgtgataatggcaggagagccctgaaacttgccctgcactttggtctccaagatgaagttgtgggaagcagtagcaccactgaaagcacaagaggtaaaaaggattgtcaaagggcaaatattggtgtgagaaagcataagtaactagtaagtgttgttactaacggatcaagtttttccacaatctttgatgtgggtccagagataagttgaaaagcctcctgtggccaagagtcgtcgttcaagctaacatcataggcggtcctgtaaaaaatgagagagagagagagagagagtagtaancaacatgatagaagaatagaagatgaatggttgatggcactggcagtgaagaatatagggcctgtttagatcccaccctaaaattttacaccctatcacatcgaacgtttgaacacctgtatgaagtattaaatataggctaaaaaaataaccaattgcacagattgcgactactttgcgagacgaaatcttttaagcctaattgctctaagatttgacaatgtggtgctacagtaaacatatggtaatgatggattaattaggcttaataaattcgtctcgcggtttactgtaattagtttttttattagtgccgaacacccaatgcgacaccctatataatacccggaaacgccaaaactttacaaccctggatgtaaacacccccataataaggattccggttccccttccctaaaatagcagtgtggttagatagatggagaaatggattagcgattgatgtgtgtgtatgtgactatcaatcatgtcatgtcatgtaggagtagtatatatgcacaatagtagcgtgataatttgtgttatcaacaagtgagtcagcttgacattattacacagagaaagggaaacatgggctcgcggctatctatcaagtctagctaacagtaggaattcccgttgtttttgacctatgcgaattaatcaataaggaaaggcggatagagcaataataggttaacaaagtgaagagagggagagagagatgtggatctaaatctgggggaagagggagatgagatggggaggggactgacgcggaaccctggttgtagaggttgagggtgacggcgaggcgctccacgcctggacccgggcgggacagcgcaaccttcttctgtgctaccacgaacggcgcatcctgcccggcggcggcggcgaagggcacgaggaggaggaggaggaggaagaggagagatcgccactgctgcgccatcaccgctcacggagattgctttgcttcttccacctcacctcgaccgaggctattgttacattacatgtgtgttcaagcccatcccatctattacatgggcccccgtgaatactatgcccatcagcccattttactacctcctgcctcctatgcggccccctcccctctctaccaaaaaaaaaataataccacctcctattcttattttttagcattgtccatatttatatatgtgttaatagatctagacatatatgaatgtgaagtcttataacctaaaactcaagaaaaaatatttactcaggtcctagttttaaaaaatactcaaaatacatataaggttaacaattgatgtattcatctaacggtttaaaaatatgaattgtttatgtagcttacttacccaacatgaaagtttatatataaatttcaagttttcacttttttaaaaaaaatatttttgagttttttatgagagagaaattacttacgcaaaagataattgacattagaaatgaggtatgttctcgaaaaaagttacattaaaaacagcaaaaaaaaaattcttgcagtatataatggataaataattttttttaaaaaaatataaaaatgtaaaatcttaaaactagtgcataaactagcattttttttcttttgaaacttatggtaggataaatcaaatattaaccgtatatggtgtattttaggtatttttgaaaatagtatagtccgatggtatattgtataataattgataacttaccgatatattatagaaagagacact

SEQ ID NO: 69400 - DNA, 1954 bp, Oryza sativa
gaaaaaaattaaaaagacaagtcacgcataaaatattaatcatgttttatcatctaacaacaatgaaaatacaaattataaaaaaaaatcatataagacggacagtcaaagttggacacggaaactcagggtttgccttttttttttttgggacggagggagtatttactaaggccctgtttacatctcaccctaaaattcatcctatcacatcaaacgtttgaacacaaacatgaagtattaaatatatgttaaaaaatagctaattgcacagattgcgactaattgctctatgatttgacaatgtggtgctatagtaaacatttgctaatgatggattaaataagcttaataattcgtctcgtggtttattgatggattctgtaattagtttttttattagtgtccaaacaccccatgcgacatcctatataattcctgatgtgacacgtaaaactttacccctcagttgctctttgtacatcctctggttttggccttatactgggcactgcactaggtagaaagaactagctgatgctacctaagtactacattgcaggcttgcagctgatgaggaaataaccgatgaatttggtggtgtttgaatctcctaaagattaaagattaagtgtttcacgtaaaatgagaggataataacgtgtgattaattaagttttaattattataaacttaaaaatggattaatctgatattttagaacaattttcatataaaaagttttcgcacgaatcacaccgtttagcagtttgaaaagcatgccactttaatccaaaatttaatccaccgttttcaggacattcgaacggggctgttgctagtgttgctgtgacttgacttgcaacaacacagcttaatctgggttaataatactacaatttttaatcaggaaactgggctataataattactagtaaaaaaaataggggagtttatatccaatctttttcttatatgcaattcaagtgatgggactataggcagcaagtactagtgtagtatagtaaacattatggtgggtagatatatatatctccaccgcacattcctcatcgagtggaccttgtggtcagctgcatatccatacttgtatgtagagaagaatgtaatactgctccagtaggcagcatcctctcctctcctatatcatcatcatatccaatccttggttggttggttcgttcacaaggaggaaagcctcgagcatcatcatcagtaggaagaagaagaagaagaagaagaagaagagcaacaggaagaagcaagcaagaagaggaagaagaagaaagcaaggagaagaagatgcaggattggggtccggtgctgatatcttgggtgctgttcatcctgctgtcgcggggcttctgttccagataccaggcaagtgcaggttgatcgagttcggcaagttccagaccagcgtcgtctccatcctcgtccacaccatcctcttcttcgccctggacgccatcttcctcgtcgccatcggcgtccagatcaaccttggctcctctccctgattctctctctttgtttcttctaggtaatctcaattgcatatgtatagcagtatatatgcacctccatccatcatctctactcaccttagctcgttaatttgtactactatttgtgtgttccttccaattcttggcataatattgtgactcaaaggaattgatttcagagttactcattacttagtttcttcctccacatatatatgtagcaaaatcaaaagtgcaccattcatagcatttcaagtaaattacaactagcaaatttcccacgcaaaattaggcgaagccaatttttttctttttctttttagtaagagctggatttggcatacacatatattttgtttccatagatatttgtattttgtatacaatagatctttgaaagtagaattacatttgatatacaacca

SEQ ID NO: 69401 - DNA, 9331 bp, Oryza sativa
atatatgctatttacggtggatgttttggtgctgagtatatcaagaaattaggacagtacggaccatctactttacttgtccagacatagaaatcgcgattactagaatggaatcattatgtagagactctgaacatgtgaattggaatggtggctacgtgttgctatttgtttatgttatttcttgtacactattatatctatccatttttgcagttaaaagcacaagggtaccctaacatccttgtcactgctggcttaaatggtaggtggtctttccattttgagtttctgttgactggttaattgatgtatctgcacagttaactagtttgtacgaaccagatcctcgtgtgatgtactcggaaccggcgaaatatgtcgcaaagctaagggaactgaaaacggatgacaatcttctgttattcaagtgcgaacttggtgctgggcacttctcaaaatcgggaaggtaagctttagatgctgtcattttcgcactttgtgttcaccaaaggaataagatccaacaaaatgagtgactgttggatgcttgcaggtttgagaaactacgagaagatgcgtttacttatgcgtttatcctcaaggcactgggaatggctccaaaggcagcgttgtaaaagaaagcccttctgttccgggttaagatggtggcggttctcaagcattgattggctgattgtagtaaaacttaacttgagtcgatcggttgtgttgtgttgtgttgacatattcgactaaggccctgtttagatttcaacttttttctttaaacttccaactttccgtcacatcgaacttttctacacacacaaactttcaacttttctgtcacatcgtttcaatttcttcaaacttacaattttggcgtggaactaaacacagcctaattgatgcaagtcagtcagacattagctatgactattgactatggggttggttgccgcattttcatcctactactggttttcaaggccattagctaggacctgccgaagacatacatgtatatcagtacatgtatgctactatagtttgcaaaaatggttggtttggtgatttttttttaaaaaaaaacttaggaattggagaggtttttttgtttgatctttaagtgtattgaccaaaagcagcaagctggccggctgggtgggccaaaagatttggagtctcgcatcgctaggcatgatatttgttgaatctgtaatgtaatcgactttttttctcagatttgttcaatgtatcgtttgctgcggcaccttggacattccagcgtatttttggcacctaaaagggtgtaattctaactgaataaggtcagctacaactagttttcagagattttgaggactttgccacggaccagctgaataaacacatcgtgtagttttgattctttgagaaagttaatataagccaaaactatactttctttgattctttgagaaagttaatataagccaaaactatactttctacgcgaagctgaatttatgtactagtacatcattgtagaactcatataagatgaaacgattccagtttgtagatgattcttgcgttccctgggtcccttggagtatactcaaatatatgtatggcaattcttgtttagttatcgcaccatgtcataatttgctcctttcaaactcggtatgcattcggatagtaatagtaatgtgatcagctgagcatttgctgacattcgtgacatgcgatgcaactggtggttactcagaaactggagtacatggaaattgcgtgcaagctttgttgtggtggttagtttgattcagtgcaagatggaaatgctcagccgagttgcttgcctacattggaaggatggatcagttggctgccatgaaacatttcaatttccatgtactccagttgtgacaccatgtcttctacatttgcgagccaccagccagacagaaacaccaatcgcattgcaagttttaacaccaaatctccagtgctaagtgctaacctaccaggaataatcatggtctatctatgcttgctcactgctatctttgactcgccggtgttcttttctttctaccttcctcgctgagccacctgcaattatgaacgaaaatgaactgtaacctcacatacatatcacattgacaagaaaccaagaatagcactggtctgtagattttaaaggactaagtatcaactgaaaaatggatgggtatcatcggagggaggatgctaaatctgacttagactgattaggggcaaagcgatcgagcgcagcttggggtctgtaatacaaaaacgcatgctagggtgatgctcttctgttcctaagcaacaacaagacgaacaaaatatatgggagaaggaacaaggcatacccagcctgcgtctgcttcctttttccattggcacccattggcgtcttggatctgactccctcagactcagagtcactcgcaatgctgggaaaatacgcatcagaatcacttaagagagccagtctatcaaaaacacttggatcaattgaggtttccttaagtcgttctttcaaagtttccagcaaaacaatccctggaaattaaataaaacaatcgacccaacatggatcagcaagcaatgcgagatagataaagaggataaacaagaataagaaataccaagagcacgcagcgtgggaagatcatagtcgtgaccaagcacagcgaggctggcattttccgtgcataccatggccaaatccttcaaggtgatgagcaaatcctgcgattgagcagcccctcaatcggagatgagaaaccggaaaaagaatgaaaggcagtggcaaaagagaggaacatacaagctcggggtcggagagggtccggagccgtcgtgagtcttgttgctgcccgccacgagtaggagatgatggctcttcagcgttggtagacgcaggttttttagcctgagtattcaaagttaattaaattcatatataaagaggttcacagaaacacagatcaaaagcagtggagtaccgataaataaatagttcaatcgtagagataatataaagtaaattgaaaacagaatagaaagaaaataaatccctgcagacatgcaatattgatatctgaattatgcaggttaggttagggagaagaggaagcagcatcggcaatctcatcttgtttctttttggagagaaaatggatgagatagcctgacagacataatatgtttgctgtatttggttggtatgatgtgctagtatttgatttggtgtgagagaatcattcatgtagagtatagaattgagaccctacattcccaatcaataatgagaaacagtactagtatatgggaggggttggagtggagaaatggaggatggggaaacttttcacctgagctgaggttgaggctgagcctgagctgctgtggtcacggtctgctggtgtgccgacgtccctcatgccggttgcccctcgtcgtccttcagtggcggagccaggatctcttcatgcctagggctcaaattgaaggctaaaactatccatgacaattcatacactgaagtacagtgcgagtgctgaaaaaaaaaatgcaagactgaaatacgatttctaatcatacaacgaagtacagtaaaagtacaatacctaacgcaacatatcctcgtaattttcactattcattaacagtactacgtagagaacctgaagttgaatccagaaaataatattacatatgtaagtgattcatccattaatcattcatcttgttctgcagctcagttttaataatgttcatagctgagaaggctctttctaccattgccgtagcaacgggcaaaattaaggctaattcaattaagcgatataacaatggaaaaaccgtgtgtctattacttttaaccatcttcacaggctcacagaaaggttgatcttggtcagagcagcttgagaaatccaaatcagattacttacatcacagataaatgtgtcaagttgatctctgaagactatacaatcatattcaaaatagtctgccgcatatatcttagcaagttcaatgagcttatcttcatcataattggtaaaagaattccttggatcaagacaagtaatgcatctcaatagccgagtagacctttcagcaaagcgattgtttaaatcaacaataatttcatcaagtaccacattaaatatttcattgctgaaatgatgcaagtaagttacaaattgtttgtgatgtttctgggttggagtggactcactagactggacttggtagaattattttaaagttctatcctcttcatctaaaaaatcaaagcaatttctaattgagactaattgctatcaaaagcagaataaggatgtagatcgaacatcaaagattagagagaagattgacctggatttgatttggggaatcaagctttggatgagaaaggggaactgcgacgccaatgcgcgcgccgctgccgagacacgccgccgatgcgcagcgcagtcgttacagaggaagcgcgctgcctccttccgtcgattcgcgccgcttccttccgccccgatgcgtcgctcgctgccgctgtggtgggtggttttggtttttcttttcttggacagagagctagcagcaactggaaaagtaaaggatggggagagatggagacagatgggcgggcgagcacttggccaccggcggcggcggcggcggtggcggcggcgttgttcggagaggagtcgtcggccccccgggaagaaggaagaaagagacaagggaaggcaacgtttcggcccaataccttcatgggccggctgctccgatatactgctctccatgtgtatacgtatggaaaataagttcactttgaatacctcgatttggtccctgaaccgtaaaaccggatacaacacatcacccaacttaagtgcaaacaaagttccccggcaatattatccctggttttgacacctacatgacttctttgattaggtctttgtcccacgtcacattgacgtgacacttacatgatagctcgataaaaaaagagcaaaattgaaaactagaaaattgaaataaaatatattgaggcccatatatcggttaaacaaaaagataaaaatgccaccctctctacctctatctcctccctccgctggcaagctgaagttagtagggaggccgacgagcggggtgggaagggaggatgcgggaagggtgtccataactccatgtcaatgaggagggtgacgaaggggagtaggccagagccaaagtcgacgatgacaccgatgccagtgtctgcgcgggttgtgaaactgagccgctccagcccgttgcagagaaggggtgctggtgtggtgctcccagaacgcgacctccggatgggcgtggatgtggtgccacacgcgcaccatccagtcccgtgcgccacaaaagcgcctcctcataacttgtagaggcagaggaaacaataaggaggaagaagagaggagccactctttctccaattcggtcaccactgctacgattcggtctccgccgtacctcatttctcctatgcgagctccgcctggcctcctcttcctcagctgctccctcatcaacgtgtccactagccctgaggagattgtttgcgccaatagcccaaagcccgtcatgtggaacaacgtcactatgaccggcaacgacggcttgccacttcaacttcgatggcttggcggatggaggaggagcaacactgtcaagccgtcttgttttgaaggaaaagagacaaggatttggggagagatgttggagagtcgacattagcgaagatgctcactcccttgaatctggaatcgtagtttgaccttggcgacattgcgacaaggtggcgcagcgcaagcttgacgacgaggtggcccaactggcccttttccgttgcctctgtcgtatcctcctacttcaccgaagacagctatgaccccctctcctcttctaccacttaggtccaccggagcccctcttcgctaattgcccacagcaatcaccaccagccgcatccggggaggaagagaggagaaggggaaggaaagtgccaccgcctgggggagatagaggagagagagaatgaggtggaggaagtgggccgcactgaaacgtgggtcccactattttttaatcttattgtttgactgacatataggcccacatattttgtttttatttttaaattgttaaattttgcttcatgtgtcacatcagatgaagactgagtcaaattagccacgtagacaccatgttagcttaaacctcagtttaaactgtcttaggacctatattgcaccagttgtgatagttgagggactcgttgtttttgtattgcagttcaaggtcgaaaatgctgtcaagtaaagggacctaaagtgaacttattcctatatgtatgtacgcatgaatttgctttgctgaatttctgttgaatcaatcacctctgagcagagctttgagaagaggaaagtaaaagatcgggaagataaagatgagtcattaacgtctaattaattattaattattttaaattttaaaaaaagttaatttgattttttaaattaacctttatatatatatattttaaaataaaaatgtaccgtctcgttgtttgaaaaacatgcatacaaaaaacaagacaaatccttttttgcgttgtcgacagtttaaaaagcgtgcattcgtaaaacgcattcgtaaaacgacacacatcttcctttcttgttttttctcctcttgtcgacattacactctatatataaggggaaaaactacattaataacaagtttcggtccgtaaaagaaacagcagacctgacaattcattgcatcacaaaattagtactagcatgtcgtgctgtgccaaaggagtataatcctacagtggaaggaacaagtgataaacagatagaccaatgagtcagtaaccaccattttcctttttgttttcttctagcaacgtgtttacaattgattgaaagtcaatcccaccaatgagagtatgagacgagacgaaagaaaacagtagtgtactcgctctcctgtctaaaaaaaagtactagtaatactcctctcctggcacctatttttctctttgcaattgagcgccagtgaagaatgaatgaaaataacagttggtatgtatgcctatctctattttatggcagttgcacatcaccaccatcatcatcttagttagttggtgacctcctcctcctcctccttcgcctggcagcgggccaacacgcagtcctccatgaattcagtgagctgagaggtatacagctctggattgctccggtagtggtcgacatgaggcgacgacacaaagtcgcatgctctcacctcatgcccggctcgccgttgactctccacgaacgactccaccgacttggccgggattaccctgtcagcagagctgtatatgtacagctgtgggcattttggctgcttcgacgacaatagctccatcacacccgacaacttcctgttgttaaaaccaaaagtaaagttgcttatcaatcagttatttgttattgtcaacggcctgcatctatcttctatacttaactgagattcaatcaaagtcatacactttatggaccaatttttctaagcatcaatcaaacaatgcacaattgtggtgtgaccagacagagacagaccacaacagttggattggatggaataaaaggcacagagataagacccaacttttctcaaaatgctaatgactacttgtgaacatggctgagatgtttacctattgatggctgggtagtttaaaacaacatcgaacaacttctccagcgctgaaagtagaatggcctcgctaactgctggcttgggatgatccttgttagactccacaactaggacatcgggccttgcatcatttggtttcactccttttgccgctacgctgtgttttttcatgatagcagctgagaagcctgaagcccaaacctgtgttccaacaaaacatggcaaagtaactgcaaatgtgaaagaatgaaataataatgaagcacgtccatttgacacaacaatgcaacacaggtgcgcacaaagagacaattagccaacagttcaagaagcataaaatcatctcgaatgctcacgatgagttctttgaaccatgcaattaaatagcaaaccctacttttgttccaataaagttacgtgttctaatatacctgagaatcagggacagcaacaggcgctgagtccactacgcagcccttaattttgtccattgcagaaggatcctgcctctgtaaattctccagtatcaccccatagctgaagcaacagatataaaaaaaattaagcccgaaatctcagaatgaatgctaattgttaacgagaggaagagcataattaataccaaagccagccagtgttactgaaggtgtggaaaacaatcttcttcccatcctcctcgctaacccaatcagcgagatgttctgagagcatctctacattcttctcagccttccctccaacattgtagctaacaatgtcagacatggggagggtgaaggtcactgcatggtaacccctggaggtataccaatcggcatatctcttgaggtgcttctgcctcgagcccaaccacccgagcagaaccaccactgtctgagacttgccatgtgagtcaccgcagaccttagggtccggcagatgccagaggtacagaacatccggcgatgacgaggatggcatcgcagtcgtcactgcctcctcttccgagtagtatttggcaaactttgcatagtggtaaaccgtgtggatgacaggcaaagatgcaggaggcgccttagccgggtgcgaagtctgcagattgcgtggcaggaagtgcaggcgagacatggcagaagcagaaggtgctgctgatacatcgggcctgctggctggaatcgagacgacagcttcggcatccacggttgtgtcaggcaacttgtggtgagacagcctgtcaggcagctcaagggaggagacggcggcaaaggcggaactgccatggcagagagggggcggtggagcgaagccatcatggagaggagagaagttgttgtgaataatcagattgttgtttagtctccggcctcgtgttgccctaccctgtttcatagaggagaggaaaggaacaaccagagttagctgtcagtccgatccggtcataacacgcggtttgcaaaaattgaattgaataggattcggttggaaatactaataaaagcatatgcgtggcgtaggcaattgaccaagtatgataggcacattatttgtgtcccaattg

SEQ ID NO: 69402 - DNA, 17652 bp, Oryza sativa
aaaaaaaaaagagaagtaagccaataagaccgttaagtaaagtgagaatcaggatggttggagtgctattttgactgggcacttttgctcttctagcattcaaagtactccctttgtttaaaaatataagttttttttattttatttcattatcacataaggctttggccaacaattatatcatttatgtgatatagaagcataattaaccatataattaagtagtacttttgaatacaaatttaataaattcaatttcgtgtcatagaaattatacccaaacaaagtaatggtcgatcaaaatctcactctaacaaaacaaaactatatcttatattttgaaacggtggagatgaataaaaaaaattgagttccacgaagagaaaaaaaaacaactcttcaaactacacactattttccttaagcaacatctaattaattgctctttcccaacatgaaaaatatgtcaacaccatctcttaattaaagtcaaatccgccatatatatatttatgaccagaaacggtaacatgtttagatcccactgtaaaattttacaccctatcacatcgaacgtttgaacacatgcattaagtattaaatgtaggctaaaaaaataactaattgcacagattgcgactactttgcgagacgaatcttctaagcctaattatattgctacatgatttgacaatatggtgctacagtaaatatatatgtgctaatgacggattaaataggctgaataaatttgtctcatggtttactgacagatactataattagtttttttattagtacccgatcaccccatgcgacaccctatatagtacccgatgtgacactccaaaactccacacccctgggtgtaaacaccccctacgtgtgttgactggcatcttgcttctgacagaccagtattcaaatttcaattaatttttttaacccaaatttattaacctggctagggggtggcacaggctcaatgtaccttgctttccttgccacacgcatttcaagttcccgaacatcacagaataagtccttaatcccttcatcccaatataaatggaccctagtatagatacgagatcacaattctaaattcagattagtagtgtcctaagatatgttacatttgtgctaggttatatttatattgaaaaggaggagtaacttaaactcctaggtaaccaatcaatcagatgtgagagatcaatttgtggatggaggatctacagacttgggggcagtttggtttgagaaaccagaccctctatatgatgggttcctcacgagatctttgctcaaatttggtaggatgagcccattcctcatctatgaggtgatcagtgatgatggacaaatttattgcatttctaaaaccaaatatatttaatatcaagtagtattagtcaattggtcatcacatttcgtttattaatccaaagtccatacccatctttttgaaaaataatattgattttatgaaaaatagcaagaatatgattcggtaatcaattatgcattgagcttatgaccctatctaacgaattctttgtgcggcaacgtatatttactagtctgaagctaagcacagtacagatacctcggtttcatttgaagttcggtatgtaaagttgtaaactttaattttcttatgctgagtgtacatgtctcggttgggaacttcttttccctgtgtatacaaaacgaaacgattcagtcgtacataattaattaagtatgaactaaatagatttaaaaattagatcaatgtgatttttttagcaacttttctataaattttcttttaaaaagagaaaaaacatacatcatttacatgttagaaaatgtgcgcacaaaaaacgagagaagttatgatacgttatatattcgaactcatcctaaaaatgtttattaccgagtacaataaattgttacttcctccgtttcacaatataagtcattttagcattttccatatttatattgatgttaatgaatctagatagatatagatatatgtctagattcattaacatcgatatgaatgtggaaaatgctaaaatgactaacattctgaaaagatggagtagtaatttaagacagcacaaacaggttacagattcctttcacacacacttgcaagccactctatataaaaagccctccactttgaggctagataagcttaattagctctctcttaagcctaaagcgagacaattaatttaataagcaccccccaccaccagccatggagcaccaccaccttctgctgcaactctcgccgccaccgccgccgccgccgctgccggcggcgcacctcatgatgagcccgagcttcttcgacgccggcgtgttcgccgatgtcggcggcgactggatggaggacctcatgcatctcggcgagctgttcggcgtcggcgtcggcggcgacgatgatgataatggcggtgtcgacggcggcgtgggcggcggtgatgatcggatgcaagagtggcagaataattgcgagggcgccggctcgccggaccaccagcctagctgcggtgatggggatggcgatggcgatggcgacgtgagccctcgtgatggggagctcggcgacggcgacggcgacaactcggcgacgaggaagaggcgggaccggtcgaagacgatcgtgtcggagcggaagcggagggtccggatgaaggagaagctctacgagctccgagctctcgtccccaacatcactaaggtacgtactcagtgcttgattgctcgcgtcggcgtcgccatggcggcgccgccatgcgccattgccaacacaagcttaatgattgcttggcagatggacaaggccgtcgatcatcgccgacgcggtggtgtacgtcaaggacctgcaggcgcacgccaggaagctcaaggaggaggtcgccgcgctcgaggaggcgcgcccgatcaggccgcctccgccgttcgccgccgcgcaacggccgcagagacagccacgccgcgtggcggcggcggctgcccagctggcgagggccgcggacgccgccgccgtgacgacagcggcgggggcgccgcacggcgcgagggtggcgcacgtcggcgcggcgcaggtcggggaggggcggttcttcgtgacggtggagtgcgagccggcggcggccccggcgagaggaggaggaggaggcgtggcggcgccggtctgcgccgccgtggagtcgctgtcgtgcttcaccgtggagagctccaccgtcgggtgctcgccggaccgcgtcgtggcaactctcaccctcaaggtgcgtcacacccaatgcacctaactgtgtaattatactcttgatcacatctgccacgtcacttaactacaattaactaatgatgagttacaagcgattttacggtcctcagagtaggcattgaaggtgccttattatctaacataaaaggtatctcttggtatcttcaacgtgagaagaaaaaaaaaagaagttacactaaaaattacggtcttttaatactactcggtaactgtaaaattgctcttaagttaattgggtattttattttggaaggggaaatattagcaccatttacctgaaaattatttttcgtaagaaaaaagaagtttagttttggattagagatttagtggtaatgcaattcatgcctatatatactatctccgtttttcttttatgaacctagaagtttcctaggtccgattttcaatatttttacttgtttgatgtggtttttcactggatatttctctattatgtactccccctcttaaaaaaaaaagacaaaccctcagtttccgtgttcaattttaactgtccgtcttatatgaaatttttttataattcgtattttcattgttgttagataataaaatatgattaatattttattcgtgacttgtctttttatttttttttcataatttttttaaataagacgaacggttaaacgttgggcacggaaatcagagtttgtctttttttttacggagggagtaactattattccattgggatatgtggattaaccgctaattaccttgtggtgtgtgtaggttagtgaagcagaggaggatgtgtcggcgatcagcgagtgcacggtgaagctctgggtgatggcggctcttctcaaggaggggttccggccgcaaccgacggtccagatctcctgatccacccaacaccggccgatatcaacccttggatttcatcgccccatccctatgtatacaactactgctctttcatgtgtaacatcctaacaaatggtgtgaagagtatattgggagggtaattgagtggttaatcttggccatccacggccgatcgaacggctagcgtaccacctaatgcttcttcttctttttaataaagagtggtgcatgatgtatacatataccgtatttcggataattagatcaggaatgaatacttgttgtatatttttcacggttaagattatgattaggaagagtgagattgtttctgcagccaaaagctctcttggggactgacgtgtatgcactagttaaaaaaaaaactgattcggtgcaacttttgacaagaatttaggaagaaagtaacatatggcaagatgtcacacctgaaccaaacttgtatgtgagtaataatggtactcacagtaggacaggtttagaagtaaccatctctgattggaagtgagcttgtaggctaaccgtaactggttgcacctacaaaaatcgatatttatttttgcatatggctctttataggttcacatgtcaaaatctattttcgcatacgaacatcttaccagtatgaaaacaaaaacaagtataatttcgcagacggaccactgttaacagtgaaatttggtaatcggcaaagacgtcatcggcttagaatcgttatcagctgtagcatctcggaatcagccgatgtgagttatcaagtcgccaatagtcggattcctgctatattcggttaaggaaatcaatctactaaaggaaacttatccctaagtgaccgagtttaaagaggatgcggcatggcagtttatctattaattaggaatagtttgttagtttccttttatctttaggaaacaatgtttagtgtccgataaggactttatattttccttttatctttaggttagtttctttcttgtccgacaaggacttgtatcaacccatgggtataaatatgtacacccggggtctatgtaatctatcctcacgatcaatacaattcggcgcatcgccaccttttaccttttctactttattttatcgtccggcgggacttggcacctgacgcggggctgcatcggtgttcgatctccggctaaggggtaagtccaatgttctgccagcccaggcaattgtatcgtctacgtcggcgccgttcaaggctgcatcagtacattcgacctcttggattactccggtttggatgatatatttgcctacctatttatcatatgtctctgttaatctagtcttagcatatcaatctagctctatcggctgtttcttgttttagggtttctgctggtatcggctaaatcgtgttgctagattaaattagcttagacatctaccaccctgaaaactcagtcaacggcttgattgtctagatattatgtttcttttcatacttagtgctgcataagttaagtttgatctactaagtcgttcttagaaccataatctctagcttacttcttgattgccaataagggtttcatcggggttttagccggtgagttatctggacgttgcatcggctcataaggattgcatatacatataagttggatttagccgatgacaacaaaggcttcactatttaatctaatcttgtggatttcatgacatcggacctccagccgatgtatgctctaaccttcagatcggtgcttattctatcatatcaatgctagccgattggtttatactggactatattattgttatattttattatcagtagccgattgcctatatatcattatttactaaagtgttagaatctacattggacgtataaccgattgcttcaaccctatcgctatcggctggtatcggcatcggctattatcggctatcggctggaactactccatcgccttgttagccgatcgactgttttgatctactatttgcatatcttgtcagttgcaggatcaaactgactggcacgcccgcatctcatcaacctttggacctgcacaggagctaagcagatatcccgagccagtgtgttcgattttttcgtcaacaaccacttaaacggttggatgggaaaatgcatttttaagtctcatccttatctcctcacctctcatttttccacaaccttgtttcctatctctctcccccactcatttttctctctcaactctcctgtcacaccccaatctggcaccgccgtacaacgtcacctgataggagcgtgtcgtaggaaaaacggcgcggaccgcttcctatgaaaccgcgatctcagtaccagtcccaggacatagtgctggtacccacggtgacaaatatgaatcattgcaatccttaaaataaatagaggacttatttaccttaacttaggttgcagctcagaacagcccgagattgcaaccgacgacgcgaacgaggaaacaccaacaacagcggcagcagcggaaccaacggactaacacccaacaccacaggcgacggctgggaaccaggacgaaaccctaatcttcactttacttcatcttcaacttccgggcggaggaactatatatatatttatatagagcaagggtgagtacttttgtactcagcaagccatgggaatttaggtgtttaatgcaagcttggaggagaggcaaggttatttttgcaaatcttttgttttgaaatcattttgaaatcactaagtgatttatttctttctaagtttgggccgaaaagagacttgcgtctcgattcgactttaagagatgtttttcaacagctcatttggtaatgtaccgacctcctgggtcagatcattacttctcggctcccaaagccattccacttgattaatcggctcccagagcctttttcattttctcggactcccagagtccagctacccagcagcacaacaatccgcttccactcgggaagcctagtctatgatgcccgtagacatcccgaatcacacagattcgtttcttgaccactcaggtcatccatctgccacataggctgattctgggaatgattcccacaccacaacaacttttcacaaagcacaggcaaacaaatctacgctacaggaaacacctcacatccgcccatgaccgtgggcatggctgttcgaacagtcagttacccacacgacattactaacccggatcacccagcccatgagatcagccacgtcgggagaccttaaggctttcatgacaaggcatttcgaaagccgacacaggttcaccatatgccaacgagaggggtcccagaccaacaccagattaggtcccagaccatactgtgccaggaagcccgagggttctccccgacaccaccccgttgaatccacatgtctcttggcatcaaggcttccttggtttgctatttactcagccaggggcgtcccattgcacccgtgtggtcgcacttgttatatgctcggatgaatttcccacaggaatcggtacttatatgcgaatacgggacagtgccacacaggcacaacccccgcattgcgagttttcacaatttattttgttttcaaacacaccgacgccacatgtcgggttttcaaggcttctcaaacccatttcccaaattttcgacagacaacggtgtatgtggaatagttggtatacgcgctcagagaacacggatactgaagtaccacaagggtggagcgacaaggaaatcagggtagtacaatctacaggaattagtgcgactactgggtaggtccatcggtttggcacgcatactgaggccaagcaagttgagtgtgtgattctaataatgcaagttgcaaacaaaataataatgattttccaattataggagcaattggtcaaagggtgacttgccttgctcaaggtcttcatgaagcttcacgaatcttcgagaaaacccgcgatcgacgaaaatccggtaaccgcaactatacgcaagcaatcaaaaacctaaacaaaagaccaaaagaaagatcctatttagactaaataatagtgccattagatagatctcaattttatggaaatactggaagtggaacggagtcaatcggacgagcggtcgaggagatatgaattttggaagtttaatcggaatttctagaagatgagaaatggtctatggaatttatagaaataatattctcaagaatattattgaatttcactgacaagcaggaccaagggaaaatgattcatagaattttggaataaggaattgatttgtggaacaaaggaaaaaggatttattaaatccctttttggaagggaaatcaaggagggatgtatattagacttgggccgagtgaagagggcgcggcccagggcatttgcggcgcggccgaggcaagcgggccggcgcgcgggagggaggcggcccaaggccgagcgaggcgtggcctatgcgacgcaagccggtggacgcggtccaccgtgccgggcgcaaggtgggacccacaaggcagcgacacggctcacgcgggccgggtgcacgcaaggcggcgcgatggattggaggaccgggaaacctttgaccggtctccgcggggccgggcggctgaggtggcatccacgtggacgccacgtcggatggggaagggagaggaggccgggaatggcatcggacggccggcggcgagcgacgcaatccggcgaacggcggtgggagggagagagaggtggacaccggcggatagaggaggtcaaggggaaacaattcaacagagcggattagctggggaaggaacgacgacggctggcggcggcgaccaatctcgccggcacgccgacgtggccgcgcgcgaaaagagcgaagggcgcgcgggctcgggcttagccgaaccggtatggtgttgcgacgcgcacgcggtgacgcgggacccgatggtcgccgtgttcgaactcgcggcggcgctatgcggcggcggaaggggcggcatggcgcgggagcggtttgggaggccggcgactagggcggcagcctgggaaggttcaaggggacacggggagggtcgcggcgcaaggaatcggcgagagaagggccgacggcggcggattgcggcggcggccatcgccggcggagaaaaggggaaaactcgccggggcaacgggagtccaattcaccggggaaggagcttctacatggctccgggaactcgtttcaagcaacgggtggcgacgagctagcctagggggtcatggcgacggcgaggtggacgcgacggcggggcgacgcggcgaaaaggggggagaggaggggagcggccaaggcgacgtcccggggaggctgctagggacgcggggagggtgatggcgacgggattcggcgcgggaccgaccggcggtagcgcgcgactgcgcacggcggccgcggaagcagagcatcggcgtgacgaacgcacaaactaccatgtcccagtgctgtttaggagtcgctagaggatgtagacgagaggacttggaccgggagctcaccgacgagcgggaatggcgtcggcggacggatggcgtcgcggcgaggtagacgcgatggcggggcggcgcggcaccgagggggcgcggccggggaagaagggagggagaggtggtgatgggccagaccggtggcggtccattgacgtctcggtcccggcggcggcggccggcgacgaggaggcgacggcactccgttcccaggagcacgggaccaaggggatagataagggccgcggggttgggcttttataggaagatggtgctcggctagcgctcataggcggtgcggcggtttcgtgggcggtgcggaagcggcgacagcgtggatgtgatgggcggcgaaggcggtggatcggacggcgaaaaatcgggtcacgagagcgggaggagcaatttggcgcggtcaaggtgggagcggcgtgctggcacggttgtggtggaggcatgggcgcggcagagcgacgtcggcgactctgcctcctagcacagggggacaaggggaagagagagggaaagggtggaggagggcggtggaaaggggagcttgcctttgccaatttgggaggaagagggaaggaaagggggggtctctgcctccgagatttggaagcacgcgcgcaggatggcgggaccgggtggcagcgcgggcacaggcggtgctagggcttgacgcatcggcgaccaggcggtcggccacgcgcgagcgcgcgcgggaacgagcgaaggcggtggaggtttggatggtggcggcgggatttcaaaggcggtggcggaaatcaaatcacggtgacggcgcatagcgcggcgagaggagagagagaaaggaaacagagagagagcgaggaaggagagagaaagaagagaggcgctgcctctctctcccgacgcgtgcagcgcgcgggcggggaggaggaggagcggccgagaggagagaaccgggttgagaggagatgggccgaaggagggaatcggcccacaaaaatccgagggacacaaaatagacttttgacagagagattgaatttggagagaattggggcttggaaatggaatttggatatctttggagtcgggcgaatatttggcaaggttttgagatttggaatttgaatttcgaatttgattacttggactcagggaaacagggaggagtcaacaacgggattcaaaaagggaatttgatatttttaggatggggacaattatttggcggggattcaaaggatgcgattcacctttgggatagttgaatcggaattgggatcttgaggtggaggattttgttggcgatgagagagaacaacgatggagatttgaattgagatccacggcacgacttagactctcacacaaagaacgaaattttcacatataggattttgccgaactagtttttaacgcctcacgaaaagcggagcgttacatctcccttcctctcccacttctcccctcctcacattctgaaggtgggcttgggttggcgatggcaggagtgcggtggcgagcacaggagctaagcaggatgctggagtgctggagcggcgcgacacgatgggctcgagtagatgcggcggatcctgcgggagtgcggcaacggcaaaggggagggttggcgacggtgtaggatcaaggaggccgactagaggggggtgaataggcggttttaaaacttaatggcacttaaacaaaactaacctaagttgctaggcaaggtaaggtgcaaggttaactaagcaactaagttaagttttgcaaacctaggtgacatgggctcaaatatgtctctatgaatgtaaatagcacaaatgtaaatgcaacaaataaatgagacaagaggcaaggaatttttcaccgaggttcggaaactcgccggtttcctaatccccgttgaggcgagcccaactccaccgctcaaccacgaagccaccgcacgccccctttgtcaaggggtgggcaaggcgggagccggcccacggagaggactacccaagcctcgatcactcggggtagttcttccttcactccgaaggtggtgaactccaaaccactcacaaacggcgccggacctcctccacaatctcctcggagaggtcaccgggcaacacctacacaagccgtctaggaggcggcaacctccaagagtaacaagtctaggatgcttgccgaggatgatcaagtgccacactagctataacaatgaagcaatgcacttggattggcttaactcactctttaacacctcactagataaactaagtgcacaagggtgtgagagctcttgcaagggttcaagataatgcaatggagtgccaaaaccttacccttgttgctggggagtgggtatatatatacccccaaccaccaaaactagccgttgaaaccgaaatccccaactctgtgctctgccggtcagaccgccattgtgaggccggtcagaccggactactttgtaactagccgttacagggcaatcattgagcccactcaacctggtcagtctgaccatagtgtagtggccagtcagaccgtccacggctcggtcagaccgctgccggctcggtctgaccggttgcggctctggcggctctgtatcgccaccaaaaaccagaccagtacaacagaccagtgggccagtcagaccggccttaccacgccagtcagaccggctaacaggcccggtcagaccggcctaaggcccacgatcagaccgcaggtcacttttcagctcaaccaaccgttagtaaaacagcgatatctcttgactcgggtctcggaatttggcattcttggactctatggaaagcttattcaaagggctatccaaaccatgaacaatccatccaagaaacacaacttttctctgggagaaagggctcacactccaaaggatactccaccagacataaccacatgaggctacccaaacctataggatttgcccacatctctctttgtttaggacttgagaaaactcaccacaggctagacaagcccaccaaatacacctacatgcatatgaactaatatggcacaagatcatccacaagctcgcttcatagacccctcttgatagtatggcgcctatctagcaaatccggtctacaccaaacaccaagaccgggaaaagactaagaaaacattcttagctccattatacctttgccttgcgcatccaacttggggtcaagcttgagtcgagatcaacacttgtgaccatttgattcaaccatgtttataccaaggtatttaccatcatttgtcaagactttcttcttatcacaagcttgatttcattcttgccaacatggcgatgtccttggcttggtgaccattaacccatcgtgtcatccattagccttatcatagtaggacctattccttttcacatttcaaaggagaacattagtctcaacaaatcggttgtcatccttcacttgatgaccaaccggttgcatatgaaagatatggatatgtttgttgagttttcattaacatcacaagtgtcatatactcgtatgcaagctcaagtgcaaagattcgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacacatagagaaggcatatgtagtaatgatgtagaccaacataaaacatataccttcatgatctccatgttctcaatgtaaatgagactaaataagataagactcaagtaaacattagtctcacacttatatatcaataacatggaaatcatatatatgaatctatcaaaaagtaggagataagaagtggtacatatcattttatctccatgcatttcatccttgtcatgattaaggtccatcacaaaagaatgcaagtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaagatgatttcaaatcaagatagaaatcttataataaacaaaatatagaataagctccccctcaagtgtacatacatatggatacaaaggaacacatatgcacataatcaatcaagatcaatgagggagctcacactatattttggatccacaagagagaccaagttagaatatgtgaagtttaatacatacctctcatcatttttattttcatatccaaatgagactagtcaaagaaaggctcataaaaacgttagtctcatatagttagatttgtcattaatcaccaaaaccaaattaaggcacttgaacttacagacggtattagcacggtggcgggctcgagcaggcttaggcaggcaaggcgggagtgcggtgacgacgagcacgacagcggtggtatggaggcgcggtggcaacggatatggcggtggagagggcagtggcggcggatttgaagatggggagggtgacagaagtggatttggaggtagggtgggcggcgacagtgacgacgatgagcagcgacgatgacgagaggtggccgagcgatggcgatgaagaacgggattgttggagttttatttttttttcatgatctttatttttgtgtgcgaacaacataagcacctgcacgcaaaatttctattttcacatgcgaatgcgccacccacatgaaaaattagcgattttcacatacactttcagggcatacgggtggtccaaccacacggaaaaatgggttttgaccacatgaaaaattctttttttttaagtagtggttagtgtcttaggggcacaaccaatcattaaattatgagtaatttgtatatgtagcctaatttagggcaacaacttagaagctgttctttattaatatttggatagattacagacaattgcttatagggatgaaataaatattacatagtgcaaagttacaaacgaaatagatacttaagacaagttatgcaagcaatgctagtgcagaaagcttttcgaagaaatcgtagtagttcgagaactatggtatgtatgataaatcaatatggtgaaaagaacgaaggttgtattcgggaggagaggttagggagaacaaacgaaatagatacttaaaaacgaaggttgtattcggtggcgggggaagaagcagggtccgggcgagagaagaagtggcggccaggcgggagaagcggcggccaggttggagaggcggcggcctcccctccgttagatccggtgggaggggaggcggcgatggtggagcgacggcggccggaccggaggaagaatttgtgatgaatttgtttgagaattgtgatgtatttgatctgtgatgtgaacatgttgatgtatttgtgattttttttagaacttatgatgtaattttttcagaatttacgatgtatttgatctgtgatttggagatgatttagtgatttcacgatttgggattatttggggatgtagtgaaatcaatatgcaaggagttaaaaacaatgaaaaaaaaaccctaccaaccaggacctggctctaccatctttagtctcagttggtagcaatctttaatcccagattcatacccccggtttgctactcgggactaaagggggttgcaaatcgggactacaaagggtttgtgcagcagtatgagattatcagaattgttggagtggaactaggaggggcaatagacttgaaaattatgtagggtggctaaattgagttcttgtgcctccaaactattttcttttaaaaaaaactgaaaataacatttggctttcttcgaaagtgcccgttcctaagttttctcatgtgaattgctgcgaggaataagttcactttggcttctttaactagtgattgaatctgattcgtttctgttggaggtatgtcatgagggccttcgcccgacctgccgaaaccgtctaaaccatcaaacatcggctaaatcccagatggacaccaaaggcgaaaccaaggggcgcagcccttgggcgaagccggatgacgaagactaaggggttcgccatcaggcctaagcgaagccaggcaataaaaaccgaagggtacgccaccaagcccatcaatcaaccgaagatccaccaagggcgaaggccgtaaggcgaagcataatgccatcgcccgaagtagaagatactttcgactaaaggcttgggaggccctacggaccatggaggcctttcgccaataatgggccggcccaggaagattgccttaggcccaggaatacaaaagacactgtgggctggtttggtttgaggcctaaattaggcttaccaatatttggcaatttcaatagtgtttagtgtctatttggtttgaagccaaattttggcatgcctaagaaaataggccatttcaatagtgaacttaggctattttggcttcaatccaaacacaactttgccttaccaaaattagtcatgccaaaacttgccaaaatttggcattgacatttttcattatagaatcagccctatcgcttaaggttcctgttgagtacgatcttttttcgaacttacaggggcgctgcgacagctaaataaagcgagcactcggcaacttcaatctcacctctacccgcattgaggtcaaaaccatctctcgatcggggctatactactgagtcgagtttgaggtagtccctttatgtttgtaccttaaaatggaaaaggggcgtggtgccttctagcgggagctgtaacaccacttggtccacaaaccaaaccaaccttgtatacccattttaatatccctatcataagggtaatcatgtaaattcccctataactaaaccctagagggtatgagcctatactaggactataaatagccccctaggccatgtaatggggtgatcctaaaatatttttaccaatcaatatattgttttactattccaacaattcatcgagtttaccatatccttcgacgtgaaacagttgtcattcgacaatagtatccttgaaccacaacaccaaatatcttgacccttcaactattaaaaccgtccaatttgacttcctttggttttagagggcggtttcgctgacgttgcgtctacatggcagcattgacttggtctataacgttgacgtgtcgcttagatggtattagagttaaaaacatatatgtgggatccatttatcattcacacactaagaaaaaattattatgagccaacatataggactcacatgtcatcctctcctcactccttgcactctctcccttctctctccttgcactctctcccttctctctatctcgctctctccccttcggccgcatcgccgcctggcgccgagcggcaccatgctgccacctgcatcgccgcctgctgtccgtcagtgcctctccttcacctcccaccgcatcgctgcctgccgccgagaggcgcccctcatgaagggagagagcgaggaggaagaaacggtgtgaaggtttatctttcttcactacttgcacgatgatgacgatgtggagctaaaattagaagcccatgaaggctcaactgttacagcccagcccataagaaacggttgcccaacacccaactcaaccccctatcttccattctctctcctcccgaaagaccgaaacctcccttcctcgctcgcttgacaccccccctctctctcccccccaaaccctagctcccgattcagatctcgcctgtccctcgccgccgccgccatggtcaccggcggcaaccccaacccgaactccacgccgacccctaaggcgcgcccgagccagccgcatcagcagggcgggtcccc

SEQ ID NO: 69403 - DNA, 694 bp, Oryza sativa
  unsure (1)..(694): unsure at all n locations
acgagttgacgcaacggacgacgacgttcgatcgcacaagcttttggttttgcttgaccggccccgcccggccgcacctattcgtacgctggtttggccgctgaaaacttccaaaagaaccaagctaaaggctaaagccgcttgcacgcacgtgtagacagtagaccacctttattagggtatgtacgatggttatcaacagtggtttaattctttgcattgctaattaggaatacctgttgtctgttgacatggaagaaagagaaagaggaagagccaaacatcgttgttatacataacaacggctcttaatcgagatttctaatgggtgaacgatcgttctaggcgattggtttttttttctttttctctcaaagtaagtttatacgcctaaagtttacacatctaaaatttatccacctaaagtttgtaaagcgaatgtttataagtcaaaagtttatatacccgattcaaattcaaatttgaattcaaatattttatattttcctcttttagtaagtttatacacctaaagtttacacatctaaagtttatccacctaaagtttgtagagcgaatgtttataagtcaaaagtttatatacccaattcaaattcaaattcggattcaaatattttatataaaaatgatgaactnctgtnccatcgagaaggtgcatgtccatggggccatg

SEQ ID NO: 69404 - DNA, 3871 bp, Oryza sativa
cgggtacagccagtgtcgcgtactgtggaaggccctcgccccggtggtgggctcgcgcaacgcgcgctcccgcatggtgtggtgggtggacgcccgccggtgtctcactctctcctcctcgcggaagctccgcgccgcgatgcgcagctacgtgggcaacgtcacgaccttcgcggtcgcgaaggccaccatggaggagatccaccgaaagcccctgccgaaggtggcgtccatggcgcgcgacgcgatccccgcgccggcgtacggcgagcacttccaggagctcgtggactgggtcgaggagcacaaggccgggaagcagcggtacatcgacacggcgagcgtcgggctgggcagcccggcggtgagcgtgacggcgttcgcgtcgttcgaggtggacaccgacttcggccacggccacgccgcgatggcgctgcccacgtcgtcctccagcgcgaggctgtgcacggggttcgtgcagatcgccgcgcggcctggcggcggcgacgggtcgtggatcgcgagcgcgctgctgtggccgaggctggcggcggcgctcgagtccgacgagcggctggggcgcatcttcaagccggtgacggcggagtatcttggtctccggccagcgagtggtagctcggcgaagcgggcaggcatgatcacctctaaaatctgaactccaatagactttgcctatgcgggattcaatatttcagaaataaaataaaaccctttcgtaattttaaacaatttttgactgaatttgaataaattttgctaaatacgaaataataaagatgtcctgccgaagctggtcgaggtggtgcgacaccgtgagcgggcgctgccgctgcggtgctggcctcaccgtcgtacagcgcgtcgctcgacggggcgtccaccgcatggggatggtgtggttggtggacggccgtcatagtattgaaagttgatactccgtctattatttcatattataagtcgttttgatttttttttctagttaaattaatttaagtatgattcagtttatagaaaatgatagtatcattttcaaaacacaaacaaatatattatcaaaatatataatcaatgctagatttaatgaaacttattttttttagatgtggctaaatttttctataactttaatcaaacttaaaaaaagctttaaaaatatttaaaatgacttataatataaaatggagggagtagctattattcaagagtgcaatgcactattgttacgagaggtcgagcttgttgtttttaataaaaaggttattataacatgggatcttgtttgggtgggatgatacacacgaggtattaatttcttatactgctggcgccgaactgttgacgcgaaaaatatacactggccttggagatctgcttagctccattgcaggtccaaaggttgatgagatgcgagcgtgccagtcagtttgaccctgcaactgataagatatacatatagcagatcaatgagccgatcggctgacaagccaatagattaatttcagccgatgccgataccagccgatagcgatagggttttgagctatcggctataattctgatgtagattttgacgcctgatgtaaataacaatataaaggcaatcgactgatgataaatgcaagaaagcaacaatataatccagtagaaaccaatcggctaacaataacatgatagaataagcactgatatgaaggttaaagcatatatcggttggtggtccaatgtcataaaatccacaagattagataaacagtgaaatctctgttatcatcggctaaatccaacttacatgtaatccttgcaagccgatgcaatgtccagaaacctcattggctgaaacctcgatgaaacccttattggcagtcaaaaagtaggctatggattatggttctaaacatgacttaatagatcaaacttaactgatgcagcactaagtatgaaaagaaatataatacctagacaatcaagctcttgactgacttttagggtggtagatgccttagctaatctaatctagtaaaataatttacccgataccggcaaaaaccataaagcgagaaacaaccgatagagctaaattgagatactaagactagattaattaagacatatgataaataaataggcaaatatatcatccatactagagcaattcaagaggtcgaatgtactgatgcagccttggacgacgccgacgtaaatgagacaattgcctgggccggcagaacgtaggacttaccccttcgccggagatcgaactaaaccgatgcagccccgcgtcaggttccaaattccgccgattgataagtaaaaacctcataaaagagggtgacgatgcgccgagaatagttgtattgatcgagagatattacaatgaccctgggtgtatatatttttactaatggggagatactagtccttgtacgacaagaaagaaatttttctaaagataaaaggaaaacataaagtccttataggacactaaacacactttactaaagataaaaggaaactaacaaactatttctaattaataaataacttgccatgccgcattctcctttaacttggtcacttctggatcagcttcctttaatagattaatttccttaaccgaatatagcaagaattatcacatcggttattggcggtgtgataattctctcaggggcttaccaaatttcactgttaacaagaaaccatctttagcaagaccccttccttccccctctttagcgatgagctcctcggagacatagtaaggcagtgcggtctttcctcccggcgacatgctatccggtagcacggcaaggcggtggggccttgctccattaagcctctcatgctacatgttgtggtggctgccaccgccatctttccctagcggttcaatatagcgttggccatggtggcgttggaggaggtgaggttgccgctgctcaattattgggcgtgctgagaagtggtcgggcctcggcgtttgggaggagagcacgcttctgcttcgactccacgtagagcgattcctgcaaattataggagcgaaacaatgttattttgtttttgaattgattctaatcctcacaggaatgttcactcgtatatatttttcttaaattcaaattaaatgcttataaatatttttaaaacactataatataaatatagggtatagtaacttctatccctcactaagggcctgtttagatctcccggcatgcatagaatatttggacacatgcatagagtattaaatataaacgaaaaaataactaattacacagattgtgtgtaaattgcgagacgaatcttttaatctaattgctccatgatttgacaatgtggtgctacagtaaatatttgctaataacagattaattaggcttaataaattcgtcttgcagtttacatgggaaatctgtaatttgttttgttattagtctatgtttaatattttaaatatgtgttcgtatatccgatatgacacgcccaaacttttcacccacgtaactaaaacaccccctaaaaatcaagtttcaaactcgatcaacgatgttgggtgagcttcgtgacatagagtcaaaggaatcttgtgtttctcgatcggcagcaagtaattaatcaagacgaatattttgtggtaagttattgagatacgaaattgctcgtgtgatatatatatatatatatatatatatatatatatatatatatatatatatatatatatatatatatatacatatatatatatatatatacacatacatatacatacatacatacatatacatatagtatatatatatatacatatatatgtatatgtatatatgtatatatgtat

SEQ ID NO: 69405 - DNA, 620 bp, Oryza sativa
tttaagcaatacttagatactacaactatcctataatataagttattttcaactatttaggagtacaagactaaacagttcttgcattgttttttcaattcccgtctaaactgatcatcaaccgagtaccgacatgttgtaatgcagccgtatgaacaaatcgcttcgactgatcagtcgtgcgtacggcctccgatagttatatatattgtgtactgaatggatatacctcgtctgcagcagcaggactacttgaattacctcattgcctgtactctcctgctgtaccccttaggtagatcgagcaaacagtggccagccggctgatataattgcatgcacgtatacgttaaatgatcagtaattgtgcaataaaatatgggagttaatttgctactcaactctgtcccaaattataagggctatattttttttacacggttttcaataacatactttgacaagtattttatttcattctatgattccaacaaatatgaaattagcatcacatgaaatacttcaaaataattagtatagatataattagtatgattattagtcaaaagctaccgagattgattttccttaaaaatgaggcgccctataatttggaatgg

SEQ ID NO: 69406 - DNA, 13082 bp, Oryza sativa
ctctatgagtcgtctagtcaccaccgcttttttttattattttatttaaaggccaaaaacaaaagggccctcctcttcctcctgtttattccctggaatatccaccaagccccaaatcccgaatgctccatgactgctccctctatgcctctacacgttcaaactctatacggtcttcaaacatagtaatctttagttttatagcaacaatattatcatcgtataaaagtaaattcaaataataatattttgtatattttagaaaacacatcctacccctataaatatatctaaagactcatcgatatatcttaaggtagataaagtcatcatcaaatatctgattgtcgacgaatatatcgttaccattaaaagaataataattagttatctctatctctatctctactacttataaaaaataaaaaataaaagatgtttccaccgtccgtataaaataaaaagggcgacaaaaatttttgtcttaaaataaaaggaaaaaaaaagaatgtccgactcccctaataaaagaaagcgctggactcttaaaaaaaggacttctcgtacgtggaaaaaagatgtccaactcccctaataaaataacgcccgactcccaaaaaaaaaagacttctcgtccgttaaaaaaaagtccgtccaaaaaaaaggtccaccctaaattctataaatatccatatattttctcctctaattaattagaaaatctgttccttccacatcctttgctacatgatttcccttttcaatttgtctttaatttgccggccgtttaactattatcaatgatggccgaccgacgatattttttcttttttatcctattatttttttcttttttatcctattgcagattcgctttgattttggaaaaaaaatgaaaataggagatcaagtggatcaaaagacctcaataaatttttagaggttgggtatatttaatagggatgatcggctatgccatcatacatatacaagactgtatttggaagctaggagaggcatgtcaggtgaagggtcctcaactccgaatagttattatactactgaaaaaaacctttacccgtgcgttctttacccgttgcaatgcacgggcaagtttccatcatctataaaaaaaaaggaaaaaaagatccaaaagtgagaaaaatgccatttataagataatcggttcggaaaaatcacctgactcaacacgagcagaaaaaacaccggtccgaaaaaaatgtctgactcaacgtaagataaaaatagttttatataaaaacaaataaaaaaagtctgattccacatgagaaaaagcggatcgaaaaaaccgttcgactccacgtgagaaaaaaaagttgtttataaaaaaccgctctaaaaagaattatcgacccaacgcgaaaaaaagcttgcgcttataaataaaatctgattcggcactgtgcaatgcaaaaaaaaatgtcagattcaaggaaaagaaaacatccgattccatgaaaaataatcatatcgtatatattgttttatgtgcgtcttgatagctaatatatgttttgtctagagttgaccatacgagatattgtaggatttgattaatcctattattagttgcaagaatgagattaaaatagtatttcagattatatgtgtaaaaccactattaacaaccaaatttggcaatatcagcatcggaaatgaagattagatcgaggcgaaatcgaagtcggagatcgattcgggaacagagtaagagtcggctggagtccaaatcgactacgatcagaatcagctgagtccgagtcagactgggtaagccgatacagccgattctgacaatacgatttggtgtgcgacatcgggttgagttgatatgcttcaagatgattgccacgcatggatagagtcctaaggcaattgtatctattaattaggatattttatgtagtttccttagagatatgtttgggcaaaagtctgtcgcaaagacttatggtatcttatagtttgttagagataagagtcgtgtccggtatggacatagtttgtaattctcgggtataaatagaccccgaaccccatgtaatcaaacaacacacacgttcaatacaatctcggcgcatcgccacccttttgctttaggtttatttcgacgggttcttactttcgggttgagctgcatcggtttcgatcttcaacaagaggtaaaacttgttatgacggcttgcgttctcgggattagtgcttccatctttatgatactctaatattatttatgtaattcgtcgagttatcatatatctcatataatctctggcaatattgctatctaacctacaatcgactaacatctatcaatagagggcagccgattaggttaaatatcaatgttgacttagattatatacaatatctaccactctatgaaacttccaatggcttgattatctagatattgttcttcttttcatacttatagctacatcagttgtttgatcttatgagtcgtgattagaatctcaatctctagcctgcttcttggttgccgatgtaggatcgagatgtcgactagaggggggtgaataggcgatttaaaactaaatgacacctaatcaaaactaacctaagttgctaggcttggtgagggtgaactctaactaagcaactaagttatgttttgcaaatctagggtgatagtggctcaattatatctctaggaaagtaaatcacactcctatgtcaatgtttagcaatcctagggtgatatgatctcaagtatgtctctagaaatgtaaattgcacaaatgtaaatgcgacaatcaaatgagacaaggagacaagagatttttcaccgaggttcggaaactcgccggtttcctactccccgttgaggcgagccaaactccaccgctcaaccatgaagccaccgcacgcccccttcgtcaagggatgggcaaggcgggagtcggcccatggagaggactacccaagcctcgatcaatagggtagttcttccttcactccgaaggtggtgaactccaaaccactcacaaaccgacgccgggcctcctctacaatcttctcggagaggtcaccgggcaactcctccacaagccgtctaggaggcggcaacctccaagagtaacaagcaatgacccggcgtggagatgatcaatcaagtgccacactagctctacaaatggaagcaacgtacttgactcttggctaattaaccccctaacacactagatggatgaacacaaagctcaagtgggtgtgagagaggtgcaaggggtgtatgcaattgaattgggtgccaagagagcccccttgctgctggagggggagtatttatactcccaccaaccaaaactagccgttggggatgaaatcccctaactttgtgctctgccggtctaaccgaaggtatgtggccggtcagaccgtggtactctgcaacgactagaaaactagccgttgtaacactgtcagagggtcccatcggactggccgatcagaccggcgttgagtgggcggtcagaccggccttggctcggtcagaccgccatcagctcggtctgaccgaatacggctatgtatcggccatcccgagcagcaccatcccggcctctagggggccggtctgaccgctcatgtgccaccggtcagaccggccttatgcgccggtcagatcgccgtcttgcgaacggtcagaccagccagggcatgccggtcaaaccgccactatgtggccggtctgactgcccctagtcaggccgaaaccagtgaaatcccaagtgattgtgtgtgtgatgaaaagcgagcacaagtctaaatgcataatgacctaatgtggcaattaaaatcatctctttgctaggtcattacccctcttaatagtacggcgaaactaaaaagtaaactagcaaatttgatcaccctacacctcgatcaattctaaattaaagcactagttttactgtcttctttctctttgctttgcgccgtcaattttaatccatcaatagtcatccatgcgcacacatgacgtggacctaacttaaaatattatctccatagcaacggttagtccacaattagcgtttgtcattaattactaaaattaacaacggggacctagatgcttcagccgattagggtattatcggagtttcagccgatcttacctgatttagctatatttgttttatgtgctttattgacatgttaaatctgccctttacgttgagatcttgttgcatttaagtatattatacttttgtttggtatattctacttgctttaatatcttagtatagagtggtatcggagtactagccgatacatgctagatctatctgatcggctatgctatgaacatatatagtcccattattaatatatatttcgatctaagtgatttatactgtctcggcatggcgaccgatctatcccaatcacttgatttaagtatatatcgatataaggagtatatattgttaatatctacagccgatcgagtagatttagttctttcttatttattcatgactgccgatcgatacatatatgacatcggctcaaagataaatgatatgtcatcggcccttagccgatcagctatcatttataagtttaaccgcggtttctttgtctttatttctttttgattgcaggatcaaatcaactggcacgctagcatacccgaaggctagtttttgacctgcactggagttaagcagatctcccaggcctcgtgtttttcgtcaacaaccacaaataatcgaattcttttgggtaaaagaggcataaataatgttgccgcatcacgcatcatcgaggttgggctattacatggaagatgttccaatttttcttatgatatgtcttagttaagaacgatcgatacaaacattatcattgacatggttatacatgtgaaatgtgtattggcatttatttttttcacccgttgcaacgcaggggcaattttgctagtaaatacaaacacacaagtccaagcgagcagaggaagctatacgaagcatttgcatgcggactcctgttaatagcagctaaggaccgaatggaggaggaatggaatgataacatccttttatcttgtgccgtgcgtgcatcctaagctcacagtgcctactactcctttgcatttgcaagcctttcaacctcacccagcagtctagctgcatgccacgcgacagtcattccatgctgctaataagcatttgtactccacttgagacagtgagagcatatacattggtcagtgtcaacaatgcatcggattcggatgaccatgaatctgaagcaggtcagctttttctcttacaaaaacaggcctgtttgccataagccccaggaccctcccaggggttcagataaaaccgtttaatttatcaataccataaataaatacacaacaatcattttcttcatcaatggtatagtttatatctgtaattgcagtactaatttgcattgcagaccctaacaatgatttatcagctcttgtttatgttacattacaacaagtcaaataaataataaatctagtgctaacagatcacacgacttctcggttttcaatttcaccagtgcgatgaaaagactatgatgatatatctcatcaatggtcaggccagaacctaagctcctcaaacacatcaattgtgatatcgcccccaaagaaaagaattgcccacaatcttgcatccttcactcttcatcacctagtgctacattcctttcaacttcagctgcacatcactcagcccagtcctcatcgctatcatcgtccacgttgttatcctgtcatatgctgttaggattagctgggaggacggcacaacctcataacaacaagaagaagaataagaacaatggccataatgtaccaatctactacactctagctatcagaaaaacaatcacctgggaggaacttgagagcacttcaattttgtcatcttctacctgtgacagaaaaatgagagggcaaaggcaatcagcaaagtaaacaatgggaagggacattcaaattaaaatccctgatcattgttgctaagtaaagtacctgtgtttttctccttttctgacttctgccagctacatccatgtaaatacaatagtcagcttcatatgaagaatactaacatgtactgatgtactcagttaaagaaaagctgatagatcgttgcatgttgtgctaagagccactaaaatgcatttgtttttcccccatgcatcacagcttttacccagcaatatcaagtcttgtaaaattcaaatagcatatttagtatagagccgccgcaatagattttaattccatcatttattccgattcgacaggcttgagatggtcctaaagcttcatgaaatggattaacattttaaatgccccttacatagacaaaagctgaaagcttctcaagtaagcctcccaaaacctttggattattttagaacaagtcttctccattgaggaaggccttcagaggcttaaaacaaatgtaatcgcaccaaggtctattagatgcttcttaacaacagacttgctactgcacttaccactcttcttccctgttggatgtttttcctctggacttgctcgctgcttcttagcagcaggtcctgtagaacaatgccaatcacagatccaatcaaaaggaattttctttgtgtaataaaggaaaacacaagaagcctagaattgcgtaaatatgaagaaccttttgctgctggagatcctttcgggcttcttgtacatctctgaaatagaaatccttttgtcagatgctgaactaatttatttgtaccaggcatgaaaacagataatgttcaaaacacatatacggaaaaagaggtatgttgtgaagttggttcaattaatgcatcaagcaaacattatatcaaagttaagggtataactgtccgctatcataaggagagaaactattataataacaggtatgcatttccaccttttttttcttctgcttttttaaacatgctagacagagtggcctgaacgagtggctccttcttagctgagataggctgcgcagaccaatctgcaggtttaatgtcttcactttgggattcattcttaactgctggactcttcatctgcttcaaacgaagaaagcaaataaacacaataaaattatttacaaaagataaaagcttgattgacattgattcatatatctgaatcttataaaattaaattcggtatcactaccttctcatccatgtcctcagggacatcaatctcatcgtcattatcagatgaatcgtctccagatgatatctcagtatacctgcataaagagcgagggatctatcaagtatacctttttattctttgccttttttcgggtgggtgggagatgaacatatttgtttttagaaacattagccgttaagccaaataaatgcaggaagtaggcaatctttcagctgctaagcaacaactagagcccgtgtgcttttctgtttatccgagagagcaacagaaaagggtgaaactgacttacttcaaggctttcccagcagttctagcagactgcctaactgaaggtgcttgactagtgctttgtgtgttatcctcgtccttaaggtctgaatcctcggaagaatcaatgtcagattcaatcttaggggaaagggatcctgtggtggtttcctttggcggtttattgatggaaacagcttcatcacaggaagcacctgctccacctttaaaatcagaatctgcaaccgcctcatcctaccagtctgaaatgaagaagcacatgagatgagaggcacagtagcgtcgtagaagaagcgaaaattaagaaaaaggaagtaacatatatggatggaaagcacacgcacattctggaactcttttggaaaatccagtttcagttcttgtgggttttcttcttcttttgttccaatccaccaggcttcagaaaaaacaatctgccaaataaaacagcagcataagtaagtagttagcaataacagcccagagaaaagggacgagcatagcagcaattgtgcggatgcaagttccagttccaagatagatagagggcagggcaggcagagtaaagatgtgaagtttgaagtaaccaggctctcgaagacgtcatctgcagtgtcagatacttgttcttggggtacacatgcgtccccaacagcttcatcctcccctgaaacattcattacccacaataaaacatgcatatcatatcatctcacctacctgacctgacggaatagatagatagatataggatacctgtgggaagtcgaggtagagcagaggatttttggtgccaagatcagcgagctcgccgacgcggccgcccgaggcagcagccgcgggcgcgaggaggccggggaaggagaagaggaagcggctcttgcgctgcccgccgcggcgcacgatgtcgcggccctgcagccgcgacacggcagtggagggcgcgagagccgagcgcggcgccgccggctccccgcgctggagtaagccattagagaaggcgagggagcggaggcggcgccgctcgtcggcctccgcatcgccggccggcttcttcttcaccatccctccctgctcctcctttgcccctcgccttgcctgcgctactttacgcctcccttctggtaaagcgggtttatccacctctgtcactcttctccatttaaaatgttcattggttttattctacattaaatgaattatttacttcttcgtagaatagttgttaatgccaaaatttggtacacccgaagtcatcatcggtttagagtcaatatcggcttcagaatcttggaatcggccgatgggagtcgtcaaatcgtcagcagttgtgttcttggtggagtcggatcaattaaagaaaatttatccagaagagtccgagttcaaggaggatgcggtatggcaagttatttattaattatgaatagtttgttagtttccttttttatctttaggaaagtttctttcttgtcctacaaggactagtatttacccatgggtataaatatgtacacccggggttattataatctatcaatctctcgatcaatacaactattctcggcgcattgccaccctctttaccgaggtttttacttgtcatccggcggaacttggcacctgatgtggggctgcatcggctttcgatctctggtgaaggggtaagtcctacgtttcgccgaccctagtgaatctgttgtctacattggtgttgttcaaggctgcatcgctttgatctcttggatcgctctggtttggttgatatatttacctacctgatatctcaattctatctctaattgcattgtgtttacagacgtatcggtttaattgggactgtctcgattaggtctgatcttctgtcttagccgaaatatctctacaatcacaatgttgttataaatagatttgttatatccatcacattagacagatctatcggctcatcgagtattagattatcatatacaatctcgtgttgcatcggttaggttcgacctactagattattgttgataatataagtcttgttaagccgataggttcatgctagtgtcttatcggggtgctagccgataagttatctggacgttgcatcggcttataagaattgcatatatctataagttggatttagccgatgacaacaaaaggtttcactgatttatctaatcttgtggattttatgacatgggacctcctgccgatgaatgctttaaccgtcggatcagtatttatcctgtcatattattattagccgattggtttctactggattatattgttatatattttatcacatcatcatcagccgattgcctttatatcattatttacatcgagtgtcagactctacattggacatatagccgataactcaaaaccctatcgctatcggctggcatcagctatcggctggaactactacattggcttgtcagccgatcggctatttgatctactgtttatatatcttgtcagtagcaggatcaaactgactggcacgcccgcatctcatcaacctttggacctgcactagagctaagcagatctcccaggccagtgtatgtttttcacatcaacaatagtcttaggtggtgtttggatccagggacttaactttagtccatgtatttagacactaatttagagtattaaatatagactacttacaaaactaattacataaatgaaagctaattcacgagacaaattttttaagcctgactaatccataattagataatatttattgtagcatcacatagactaatcatggattaattaggctcaatagattcgtctcgtgaattagtctaagattatagatgggttttttattaatagtctacgtttaatatttataattagtgtccaaacatctgatatgataggggctaaaaagttttagtcctatataaacatggtctactattacacttttggaatgagggagtactatagtacagatgtgatatagtatcttatcttagaattatgagacaaactacaaatctagacaaacagattatgaatctgtagtctgtacagttatctattcggtccaaattcatagttataaaaatgtcacatctgtactatgtgcacttgtatttggacggaagacgtaatacggagtaatatagatttgcttttactagtaataaatactatgttcgctaacagtttgaacgttttaaatgaagtttaaaaatttccactttaatagtaatgattctactggctttcgattcagaaaatcattaagaattcacttacaattggctcaggacactatgcaatcagtattcagaaaacatagagactgtaatttagatagcccgcttttcatgaaaattaagctctatgtacttttttcatgaaattaattggctttggatagctgctgctgctagtagttattattcgtcattcttgttatttgtaagaattttctttggttgcagtgaaaattggtggtacaaactgaagtcattggaaaagagacgttagggtgggagggaagcatgtcaataattctgactcccctgatcctgataagatgcagatgatcatgatagaagtaaaaaccaacatcaggaatcctaattagcacgcacgcgctagcgagagaagttgcgcgcgttttccgaccacgtcacgacaactagggttagagttagggtttcagggtgggtcagggaaaggtggcgttggagagggggaagtgggggatcaggtttagagggcggtggagaaaagagctaacctgttaccggagggaggaggagaggactcgtcatagaaaggaggagcgggctcgccggagccagcgccggaggggagccgcccatcgttgccgctctgctccctcagcgacgggaagagataagggagagagagagagaaacccaaggaaagacaagagagagcactagaggtgacttgagataaaaacattacatataggtcatgtttggagaactagccaagagttattttgagagctattttttagcacaaggaaatagctctccaataaaatagctctaagttatttagatacaagggttattttgagagctatttggcttttaattttaatgtaccttcccaaggagagagagaaaatatactttttcagtgggccccactcgaaatagccccaattagcatcccttaggtgggatagttttttgggtgggttcttttcaaatagccctcaaatagctcacctttttgaatctttttgactatttgagctatttaagggagggctaaaaaatatccctgatcgaaacagggccatatagagtagcttttttatactccctccgtcccaaaataagtgtagttttagcaatgttcatgtctaacgtttgaccgttcgtcttatttgaaaaaaaaattatgattagtatttttattgttattacatgataaaacatgagtagtactttatgtgactatttttttaactttttcataagtttttcaaataagatgaacaattaaaacgctaaacacggatatttatggctccacttattttgggacggaggtagtattgcgtaggcagatgattactgtacgtagttagcaaaagagtggcattgtagtacgtgttgctcaaaaagtgacagtcgattagtaagttaaaacaaacaaaaatatactcattcccctccactcctgtaggagtacacacaggaccgatcaattggagtagcagtagtagaagaagagccaatgaactagtactagtagtagatgttgggaaaggcaggcagcctccctcaattaatctgaagactgacggcggcagccggagatggtggtggtggtgctgctgctgctgctcaacaaggaaaaggaggaggaggagacatggtcgttggtgtcgtcgtcttcttcctcggcgatggggtggaggcagaggtcggccgcgcggcggagtagctgtcgctgcctacggacgacgtcaagcgtctccggcggcggcacctcttgggcgaacaaggcggtgcctctcgcggtggcggccatgtaatcgatcgatcgatcaggactgactgtagcttaattaatttgtcaatctaattaatcttgaatgaattgaatgtggttgggggtgagtagaagacgacgaggacggacagcaacaacgaggcaacggggccaggaaggatccaggaaagcactactagtactgtagtagtgtacgtgtgggcagggctctgccgcgtaggagtaatactcctaggtaggagtagttgcctcgtccttgtcattttgttttgtgtccacgcaacgcacgcacgcaaatcgcaatcgcaatcgcaggtgcagctgcagctgccgcgcaacacaaacaaaacgtgttccttttcttttgcaaaaccaacaaacgtgtattgcgtgcgtacgcccctgcctgctaccacaccacaactttattttctccttcctgtaccagtaggactacatccatctggggatcctctagagtcgacctgcaggc

SEQ ID NO: 69407 - DNA, 563 bp, Oryza sativa
catcaccatgcctttgcaaaccctttatttcgagctttcactacatgtcaggtcacacattgtggagtaaaacacaaaagttagtgggatggcattgagttagcagtatccctacttgtggtcttcgttgatgaatagacagtgctggatatgcataagctcatcaattagagatgaaaagaatggatcgcatcaaatgcagtatcggagacttagaatgttgcagcagaatacctgtttaaaaaatccatggattaaggcaacagtccacgttgtattcttgagatggttccggatagctcgagacagaaactcgttccaaacaaacattgtctcataaacaacttgcccagtattcttgtcagttatgttcttctgaaggctgcgcatgatattgtaagagtagctgaagaagaagtctttcgagagatcgaccgagcaaaggagccgtttatatctacaaaaagtgaaaggtaaaaatataaatatccgcagacaatagaaatgagaaaaactctagatatagtatatttagaatcatactaagaagaatattagtggat

SEQ ID NO: 69408 - DNA, 4405 bp, Oryza sativa
ccagtaggactacattcatcttccactttaattccactcactatatcacaaattattttcaaatcatactatgtatgtccatttttatttaccactttttaacactttatatatactattaagaatatctccaacgacttcttcatccaacttgaaagggtctattcttaaaagtaaaaaaaattcaaaaaaattaaaaaaatatatcctccttaataggccaaatttggccaccccattttggttagccaaggatggaccgagcctcacagccaatacactcccccccatctaatacactccccccatctcccccatcggtctctctcccaaccccatctcagcaccggtgcactgctactggagggcgacgagacatggcgaggtggaacacggccaacaacaataacaacgacgcagaggaagcctgcagcaagccccgggttggcgcgagggcgaaggttgaaaaacatcgttcgtagggcctcaaactccctcctccctccctctacttcgagcaccgccgacgtccatacaggcgtgcggcctccagatcccatcatcatccaccacaggatagtggacgcatatgaggctacgacgacgaggacggagtgcttgcgccaggattccttccatccgccacaaggggggagagagaggggggtgaagaagaaggttggggaggttagagaggctgttcgagtgaaagaaaaacttgactatctaaatttttctcaaattgactaaatggatatttggagagaatattggagatgttctagggtagtgattcccagtttacccttagagcaactccgatccacgagagttgccatatgcatctccaagccaaaacttggttatattgggcaaaagtgctactccaagagattggtcaactggatggctctactagccaaatttggccacccatagccgctgccccaagtgtgggtcccacaccctttggctctctctcccatcgccctctgctcgctttgcttgcttggtctcccacctaccacatcaatccattgaaaacagtggcaacaacaatggtggcagtgccagcagcctcccatcaccgagatcctcctctatgcgatgcggtggtgatggcctccccatccacccagcacggaggcaccgaagaggcagcggcggcggcacctcccggcaacgacagatcggtcgacgtcccgctggactgtctctgccccatagccgtcgcaattgtgcgggagctcaagatcgtgtgttggaggtcatctcccatcatcccccctcccctcgcacctcaccttcctatacggtcgggtgtggtggcagcaggacaatcggctaacagtgacaagggtagggagaggatgacgatggaggggtagtgggcagccaatggtggggagatgaaagatatggagggatgaagaagtatatagagattgacatgtgaaccactggttgtttagcacgtgtaaattcctccctttttggcctagcggatggctgattgtaagagtacttatactgccaacattcaaaccccctaaatctttttaatctctaataggacttaaatgataaaactatatactcagctccgaaagatatctaaaacttttagaaaaacggttgtgctaaaagactggcgacaattttttgtttagaaaactttcgattttctaaccattagatgcacttcaggattcgcgcaacatatacggccatacgggcagaataaaaaaaatctcgtgtgggctagacaagcatcgaaccagctaggatctattcatcaaactcagcacacgttaccgctgctaggggtacttttttattattaatagtactttttagttacatactcacttacatcctatgtgcatactccctccgtctcataatataagttattttgactttttcttacactgtttgaccattcgtcttattaaaaaaatttggaattattatttattttatttgtgatttactttattatccaaagtactccattttaagcacaacttttcgttttttatatttgcacaaatttttttaataagagtggttaaatagtgcaagcaaaaaagtcaaaaatcccttatattataggacggagggagtagcacttacactctaattacagagtagttacataacacttacaccctacttacagagtagttacatagcacatacacatgtacactagttacatgatagttacagggtaattacatggtataaaattaggatttgtaatttttttcgggggcatatgcatattacttttgaattgaaagttatttttttcattctacatgtttggcaatttcttgacgttcaatcagtttgggcactaagactcgtggtttgtactagtgcggactgttttcctgttatcgttgataacaattcactaagaactcatggtttgtactagtgcaggctgttttcctgtaatcgatgatgacaattcctgtggttgaaaaatttgaaagttctggactaaaaaactgtcaacagcacactagctagtcccttagaaaaataggccacgttataaacttcaaaatgaaatggccacattaaaaaagaaaacttccaaacaaaattggtcttcttttcccataccctgtcggtcttgtttcccagtacgtagcttgcgcgaactcgctcagtgatgaagattaggagcgagattttaagagatggggatgggattatttttccttaaaaactggaaaacttgaattaggagtagtatatataggcaatcttttttgctacaatttcctttcttttatttgtttagttacgcgcaaattaaggttgtcgtgtttgaaaattaaaaaaaaatcaattggtagataaaaattcttctaccatgaatctttgttgcaaaatagaataactttaagctataaatacattcattcatattgatagcatatgtagcaggtacgttgatagccgaaaataaataaatgtgaagtttagagggcaggcatattagatatatgccctaacaaaatatataaatcctaaaaataaataagaagacgcacagctgctaatataaagaaaattaaggtggagtgggggcgaggatggggttggcgggcatgtcgtcgccggcgaggaagtgggcgaagagctgtctggcctgcacaggcgtgatcatgggaaccatgtggccggcgccgcggatggtgaccaaggtgaggccgtcgtagagcacggtgtagccgcccacctgatcgctcgtgaaccactgcttccacggcctcaccgtcttgagcttgagcttccgcagcgcgtacctcgtcgacgtcaccggcacgcggtcgtccgtgtcaccgctgaagacccagacgcggaggccggcgcggacgagggcggcgatgtccggcagcgtggagggcggcgcgtccgtccagttggtgagcgcgtcgctgcagggcgcccagctgtaggggatgccgcccgacacgttggcgtggagcgccgcctggacgtcgccgcggttcaggtagtcgatcacgcggtagtccacgcacgggttgtacgtgttgtaaggcaagccgcggcggaggcggagcaccttatcggcgaagcggctgcgggtgccattagtaatggtggttgtgccgttgagcgcggcggtgcaggacggagtgtagaggctgtagatgtcgatgtcgcccatggcggtgaagaagccgttccatgcggtgttgcacttgtccgtctcgttgccgtcgtcggggaaggtgcagttgcccttgatggcggcgtagatttcgtcggagatgacggcgtggtcccaagcgtactccacgagaccgcggtcgtcggagctggagtcgatggcggcgttgccgatcatgatgcccttgaggttgatgatgcgatcatcatcatcatgttccttcttcttcttgttaaaatggaggatcttggtggcgagctgggggacgtagtggccggcgtagctctcgccggcgatgtataggtcgtgccccttgaattgcgggaacctctccagccaattcaccaagaaggcgtgcgcgtcatgggctacgtacatatagctagtattaacttaaatcaatcattattctactccctccgtttcaaaatgtttgacaccgttgactttttagcatatgtttaaccgttcgtcttattcaaaagaaaaagtaaaatatttaaaactatatgtgtacatgaaagtatacttaacaatgaagcaaatgatatgaaaagaataaataattacttaaattttttgaataaaacgaatagtcaaacacgtactaaaaagttaacagtgtcaaacattttgaaatggagggattactatatttctagcactacgcaggccacaagcagataccgg

SEQ ID NO: 69409 - DNA, 1244 bp, Oryza sativa
ctgccgccctgccatgcctactgatcactgatcgatcgatcgatcgatcttaatttggtttgctttctatcttgctagtgctagctatatagatcgatccatatgcaagctgagtactgcaatatatataagctgatgaagctgaggtgagctggtaactcgatctatcgcgcgcgggacatcggggttctgttgaacatttttaggaacagattaacaaataaccaattaagctgtacgttatccatctatctatctatctaaaactaaccagctgcaactcctcgccgatatatgcgtacgtgctcgccctacgtctcaaacgtacgtacgattcatcactagtttcatcgctcgcccaatcttggctggctgctccggcctcgtcctgcaactgatgatatatcaaatcaggatttgatttcatcatatttatgaggagaatgcaattaacatcagctcacgtgattaattgtctctcctaatttgctgcctcatcaatccatttacctagctgcctacaagcggtcgagatccacgattatttaatttacttctcattcattggatagggatatagactatcatttcatttactcctctcgtaatttgttgcccgatcaatcgattaacctagctgttcctgtctctatacaagcgaaatcgacggacgatttgttatttactcgattggatatggattccatcgtttcatttttttaggagtagtttgttgctccaatgcatttaaacatacagatacagatgcacactttaaaacctaaacaaaaaagagaagaactgactgtctccctccagctaacagtacgctcaactgccgtcaaacacgcccaaaattagtccctggttacctgtgttggccatgcctttttttttaaacacacattttttttagagaagggtattttttacccggcctctacatccaaccgaatatatacggcaattgaaatagggaattagccccacaaataacccaatctaaaattcgctccataggagatttgaactcaggaccttggggtactactcaggtcactgtaaccactaggctacatgcacactcacctgaaagaataattagccataaatatgagtacccgtgttaaggactaagaataattaaccgtaaatatgaatacccgtgtcaaggatttgggtgggttggttccaccacaaggaagttaactagttgagctacgtttacttcgcggcaatgcaat

SEQ ID NO: 69410 - DNA, 609 bp, Oryza sativa
catcatcataacaaaggtaaataggcatggctagataaaacagtgataacgcgggaatttaaataaagcgataatgcaataatttaaatcaaaataattttataaactgggattcaatatgttataggatgatgtgacttgccttgctcgctttcccaaacgtcggcttcaacttccacgaagagcggatcttccgaagctgcagcgtctacacgaccaacggaaaagaaaaggcttttactctaataaactccatataatcagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattcaaaaatggatttattgcgtcaaccgaggggaggggcgcgcggaccgggtccacgggggtggggcccacgcgtcagcctcacggtccacggtgaaccgggcgcacccgggcgcgcaccggccggcgccgtgtgtcccacgcgtcagccgcacctaagggcgcgggcggctggcagccaagccccacgcg

SEQ ID NO: 69411 - DNA, 2012 bp, Oryza sativa
cgatttagcagctgcctgaaggctggaggtaggagaaggaggcggccggcttgcttggctttagcttggaatgagagagagagatggcttgctttggcttggctggccctcccctccctccccaagatcacaacacaattgcaagcaaagccagccagcctctccctccctttacctttgacaccacgaccacttgaaaaccaaaaaaaaaaaaagaatcgtgttttgcgtttttcttttttttaaaaaaaaaacataagagtagtacgcggttgatggggttggagccacgtggttgctgtgctcccatacagtaagtacttcatacatacagcgtccgtctgcttgtcttccctttctttctttcttcaaacaccatcgctcggctggaatggatgtacagcaggcaggcaggcagacaggtggccagccatcctgaacgagtcaactcacctactttagcaccaacctgaactatccttttacaatggcaaacacattaacatgtgtgacattttatatctcccatacttaatcttaaccgattattatgatgtacagttataactccctattatttcagtataacttatctaattagaatgtaattattactgattattcttgtttatttgtttaaaaaatattcttttacctgtttttatctacaatttcctgcagcaatacacgtggttagtactcctacatattaatccttctatatattttggtagataaaaactactctgtagctccagttccattaaattccctcaaagctatcttaaaaccaacccctattttgatatctaatattgaatttaccgtgtttttatattttcatttttgtccctttttttaaaaaaatgaagcaaatgtttaccccttttatttaacagaagatagtggatccagaattgttgtgctaaataagtgtatagacttttaaaatttgttgattgacctttgtacacctggtgattttaccatagccaaatctatgcctaaccacacacactactcgtcctttatttgaccaagtttaattactcctacatacagagaacaacactacgacgtgtgatgtgagtgagtcctgcatgctctttctttcgttgacactttctcctgactaataccggtcaatcaaacttggcttactactataccttggagtacgtatcatatggatggctacctaccaagcatcaccagatcaatcccctctatctccccccccccccccccccaaaaaaaaattaaaaggaaaagatgaagacctagcaaaagcttcggcattaatattaatccttaatcatgacttgtgagcatctgcagctccttccttcttgcagctctagcaagcaggcctgaaatgatgtactactcatatgtactcgtatagcaagagtaagcatgtaggcataaaacaaatgctgctccttggagtgcctattttcttcaaaaagtattgacaagcactagtacttaccttgctgtttgacaaagaatcttcacgcttttgaagctatataagagctggtgctttacatcacatggcacacacatgacaccactgcttttgcactgtcttttctgcattttccttctctccttcctttttcatggagagcaaattatgtcgagtgcatccctccaaaatgtttggtgggtatcattgcatataaccataagatttggaacagtatttctgttggctatacatattttgggttgccctgcaactttctctgctacagccgaaaacgacatgtttctttttccttagttaggtgcagacgcggttactaccgcaccatcatatatatgatgatgatctccttagttgtgctacagatcattggcaacgttggatccctgactaatgatcgatcagcaagaaaataaaacgcagtgcaccagttgttatattcagagcttgtgaccgtccaaagagctgaccagaaagctagtccagagcacgtgcaatcattcaaccttgtatatattct

SEQ ID NO: 69412 - DNA, 22793 bp, Oryza sativa
atacatatatacatacatacatacatatatacatatatacatacatatatacatacatacatacatatatacatacatatatacatatatacatatatacatacatatatatatatacatatatatacatatatatacatatatatacatatatatatatatatcagagccaagtgctcgtaacctccccaagccatcttctccgaaagggggggaagatgggtcgggtagcgtgctgaagtcgcggtgatcccgaacggtgtggtggtgttctgaagtcgcggagttcccgaacctttgatcggttgcccgaagtcgcgttgccttgttgagccacagaaggagtttgtcggcgtaattcgttgactgggcacttatcaaaggcaaaggatgaacttaattgtgggaaatattccctgccgttgactggaacacatcatatccaaataggttgatcataattgtgggagatttccccgccgttgtctggtaactacctacctatcttcctatctttcgtataagatgtcttggttggttagatcacgaagagccactgatcgatctgtagcctcgtgcagtagcgagaagtctgttggcactatgtcggtaaagaatgcttcatctatatcttttgaggatattgagaaaagtatttccaactggaagattcctaaggttaatattaaggaaatatatcatgtaggtactttttcgttacttagtaactactatattaaaacaattgaaaaaactattccaattagttctttgcatgaaaccctgcatcttctttcagaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttacttggcatgatggaagccagcctcagtaatggtcttgtttattttaacacctttcctgatttttctgtatccctctcagacacagatatccataaagttctcactctcaacttacaaacatctggttatgaactagaactagggagtgaaaacatctccgttacctacagagtttactacaaagccatgacaactttagcaccttgtgccaaacattatacaccaaaaggcctaaccactctccttcaaaccaatcctaataacagatgtactacccccaaaaccctgaaatgggatgagatcaccctgcctgagaaatgggttttatctcaagctgttgaacctaagtctatggatcaatcagaagtcgaatccttgattgaaacaccagacggagatgttgagataacatttgcttcaaaacaaaaagcctttctccagtctagaccttctgtcagtctagattctaggcctaggacaaaacctcaaaatgttgtctatgctacctatgaagacaactccgacgaaccttcaatctcagacttcgatatcaatgttatcgagcttgatgttggctttgttattgccatagaagaagatgagtttgaaattgataaagatttgcttaaaaaagaactcaggcttcaaaagaaccggcccaagatgaaaagatactttgaaagggtcgatgaaccatttagactaaagataagagaactttggcacaaagaaatgagagaacaaaggaagaacatctttttctttgattggtatgaaagtagccaagtcagacacttcgaagaattcttcaaaggaaaaaacatgatgaaaaaagagcaaaaatccgaagcagaagatttaactgttatcaagaaggtttctacagaatgggagacaaccagtggaaacaaggtagactctgttcatcctccatttgaatccattcaattatctcataatagaggaaaagcttgtccactaaaaagtatttctaaaaatacatatggagaaacagcaaaggttgaacacataggacatttggtagaacaacaaaattatgcaaatatatctctacgttctcttggtcaacaaacagatcgaatagagacaatccttatggaaggctacaaaacaagaagacctgaggtaaagataaatattccctctaattctcagtcttctagttctcagtctgttagtcctatgtttgtcccaacaattgatcctaacatcaaacttggaaaacaaaaggcttttggacccgcaatttctgaagaactagtcagtgagctagccttaaaactaaataatttaaaagtaaataaaaatatcaatgagatttctgataatgaaaaatatgatatggtcaacaagatttttaaaccttctacacttacttccacaactaggaattattaccctcgaccaacttatgcagacctacagtttgaggaaatgcctcagattcaaaatatgacttactacaatggcaaagaaattgtagaatggaacttagatggctttactgaatatcaaatctttactttatgtcatcaaatgattatgtatgctaatgcctgcatagctaatggaaacaaagaaagagaagctgccaatatgattgtcattgggttttctggtcaattaaaaggatggtggaataattatttaaatgaaactcaaagacaggagattctttgcgcagttaaaagggatgatcaaggaaggccattgcccgatagagatggtaatgggaatccaaccggtaacatttctgatgccttagccactttaatctataacataatttatcactttgccggaaactatcatgatatctatgaaaaaaaatagagagcaattgataaatttaaaatgtaaaacaatgtcagattttagatggtataaagatactttcttgtcaaaactatataccctaccagaacctaatcaagacttttggaaagaaaaatatatttctggtttacctcctttatttgctgaaaaggttagaaattccctaagaaaagaagggggagggagtataaattatcactatctagatattggaaaaatcacacaaaagatacaatttgtaggggctgagctttgcaatgacctaaaaatcaaagattaactcaaaaaacaaaggattcttggtaaaagagaaatgggagatttttgctatcagtttggttttcaagatccttatgtctatagaaaaagaaaaacccattccaaacctatgacaaaaccaaatgataaaagcaagatgagctttcaagctaccaaaagaaaaccaaaaagaatttacaatatgaacataagaacacaagacactgaaagcaaagaaaccatttgttacaaatgtggcttgaaaggacacatagctaatagatgtttcaaatccaaagttaaaaaagagatccaagccttgttagattcagaatcagaagatgttaaagaaaaacttgaagcaatactaaataatatagacaatgactcaagttcagatgaagaaaaaaatgcagagattaattgttgccaagacagtggttgctcttgttatgagccagataattcagaagaagagtctgatgaaaatatactcgttttaaccagtttagaagaatttgttctcgatacttttgaaaccattcaagatccagaagaaaaaagaagagttcccaaaaaattcctttcaagagtcaagactgataaggataaactaaaaaaggatattcaaaagagcaaattcctccctattgatgaagtgttcaaaagattagatgaacagaaaaagaagaatgagaaatcagatttgatcagcctattctaagaccaaaaaattatgaaacaagatttagaagaaataagaaagcgtctatacatgttagaattaaaagaaggattccatatggaagaaaaggacgaaccaattcaagaagatgatcaggttgttggaaccattcaaaaatatacgaagcaaaaatggtacgcagaagttatgtatcgttttatagacggatcctattttcagcatatcactttaattgattctggtgctgatgtcaattgcattcgagaaggtattatccctcataaatatttctgtaaagccacccacagaattcgtggggcagatggaggacttttaacagtagaatatcaaatccctgaaatctatatttgcatatctgaactttgcattaaaacatcttttctactcgttaaaaatcttaagcaagatgttattttaggaacaccgtttttatcactcattcgtcccttccttgtcacaaacgaagatattcaatttgagataatgggcaaacaggtgagcctaagattttcgtctaacacagatgagattcttgaccagcttgttcagaccaaaagagaacaagttgtgaattcaatatatttacatgacaattctttcccaaaatctatggacttgccaggtaagacatcatgggaagatagatatttattaaaagctactaaaaattttgaatatatatgcagggaaatggcttcacagaagtctgaatggttcacgaatatgagttcatggagactgccccaactgccgagaggccatggagaacgatttaatcacaatttcagagtaacagagctacaacaagagttattaaacctcttgtggaaggcaaaaaacaaaaaataaaaagctcatgccttaaatggcctggcatattatttcaaaaatttcgtgccctcagatcaaaagataacagaaaaaagggctaaactacaagatatccctcatcatgaggagaggttactagattatcgcgagaagaaatcccgtgatggccaagataaacttcccatggaagttgaacaatctatggcaacaaataagaataccaaggtattctcagataagattttgatctcaacagatcctgcttcgagcatggttgctttccacataaatatcaataacctattgcaatcttttccacataataaaccatcatcatccacaaaaaagcatgataccattccccaaacaccatacatactgcataatcatcccaattcattccttccacaatatatactctggacccagccaaaagctccatgtagatcttgtgcctacaaagattcttgccaaaagaaacttaaaagccaaaatcccatgagtaccacatacgaaaatctccaacctagattaagcttcaagacggagcaaactttatcttgctttgggcaagacatcctcgatcttgtttggcaaaagtttaaggagagacaaatgaaaatattccttggactccaagattatttctttgatctcttagaaggaagagaaagaaacccagccatacgagtaatcatatatatgctccctctcttaaggctagatgatcaggcaatctctgacccatcctatagattcctggttctcaaagctgagataaatctccaaagattccggaacctacccacatacaaccatgaagaaatatctctccaaaccattatagatcatggtcttgtgaattccatctatgcaaccctcgatcagatccttcaatctgatttaggaagcgctgtgaaagatgtctgcaggagacttggacatggaagatacaggattatcttctcctccataccaccaaaattcacaccacctgttcatccaacaattcattatatatatatatatatatatatatatatatatatatatatatatatatatatatatatatatatatatatatatatatatatcatgaatggacaatttaattttcaagaagacagtcctagcaaactatcggatgaagaggaagaaatatatacaacaattgctaatcatgaaaattggagattattttctgaagctgcagaaattgaagaagctatcaccaccagattatgaatatcagctagttttccaaaacaagatcacaaggatttttatcagcaaatattacaaccaaagttatgaatacttcaagggagcagggcgcataattaaaccggattttggaaatgaatgctccaagaaaagttactacagaagcctggctcagtggtttcagaaaaaaacagagccgtcagagatcgacacggtgcaatcagcacccacgataatcaacgaagataatgaataaagatcttgtcatccccgacaaagatcactattcaagataaggaatctacactattcaagataagataagtccatagtcaaaaggcgatattatgacatctttattaaaggtctaaagcgtcatcaccaaagattctctccatgaagtctaaaggggtatcataaactctttgaggtcaagaagagatatcatgaagatactctaccgagcgctatataaggggctcaccatcacatttcacaggcatcgcatttcacacacaacacatctcactcaaccattcctctcacctctccaccagccatcacactccactccactccatctaagtgttagtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacctatcaaggtatatgaatgaacacctggactgttctatataaacctactatgttctcaatatctaattttatatcttgtacataatttgtatttatagcttgtctttatttcttgtactgcatttatgtttgcataataatataaaaaaaattaacaacctggattgccatccaattgtcacatactaatctcacatccaagattgcatatagagttcatgatatcgctttagacttcatggagagaatctttggtgatgacgcttttgaccttcaataaagatgtcataatatcgccttttgaccatggacttatcttatctggaatagtgtagattccttatcttgaatagtgatctttgtctggaatgacaagatctttattcattatcttggtgacaagatctgtcgtcatatctcgactaaatgtgtgttggattgaaatctaatattccttcatctgaatcattatcttgcttaattgagtaataaggaggtattggcgaagatggcttaatttggctgcattgtaccatatcttcgtctagacttctgcatgtagaactagattttggggattcttccaatcttttaaacatagtttcatatacttgaagttgcaattctccctttgtcaactcggatcttgcctttaataattctcttgttatatcttcttttaattgagccacatgagatttcttgtttttggctcaaaactttcttccttcaattactggtgtgattgcaaacttatcccaccatcttgcataatagtttcgctttaaggttgctgggaactccattctttgaatattgaggtcccattttagtatccaaggcatccctgtttcggcacaaaattgcataaggataaaaggatattccttgagatccttttttgattcttgtgtaataactttgatgatttcttgtggtaggatttcaggaatggcccctactttcagccaccaattactgaaaaaccacagtggtatctcctcacatccttctttgaagcgaataaaccatgaatgcttcatctgggaattttgtacaaggagtactctttcccaggccttctgataatcccaatagttatatcttttatttgcacaggatgtagaatatatagtcctggcaacatatggatttgatgatttatcccaatcatcgatacttataattttttgggtcaataattttgtgaatcccaattcatcactattccttgtatggaatatctgtgcacttcttgtctcgcataatatggtctcataataattttgatctttccctggatatttagggataaaatattggtgttgtgggaaatactttcccataatcttgataatattgagatcagagtctccaaattctaatggcagaattacttcctctatattgaggatataagatgaattattcccatacttttcttgaactgtaggggttctaggaataatatttcctagttcattatatttatgcttatttggtgaactttctgtagttctcccttgggctgataagtcccttttaggtgccatagccctgtaaaattcatgagataagaaatctggtagggagtttaattctcccttgatatgttctatttcaaagtcaaagcatgataatattgcttgccatctggcaaaattttgtttggagactaagttctccacatccttttggaggacatcttttgctgccttacaatctatacacggcaagaatctttgattcaataattctccttggaattttgatatgacctttactatggccaatgtttcttttttgatggttgaataatatttttttgagccttattccaggtcccagaggtgaacctgaccaactgctctctggaatcctttttttgtttaagaattcctccataaccatgatttgaggcatctgattcgataattttgaaggcatcttgatctaggatataaagacagggcaaggttttgaccttacctttgatcttcttaacagcttgagtatgtttagctgtccaagctggaggctttttctttaacctctcggttaaaatctttctgtcttttgcaagatctttctaaaaatcggagacatagtttaaacaccctagaaatctttgcaactgtgttttatcttttatctcatctggaaatttttctgcaaattctattactcttgctactggttggactcgatcatatttatatatgtatgtatatatatatatatatgtatgtatatgtatatatgtatatatatatatgtatatatatatatatatgtatatatatatatatgtatatatatatatatatgtatacatacatatatatatatatatatgtatatatatatatatgtatatatatatatatgtatatatacatatatatagtaaatttgtttggtgctccatggtgcccgggcaccattgttgaaattgagtatatacctaattcaaatgagtatgaaactttttcaattacttaggtattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtgtcctatatatatatatatatatatgtatatatatatatatatatatgtatatgtatgtatatatatatgtatatataccgtttgaggtttacccaatccgaagcttcgttgcatcgatcgctgtcatcatcgagatccggcgtgttgacgatgaaaacactaaatacgaaggaggtcgcaccaacttttcacacaaaaatttttaacattgtcacatcgaatatttggatatatgcatggagtattaaatgtggaaaaaaaccaattacacagattacgtgtaaattgcgagacaaatcttttaagtctaattgcaccatgatttaacaatgtggtgctacagtaaacatttgctaatgacggatcaattaggcttaataaattcgtctcgcagtttacagacagaatatgtaatttgttttgttattaaactgcgtttaatatttcaaatgtgtgtccgtatatctgatgtgatacgcaaggccaaattttttttttaaactaagctgggcctaataggaggtggatttttcatcccataaatattttatgcatttcatccaaaaaaatcatcaaatattcttataaatgataagatagatcgtaaggtgctatatcactttacaaattatatgcaagtttaaattcaacatgtaactttttttcaacttttttttcaacttgaatttgaatatttacatgattgaagagtgatgtattacatattaatctatcgttaaattttttaacaaaatatgatttttttaacgacattaaaaaaagaggcgatgtccctagaggaacggataaacttttatggtagaaactaattatttattatctctaatactttaaagagtaaaatgcatgggcggtccctaaatttgtgcgggtgtgtcaattaggtccctaaattctaaaaatgaaattttgggtccctcaacttgtctcgggtgtcatataggtccaaacaggttccaactcactccatgtggtgacgtggcataccatggtgacacatacgtgtcagtagaacccagttcagccacatatagaaaaaaattaagaacatattttttcttctctcttttttcatttattttttcaaaattaaaaacatacttttcttctctcttttttaatttttttccctacttgactgacatgttgatgccatatcatctcacggagcgggttagagcccgtttggatctatatgacacacatgacaggtttagggacccaaaaatgtattttgagagtttaagaatctagatgacacatctgtataagttgtataagtttaataaccgtttgtgcacttcactctactttaaaaatggagtcgtcctccttccatcatatacttttcttgtatttctcatcgacaattaactaagaagggtattccgaggtaatgctgcatcataatgcatacgatttggatgagtaaggaaataacataattaggctagttgaaagttttgttaaaatatataaccatcgggactatgaaaacactgtagagccacagtgtttgtctttatattttgaatatgggaccagagcatagcattgactcaacgatttctttgttgatttctttgtttagagcaagtacaatatagcaaagtctcattctagcgccaaatacatcatccaaatacacatgtggaggggagcaagaaaattggagagagggggtagcgggcgcttattctagcgccaggctgcagcataataaacaatgtaaatcataggtaacgatgcaaatcaggaaattgcttcccatctgctgtccgggcaaaagagaaaaatcgaacacgcttcatgcaagcctgtgctttcaagtgtgcatggggtgtgggacccatggaagggtcaatcaaaatgagagggatgtatcgagttaagacttcaaaattcaaatgtttttttctcctaaactacttatccaatctaaaatccggttacaccattgtatttgttggaactaaatcattataacaaagatatcacatgattatattccaattaaagaaaaatataagtttcaaactattaatacttcatgtttcatacgttatatccatatgtttcagcgcctgtttttaatgtgtttcacaaaattctcaaaaataattgccactatcctctatcaatgcttgcatgcatacattttagcggtctttaaaatgatttttcttctaaactacttatccaatctatgattcgatcacactgttgtattcattgtaattaaatctttacaacaagatatcacacgattatattttgatgaaagaaaaatatatgtttcaatctattaactctcgttgtttcataagtgatagcaacatgtttcaacgtgtatcgtcgctgtgtttcataaaatttttaaatgtttccgttgctgtctttttgtttcaccatatataaattaatgtttcacttgttgatcagctgcaacattttaaccgaccgatgttttttgagatatcagacgtccgattggtagtattctcctgcaaatcaacgcaatgtgctggccctatccaaagaacaaatatcattggacagagataagcaaataaaattgagaacatagataattacttcattgtctaggagagtgtgtataggcagcttagcaactagctaacgtctcttattggcatgtacggccaagtttagttttaaactttttcttcaaactctcaacttttctatcacatcaaaactttcctacacacataaacttctaattttttcgtcacatcattccaattttaaccaaactttcaattttaacgtgaactaaacacacccaaaaatacgaaccatctgttcagattctcttctcgatcattctctctttaatttatgctctttccaccgaatcagcctatacatgccacgtgtatcgtgcatccgttctagcgaacattcccaactagtactagtataaaaaaaaggaaaaaactactattccatcttgaaaaatatttaaccattagcgggagagcgctacgcgtcggacgtacggcgcgagacgaaaaatcggacgccttgcgcgaccgtccgatccatgcacacgtgcgtcagccatccatcatgcatggatcaaacgaattttaaacaattttttcccttaaaatatttatctaaatcatgatccgattgcactattaaatccgttgcaattaaatgtttaaaacaagaccacacatgaatataatccaatgaaaaaaaaatagcttattattgaattattttaaaatgttgcatgctgttgcgccaaatatatcggaatagtttcattgagtagatcgaaaatgttttatcggatgctgtttcaccttatatgaaaatagtgtttcagcgaatagcgaaagtatgtttcaattcactgcaacatttgatccatacatagtgaaacatcatgagtacattaggtgaaacattttttaaattaaaaaaaatcgaacggttaaatgttgcagttgaccaacaagtgaaacattatgttatatatatggtgaaacaaaaaaaatcagcaactagaacatttaaatattttataaaacatggtggagatacacgttgaaacatgtcgctgtcacacgtgaaacaacaagtattaacggattgaaacacatgtttttcttttatcaaaatataatcaagcgatatcttgttgtaaagatttaattacaacgaatacaatggcgtgatcgcatcatagattgaataggtaatttaagagaaaaatcattttgaagctttgcgaaaatacatgcatgtatgcatgcatgaggtggagagagagtagtagtgggtagtttcaggaattttgtgaaacacactttaggcacatattgaaacatatcactatcatgtatgaaacattttgttttaacagtttgaaacatatgtttttcttttgacataatataatcatgtgatatcttgttgtaaagatttaattgcagcgaatacaacggtctgattggttcgtaaagtaatttaggagaaaaaaaaatatttaaatagaggagaaaagaatgaaaagaaatagttagacatgtgcatgtatgttacagtacgacaagggtttgtccaatccaccaggctactgatttgcagtattttcctgacatcaatagagagaaaggagaaattagcaagtaaggactgagctgaccgtaggcgtccgacgtttttcatctgatcggacgttcgaagagaagcatttttgacattagtgtttactaatttaacacctataaaccggaggcaactccggcttggacgtccgatgtttgggggaaatcgggcgctgacgttagcgcccgatttacgtgcaaaaactactttaaactgattttaatcttaaattacttatccaaatcatgattctattgcaccattaaattcgttgcaattaaatcttcaaaacaagaccacacatggatatatttcgatgaaaaatttttttagcttattattgaattatttttaaatgttgcatgatgttccaccaagtatatcggaattgtttcactacatagatcgaaaatttttcactcgtttaaatcgggtgttgtttcaccttatataaaaataatgtttgagcaaatagcgaaagaatgtttcagttcactacaacatttgatccatacatagtgaaatattataagtatactaggtgataaatattttggtggaacaataatagggggtttccaaaatatgtgggttttttgttgcaatggactatttcagttcactgcaacattagatctatacatagtgaaacattgtgagtacactaggtgaaacatttttgatggaacaaaaaataaaccaaattcccttaataggggtttgcaacggcgcgttccataatatcaaaatccactgcaacatttgatccgtacatagtgaaacatcgcaggtacactagctgaaacatcgtaaaactactggttgaaatatcaaaagagatcatatgcaatattaaaaaaaatatcaatagaaaagctaaaatattttttatcaaaatataatcatgtgtggtcttgttgtaaagatttaattgcaacgaatacaacggtgtgatcggatcgtagattggataattagtttaagagaaaaattgttttaaaactagttaaaataggagcggcagaggcgcgggggcccgaggcgtccgatttttccaactgccgtcgggcgcccgcgcggagcattctccctgtaaacctacaaatgttatacacatatggtaagttattaaacaccacatctaaaatgatatatagttaatgccataaaaataaactagtactactagtagcaccctaaacccaaattgatatacgtctcttttcgaaacaatgagcttcacttctttaagagtctccggctatcaaaaactcctcaaacaatttagaattttcacctaaaatctaactaaaagccagaaccagctgttttttagaattttaagtttcacaaacaaacattttaaagccatcagtcgattacaattcagctagccaccatcactccacctgctgaaagcactgcccgagtagcagagcagtaacaactggagtagtaaacaagtaggaatacaaagcaagaagaattaatggccagcgtcgtcaatgccgccggcgacctgcacgtccgggttgtgagccggcgactcgttcaggcctccgacgaatccctcgtgccgcgcgtcctcgccgtctccaaccttgacctcctcccgcaatccatgcaggtctccatgctctgcgtctaccccaagcccagctcgatcgccggcggcttcgacttcgacgacgtcgcgtcgtcgccgccttcgtctccggcttgccggactttctcagccacttcttccccttcgccggccgcgtcgtcgccaacccgttctccggcctccccgagatccactgcaacaaccaaggcgcggagcttgtcgtcggcgaggtcggcgtggcgctcgctagcctggactacggcacgatgggcgcgtcgttgcggaagatccagctcccgcacggcaaggacgtgccgctgtcggtgcaggtggtgtctggcggatacaaagggtggtccgggtggttccgggaccacccaaaaaaaggcgatgaacccctattaatctttttctattataaaagttttaagatgtttttaccagaaactttcgtacgtcacctttgttgagtcggtttcgtattccgaatataaggcttctgtagaattttttttgtccagcgtcgcacacgctcgcgctgtccgattccatcacccggcatcgagcgcgcgttttccgcatcccgtgtaaaccacgcaaggcccacgactgcaagcaatcaaacccacaagccaaatatgaaacccccgtttcaaaagttcccaaattagaactctaaatttcaaattcagatgatgaaaaacaccaaatcaacacgaaaggaagttggatatggatttgatttggactcaaaatcgggtgaaattaaccccataaatacaaggatttcatgggactgctacaacaagaaatcgaacaagattgatcaattggtgagatctcacctaatttcacggaggcggctttcctcgctggcaccgtggacgaggacccgccgtcggagccccgccggccgaagcgcgcccgtgccacgggacttgccatccacaccgccagatttgcaccctaggtcaacacctccgctcaagccgacgccagatcagccgcatacagcccgcgaccgagctccacctccagtgccttgacccaccgccctgaggtttgccgccggtaccgccgtccatgacttgatctccgtcgccgcccgtgcccggagctaacaccggatccgccgcctgcgacccgagccgccaccgaatccgccgcccgcagcacgcgaccgatctccacctcttgtggcttaacagcaccaccccaagctttgccactggtactgccgccgctcgcgccccgagccgacgctagatctgccgcctgtaacctgagccattggcggggcaaagggcgcctagctgaggggtaggggagcggcgtcaccagtgtggggaggaggagggggagtaacgccgctggtagggggagagggagggtgtcgccagctgataggaatgcgcaacagagaaagagaggaggggagatttgcccccccaccagagcgaaaagtaggagcggtggaggcggcagcttgatgtgccccccaccgcaggtccacgccatcgccagatccacatggactggctcagctcgatgccactctgctcatcgccagcctcctcggctggctcagatcatcgtgtgctcgccgtctcccagccacctccgctgcctccgttatgcatgcagagaccggcgaagccggtcgcctcttccatctatcaggcaaaaccggatcgagtagtagcgcagtacagtggagcatgagaattggaagatagagatggacggggaggccaccgcaccgctcccaaagaccacatgcgaacttgcaggtggcattgactcctggcatttttttattttaaaccctaatagtatcttttatatatcctatacttcagtaaatacaaaatatttttaaaaatacccctaggttagtactcgcacattaatatccaggaccttggaagtttcaactttttgagactgatctgatgtacaaagagtaatcttttatggctttgcatattgagttgactatacagtccttaacctaatatatatatatatatatatatatatatatatatatacattatataaatttcgtgattttcatgtggtttgacaaattttgttaatctctactattataaaaattgaagatgtttccacggatactttggtgcgtcatccatatttgagtcggtttctaaattcgttcgcttttaaaaatacataaggagtcgtataaaaaaatcctttagaaaaaactggcatgctcccctgtgattagagtcggatacctaatttcttcagaattttaacaagccatagaaaaacaatatataggatatagccatcatcccaaccaggatacggattagatatcaataatatctcaaaataaaattcccatgtactttttagataaaaatatctaacaataatacgattaaaatagcattcacccgttgcaaagcacatgcatgttttctagtaataaaaaaaagaaaaaaagccatataatccctattccctagtcccgacgcgctattccctaatgacggctgcagagacggagagacccacacacgcgcgtatggaatcgatctgacgcgatcacgactctctctgtctctctcctcatcgccgccgtagcctatagcaactgccctagcctggctagcgacgagccgatgagagagtctgcggctcacgcttcagctcatggtgccagctggcctagcttggtgcggctgtatgagcccgacagaggagtaggacgacgcggccaggacagcactctcgtacgtcctccccaacaacagcgtgggctccttccgatgtatgacttctttggccaaggccacggtggcgcaggcgtacgtggtccttgctgtgcggatagaaacgacactccatgtcgagctcagggcatctttttgctgcttgatgcttcattgcctcctctccgacctctcgccaatggccaccaccgatgaatccatgcctggagaaagaatgacacgtttcactcacatgtgggacccacaatctaatggaatgccacgtaagcgtcccctaaaaccaggctgattaataaggatcttgtttacaccggttttaggagatgagtgatatgttgtactatcaggtttgtgatcgagggatgtgattaaaattcaagcttaagatgaggtatgtaaagtaaacttattccatttggactatatgctccggcaatttcggcccatacatgctgtcaaatctgtctcttagaaaatttggcctatttcgcacgcaaatgcggcccactggcccaatagtgattgcaattttgtcccatatccgcatgcaattttcggtcgacttaaaactagccaacgtgaagttttgcgctattggggagaactacaaatcggacgtccgatgttgtaaaaaaattgaacggtcaaatgttttagaagtggacggtcaaatgttttggatgttgtaagactagcatatgggctgaataacacggaagtgcaatgtccattcataatcaatagaggttttatactatctatatctatgtttttaaatagataacatcgttaaatttctgacatacatttaatcatttatcttatttaaagaaaatataagatagatagttaaatatgtgtttaaaattcaagaatatcatctattagtagaaaacagagggagtatatatggtcatttcatcactataggccctgtttggagaagtagtccagagttattttgagagccctccaatgaaatagcccttgagctgtttggatgcaagagctatttgacctttagtatacttttccaatcacaaataccccttttctctctttctccactggatcttttgcacatgtgtcttggtgtggccggctgcatggtcagtgctctacatggccggctgcatatgccatgccgttgtgctctatcactaggacagtgctctatctcataagcttgtagcataaagggagaaaacaataaagtttttttatttaaaaaaagagatcaaattgctccgtggaggcgtggagtgctcattccattgcataagcactgatacatgcattgcattcttcgtgcatacattattcaagcatgtgcatatattattcaaacaaaaaaaaatcgaagccagatgcttggatttggatctttcgagaagaaatcgaagccaccaccctccatggacaagaaaacaaatcgagcagtggagggccggtggcggctcaagtgggggccggcggcgaagcggttgacggccggcgaggagcggggccggcggcgctggtggggaggaggtgggggcggcggcgctggtggggcccgacgaggagtggaggcggcggcagcgaaaatgccccgcgcttgcgcgcgtagtcgtgcggagagagagagaggaggttgcgttttctgatcccgtgcgtctatgggagagagaaaagccaccttttttagtgggccccactcaaaatagctccaattagcaccccttgagtggaatagtttttttgggtgggctatttccaattagcccttaaatagctcacccttttgaatcttttggagctatttgggctatttaagggagggataaaaatagcccttggatacaaacagggcctatgttccattcatgcctgtgatatttatatcgtactgtttagatgccaaatttcataactactttcatcatccttgttaaattgtattctgtctggattttctttcttttttaaaaaaaatactgcatgtctatactttgtactgctaagtcctaatctttacaagtagtaagataagaataaataacaaatcataaggtttttagtcatcaagttttcagctttctccattttaaattatttatacatcgttctccgtttatcatcctaagtaaaaaaatttctatctctaactatcaatatgttaaaaaagaactgtagagtttaacggtggagtagttctctaggtgaatctgaagcccatagttcgctcgctaactgcgtagtctctgctactttaacgcctggtcctcttcccaccgagaaaccccgtaaaaaaaggaaccggcccatccttctgaaatgaaaaatgtaaaataatttatgagacttcctttttgtcagcattgcaatgtaactagttctgtgaaaagaatatatagggtccaatttagagtaaattgtactttgggccatgttttattgctaaaattttaatttggatcaccctaaaaccaatcttttttactttagattaggtaactttacctttgttgtataatgaatcaccctaactatattcactagtcatgtctaatgtctccttgataaaggtatggcatgcatataggttaactatattcatcggcatgtcgttaataatttgctcgaagtcattgaagtgatgaagatatggtttagggtggtccattgtataataaatataaaattatcagtctaaaatgaaaagatcggacaaaggtgatcccaaatgaaactttagcaattaaacatggcccaaagtgaaattaactcaaaagtttatagtaattacgacttctcacaaaactttcatccctttaaaatggttcagattgtcccgcagattcttgtcatctaaattctgaaaaatatgtaatcgtagaatgcataaaataaaataaactaaaagctagaggaactgaaaaaccagaattttaactcctcgcacagagtcataggccctgtttggggagcttctcccatctgcggtttttcccaaaagctgcttctgctagaagctaccccaaacagtccacagcttacagattctgaaaaatgaactaagaagtcagaagctgaaggaactaagaagtcagaagctggagaagctgggtttcagagcttttctagactctcagaagctaccaaacagctgctgctcaaaatctaaagctccccaaacaggcccgtagtactaccgtcataacattgcttccgagcagagaaagcaggatgcagatgccgttacctgcatatatagagccatagatataaaaccggagcatcgctttttggccacttccaacggacgtagccgtctcatgcctaccaaggatcgtgcttcgtgcatgcagatagttcacgattaatttatttgctttgttcatttgtgaaaaaagtacagttttgatttgtctgaagagtgcgtgccaaacttcaactttaattaagtactagagagtaggcaccagagacttgaaaagttcagcaacttttggtaaagtaggtaggtagattcaccattgcattgtgcattgaaattattataggaccaacacgttgacaatttaattttcctaagctcgatctcatcatgctgataagttattaaaaagtaaaccaaacaatttaaaaaataaattatggataaaaaaattatatattcgtgttggttgcagtttaaaagctaatgctagaaaacagctatgatgagaaagctaaaaaataattctaacaataaattttaaattttaaattttggttgcggttgaaatcggtcgatgagaggcataaatggcttgccttggtataatgctgtcaacgattgagacgtgcaagctactcgctagctagcaagcacacatgagatgatcaagcagctccagttggtggccgaacttttaggactatcctgaagtgggttatgagctactatagtttaacagtggagctacatatactatttcgagataacatgtatgattagctataaagttttcttccctctctttctctcacttatataaaacatatgtagaatggcttatagcctactattaaacttgctcttagggtgagtctttttcctattggttgtggtagctcgacgacatataaaatgagacaagtcattagtttattatgatcaattgagtattaattattacaaatttaaaaaataaatgtatttgacctttttctaaagaaacttctacataaaatatgttcaaaaaaacagacataccgttcaactattaaaaagagttgctaacgaaaaataaaagaataacagtgggacctaagatatggagtatagtggtgacggagcgtggggctcctcaccgggagaccgcgcaggcccccctttgccggttcggccgggggccctggtgaggttctaagctcctggtctgtgtgtggaaggttcgcgagagtggaaaaagcacaggacacgggcgatgtatacaggttcgggccgctgagaagcgtaataccctactcctgtgttttggtggatctgtgtatgaagaagctacaaagtgcgagccagcccccgatcgttccaggatcgttttttccttttctccctttccctaagtgggcaaggtcctccttttatacctcaaggggataccacatgcaccatttctctcttttttgtggggacttatcctattttttcctaaacagacggagacttggcttctcttcattaatggacggagatttgtatggctggccgtccgaatgaccttttgatgggacgggccatacctaccttcactttccgccgaaagcaggcgcgacgtgggaacatggctgtctgctgacgacatgaccattgttagaccggtcacaaatcgg

SEQ ID NO: 69413 - DNA, 11713 bp, Oryza sativa
ccccccccccccccccgagggggtcaggcctcgtgggcgattgctcctgcccaagcctctagtcatgatactcccggtcctatgtcaccgacagtagcccccggcgttatgccagggcgatcgccctcctcgagggaagcggtcgggcgtgacgtcacttcctaaggcctggtgacaggtgggaccggtctcaacagttgggcagaaacccaacggtcgcaaatcacgcacatcggcaatggttactcggctgtcaataatgagcagtctcttcaagactgccacattactcgagtaacacgcgaatcgggacgagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgcctcttgcaccctaactccttgtttcctgtgccctaccttcgccacacgcgctcgctctcaaacatctcttcttccggcgtcatggcacggggttccgctccgcttgacggtagcgtgctgccgccttcccgcatcgtgagcgagagacaggccgggctgccgcgccgcttcatgccggaatctgccaccggccgggagatagtctcgttgggcgagggatgcccggcgccacgctacccggggcggtccgtcttcttcctcccttttgctatggcagggctggttccgccattttcttctttcttcatggatgttctggagttttatgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggctgctacttccagccgcgggggccggtgctgaaccgctacattctctgcgtcctccgcaagaagtgggatgactggaagagcgactggttctacacccccctcgccgacgaagcgcgcctccaacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggattgcgccactccagcggcgcgcccggggcgcctggagtacactgggtccgaggactgtatgaggacccaccagggagtcagatgggactgggctcctgaggacttcaagatagtggtccaacgggtgctgaatctcagctccgtggaggcatccctcattcctcaaggagtcctccccctctgcagcgatccagaccgcgcctccatcctggccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcggccgccctgccgacgcccgggggaagaggaagcaggaaggaacccctcccccatctcctccccaagggggtggggcggcgcgtgccagcagcaggcgcccggagggggccacgccgacgtcgcagcccgagggggagcggaagaagaaacggccccgcaagatgggggggacagaaccatcccggggaaacctcatttcccctccaaggtggtcatttaaccgaccccctcgcaggttcgtcccacgcccatcgtggccgtattcattccctcaatgcgagttttcactcatccatcttgtttgtcttctggtctttcttctgtttcagcgagatcccgtcgcgtccctcccgccattccaagtccggccagtctgaggccgaggacccggcgaccacagaggcacggaggcgggaatctgtccggcgagaagccgcggatcgccttcgggaagccgaggaggccgctcgggaggccgcccgggctcgccagaccgaggaagccgctcgggaggaggccggactccgccaggccgaggtgatgacatcctccgaggcgacccgtgaaactgaccggcaagaggccgcggatcgccttcgagaagccgaggaagctgctcaggtggccgtccgagctcgccaagctgaagaagccgctcgggaggaggacagacttcgccaggccgaggcgacgacgacttccgaagcagctcgcgacgaggccgcgggcgcatcgcttgggcccactctctcgtgcgacgctcaagacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcaaagaggggcgtcgctcggtggaggccatggtggaggtgggccgcaaggcacaccgccggcacgtctcagagctcgaagcccgtcggaaggtgctgggggaggtcgccaaggaggtggaggaggagcggggggctgccctcatcgccaccactgtgatgaacgaggcgcaggacaccctccgccttcaatacgggagctgggaggcggagctagggaaaaagctcgacgccgcccggggggtccttgacgctgccgctgcccgagaacggcgggcggcagagaccgaggtggcatcccggcggcgcgaagaagccattgaggcccgtgccatggcgctggaagagcatgcctgcgccgtggagagggacctggcggatcgcgaggccgccgttgctattcgggaggtcacactggcggtgcacgaagccgcctgtgccgaagaagagtccgcactccgcctccgcgaggacgcgctcaccgagcgggagcgagctcttgatgaggccgaggccgcggcgcaacggctggcggacagcctgtccctccgcgaggctgcgcaagaggaacaagcgcgccgtaatctggaaggtgcccgcgccgagagggccgcgctgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatttgcagggcgcgctagactcgtccgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggctccccgaggagctcgagaggacgattaagtcatcctcgagggacctcgcccgaggagcggtggagctcgtactggagagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcattcgccctcaactccgacgaggaggacgatgacagcggagtgggcgatagtggcgacgaggctggcgacccgggtgcatcggagtgagcccccaggcccccgccaatctttaaatagtttcttcttttttttcttccgaggccttcgggcccccttcttgtatagactaatttaatctgcaatcaaataaagaggaaattttttgtgtcaattctatttgttgtgtgtatgagacaaggatgtctgtgccgtggttcttttgtgtcttggcttgaacaagggctcgcgcccaggtccttagtcctcaaatggctcgggtcggggctagtgcctggggagatccacatgtcgagactggccaggccgggagcgtggtgaccgagggttatgggtgacccgatagtgggtttttgccgattcccccccggagttcaccacgccccggggcacggctcggttctgggccccgtttggcgattttagccgacccgagcccccgagggcaggattgaacacgaatgacctatttcaagtcaagattcttcaaaaggaaacaacagcacagatacagcctttaggaaatcgaaaatacttttattgagatacagatataagagaaataagaatatgcatatgtggtagcccccggccaaccctgcacgcccgaggggggtgcggggttggcccgagcctgaaacctgacacccgatcccccttaggggtagaagcgacgaaggtgttcgatgttccacgggttaggcagctctgtgccgtcgctcgtggctagccgaacggagcccggccgggggacaccgatcactcgatacggaccctcccacattggtgagagcttgctcaatccagcacacgtttggacgcggcgtaggacgaggtcgtcgacgcagagtgatcgggcccggacgtggcgctgatggtagcgccgcaggctctgctggtagcgcgcggctcggagggcctcgcgccgccttcgctcctccaggtagtcgaggtcatctctgcgaagctgatcttgatcagcctcgcagtacatgatggcccgaggggacctcagggtgagctcggatgggagaaccgcttccgcgccgtagacgaggaagaaaggcgtttccccggttgctcggcttggcgtgattcggttcgcccagagcaccgctggcaactcctcgatccacgaatcgccgtgcttcttgaggatgttgaaggtcttggttttaaggcatctgaggatttccgcattggcgcgctccacttgcccgttgcttctggggtgggcaggtgaggcgaagcagagcttgatgcccatgtcttcgcagtaatcgccgaaaagttcactagtgaattgggtgccgttatccgtaataatacggttaggcactccaaactgggctgtgatgcccttaatgaatttaagtgcggagtgcttatcgatcttgatgaccggataagcctcgggccacttagtaaacttgtcgatcgcgatatacagatactcaaacccgcccgaggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcacctttatggatatcggcaagaagctcgacgccttgttcccgaggaatgcactttaggaggattccgttagccgcgcgccgatagagggtcccttctaccagcacgtagcgtttggagatgcgctggacgcgttcactcccttcgtggtcctcgggtagagtcttatctgtgaggtatgcttggatctcagcgatccaagcaatcaatctaagggagctgggagtgctcccctcgggtcccgaggcctggactccgacgggcatcgggggcctgtcaggcgcgtccgtctcccctatggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctagttaacgaccagctgggagtcgcctaacaccaggaggcggcggatccccagtccagctgccaccctgagtcccgcaaggagtccctcgtactccgccatattattggtcgcccgaaagtcaaggcgaaccaaatatctgaggacgtctccgctcggcgaggtcaacgtgacccccgcaccggcgccctgaagagacaaggagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaatcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggtgcactcgtcttctgtgccgacgacctcggggtcggaggacgacaggagcggccttcccacagtggcctcagggccgtcctgggggtcgggagctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacggggtgggggtgcgcggaatgaggattgtcctcatcgcgctccacaaccaacgccgcactaaccacttgcggggtcgccgctaagtagagtaacaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatacaaccggtgacgcattgcacatccctaagcttgctggggggcgcatccgctctatagctcgtatcttctcggggttggcctcgatgcctcgggcggagaccaaaaatccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgagacagggggtaagggtccttaggacatgccttgttaaggtcggtgttgtcaatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgcacggcgagacggtgctcaatcaccttcctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggatgtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaagaccgcgttgtagggcagactgaggtccgccacatcaaagttcacccgctccgtgcggaagttggcggatccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcctccatcaatgaggacacgccccagctttacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccctaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgagatcgtgaagggaagtgttgtgaacgatgcaccacttgccggttgggcgctccctgctgggagcgccggcctccttctttttgtcgcccgcaggcctcccctttcgggtggcccgcgaagcgccctcgacggcgaggacatgaccctcgtcgtcggtatgggctgacctcttcttcctcctcctatcacgccgccctgtctgagcagcggatccaggggcggccgaagctgccacaccggaaccggaggggttccaggtccatgcctcctccttacgagccactcggtccgcgagctgaaaaagctccgcggtagtctggggctctttggaggtgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctggactgcatgcagatccgcttcttcacctgggcgcggatatgtgccttgaaagttcatggtgaactgttggcacaaatcctcccaggagtggaccgacgcgggtggcaagttcattagccaaccccgtgcctgtcccttcagggccatgggaaaaaaattcgccatgactctgtcgtcacccccggcggcctcgatcccggtcgtgtagacctggagaaactcggcggggttgacgctcccatcatatttttcggcgatggtgggccggaaccttgggggccaacggacgttccgaaggctcgccacaaaggctctacagccgacaccaccaaccggggggcacggagggctgatccccgcgtccgtgttgaggtgagactccggacgaggaggcgccctccgttgcgtggggagtacgccgaccattacgccggcgctcgatatcgatgcgggcatctggccccccacgctgatcttcctgggtcggaggcgctgacgaaggagtggcggccgaatggcgagcaacagccgccgctcgccgcgccctccgccttgacgacacggagccagtggtagcagcgccagaggtcttggtggcggaggaccgcccaccagcacctaggcgctgccgtgccgtcatgaccaagttggccacgtcgtccagccaacgttgggctggagactccgagtcagggacaatgggcgggtgacgtaggagcgcgcccgcagcttggagcgcgccctggggcgtgctgccgtcgccgtagaggaggagtcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcgcccacgaaagagtgcgagagctcagaagatcactcgcagagccccctacctggcgcgccagatgacagagcgtggggctcctcaccgggagaccgcgcaggcccccctttgccggttcggccgggggccctgggtgaggttctaagctcctggtctgtgtgtggaaggttcgcgagagtggaaaaagcacaggacacgggcgatgtatacaggttcgggccgctgagaagcgtaataccctactcctgtgttttggtggatctgtgtatgaagaagctacaaagtgcgagccagcccccgatcgttccaggatcgttttttccttttctccctttccctaagtgggcaaggtcctccttttatacctcaaggggataccacatgcaccatttctctcttttttgtggggacttatcctattttttcctaaacagacggagacttggcttctcttcattaatggacggagatttgtatggctgccgtccgaatgaccttctgatgggacggcccatacctacctccacttccgccggaagcaggcgcgacgtgggaacatggttgtctgctgacgacatgaccattgttagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaagagctaacacgccggctccggctagggacgagtgcttggaggctctcgtcctgacgggatggggcgaggcgtgcgtcagaccacctatcgcctcctaacccacgatctgaccggtctgtgactgatcacagaccagatgaacgagcgcgctgcactgcgctacatgcggcgtgacgcgctcgtccaaaccgcaataaatgcggttag

SEQ ID NO: 69414 - DNA, 26198 bp, Oryza sativa
gcaggatcattgcatcatattaccattgcctgagctatgatcaacctaatgggagaagaaaaacacatataacatcccgagtagtttgtcacttgatgaataaatgaaccaatgaaatctcttttcagtgaaacctcactaaaaggagtaatcagtacatgtatttttctgcagttggtatatcttacaaagaaatagttgcactgccataaaaattgagaattttattgaccatttcgtaacagtgtgcagtatgcccagatgcataacaaataaattaaaagtgagtttagcaggtaaaagcaataacaaaacaccatgctactgcatcataagaaagaaaagagaaatagtaaactgtggctattagtagtctgaactaggagtacatttagttcaagtaaatcatcacaaggaagaaaagagaatcattagaatgtgtctgtaagtaatctggcctagtactaaatttagttcatataagctacctttgagaagtgcagcaccatgatttggacatactgagcagagcatgttcctgaaataaattagacacaagggttaattgatataatctacacacggcaaataaaaggcaaagaaaccacatgcttattaccctaccatgtttatgcatgttgcctatgtctaaactgatgccaaatatgctcaattaaatcagttttcagttgggtatgcacagaacgagcacgaatagtagattttctacgtagcacatcagtaaaacatggattatcaccagaagttacttcaggaggtaggactattgatgtcctaggaattctattgaggtcaatgtcacatatcgcatcctctctctcatcttcaacaatcatattgtggagaatcacacaagctaacatgattttcccaacactcttccgtttccacttcttcgctggacggcgcacaatgttgaaacgggcttgcaacactccaaaagcccgctccacatctttccttgccccttcttgacgtttagcaaacaatttatgcttctctgtttgtggaagtgatatagattttatgaagctagcccaatatgggtatataccatcagcaaggtaatacccattgttatactcattcccgttaacagaaaaatgaacccgaggagcctcccctctaacttgttcaaggaatagaggggactgattcggcacgttgatgtcgttgttagaaccagcgacaccaaagaaagcatgctaaatccaaaggtcatgtgaagcaactgcttcaaggataattgttgggactttgtagtcaccacgggtgaattggcataaacaagaatggaccatccttgaaatcattctcatacattttcactgccttagccatcagatcatcatgagactccccactagcatataatgaattagcctccttccaagagcaacaaaaattcccaaccttcttcttaattttaccaaaacgatccttaacttgcttaacttgcctaacccggctttttggggtagtgctgttgtaagctgcagcaacatcgccccaatatttatcattcttcttgaaatttgattctatagaatcatttgagttgttcagccaggcgctgatctgcaatttttaggaaaaagatgtttactggtgttagtaatgtgagtgatgtacatcacattgacaaataaataactcacacaggccacttaccaatctcaagtcttcatcgttcgtccataataagcgtttcttagtcctagagatatctccattctcaacattgataggctgtgatggactcccttcggcgacatgatgcatatggtttgatggggcattgataagattaacgaacccaccaggaggacgagattccactcccctgtatagaaagcaagaacattatagtttcaccataactaaattgtttatgttggatccaccactgctgcaattgtaactaaaacaagctaaggtactgatatcctaaaaacaagctactgaaacttataattagcacaaaaacaaggtattgatatcatttttagtgtataattagcacagaaatttcgtgcttcatcttttatatttaaaatcatacacattaatattaatatggttcattgtttgctcttttggagagcacactattggccattgtacatggtgatattttctgatcccttgatcttcttgccataaatatctccttacaaaatatattttctctttaacatcattaggatccgcatgcgttaaaccagatcggttctagtagatcaagatgatatgccgtgacgggactgtttttctcttttactggggagagatgtacttggtctttgtttactgtggggagagattgatttacagcaagggactaaaaataattttagataaagatcccagctcaggatatggtataggcattttttagtaatgcagattaagtaataaaactcacatgctatgttttatgtaaaaaaagtgctactacagccaatgtcatctgattctcattttaatcgatatcacgtatactaaaattcatgaaaaaaaattgtaaaattttaacatggtccttaacatagatcgcaaaaatatcttttcaaattcatttaacgcacgaacacaatagtaacaggcatataaaatctgaaatattagacagaactatgacaaatttgtattttaatcgatatcacgtatactaacattcatgaaaaaaaattgtaaaactttaacatggtccttaacatagatcgcaaaaatatcttttcaaattcatttaacgcacgaacacaatagtaacaggcatataaaatctgaaatattagacagaactatgacaaattcgcaactaacttaccattcttcaaaatcgtgttgcaactcgatgttggtcttggcagccatagggagaggacatacagatgaactcggcatggcttgcgatggtggagaagcaaaccaagctggcggtggggtggcgaaccaaggacctccataaggatatggcactgccgacggggtaggaacaccgggaggattggcgcaacctccctcttcctccggcgagacatggctattggtggagaggaactagggttttcggtaaaaatatgttgcgtgcgggcgggagagattagcgagggggaagagggaaggcggatagtgggaggcggagacagtaaatcttaccggatttttgaggccggcaaaatagtagatggggatttttttttttcagtggatttgtgtcgggaggggaagagctcttcacgcgcgagaggggaagagatggcgcgcgtgggagggaaagagatggcgtgcggcacgggagatcgagcgccatcacccgggatcgcgcgggagatcgagcgcaatcgcccgggatcgtgtgggaagggcggagatcgggcgggcgctgggtggaggggaaaggggatctcgatcagctacggtggggaagggatcggctgcggtgagtgggtccacaaatcgcgttttttatcgcccaggtaggctgcaagcaagcgataacgcgtgggaaagagagctatcgccgggcgatagatttgtcgctcgctcgcttctctctcatcatttctctcccctccacataggaatatgatgatatggcatatttttggagcctgcctagtcagcttattgtacctgctctaacaaaaaattaagagggttggctctcatgcaagagctagcttaacacaatctccaagacaaatacattaaatgtataagtgagagatagagagagaagaagaaaattgtagccaaccttatagctaatctcattatatatgttggctttaagatgagctaatagtaggaggtgagctatactattatcgttgctcttaggaggaaacatcggcaggacagggaggcattatgcaggggagggtgcggcagattcggagcattcgagtctttctattagtaggatctaagaggtactccatataccaaaacacggatgttagggaatgacctaatattaaattaatagaaaaggtatggctttgaactcaggccggctagtccaccacattgtgaagttagctggaaaacccctagacgtttctatcagctatcctacataaaattacacaaaattatgtagggaaaatacctagtaaaattaaagtgcgcttcgattatatagaaggccccatttcgtcctcagatcctggctccccacactgcctatatatgaagacggtgcaactgcagagttggtcatagtctcatagactcatagtggctgcaagcttatgcaaagcaacaatggccacctgcatcaatggcggcgagctgcaagttcgggtcgtgagccggcgactcgtgcaggcctccgacgagtccctccggccgcacgtcctcgccgtctccaacctcgacctcctcccgcagtccatccaggtctccatgatctgcatctaccccaacccacccacctccgccggcggcttccacgacgtcgtcgcggcgttcgccgccggcttgccgtcgttgctcaaccacttcttcccgctcgccgaccgcatcgccgtcaacccttgctccggcctccccgagatccactgctacaaccaaggcgcggagctcgtcgtcggcgaggccgacgtggctctcgctagcctggactacggtagggtcggggagtcgatccagaagatcctgctgccgtacgccggcgacgtggcgctgtcggtgcaggttgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccagcaagatcgcgcatgtaacagactcttttgtggaggtgaataaaaggaagaaaaaccccagaaaagctgcgaggtttttcagcaccaaaactctgtttttgctctgtttttctatgttgtcgtattttcgtcagatactgttcatcgttctgaactactcagacaagctaggatagccacaatctcgcgtgtgttcagagtgttctagctaacaattggtatcagagcagtactggaacgatccggcgatgtcatacacaccgcctggccgtcgtggtggcggtggcggcggggggagcggcaacggccgcggcggcgcaagcggcagcggcggggggaatggagcagacggcgcattacttccgctcgtgtctcaggggagagacgcatcgcacaccgctcgcctcccagtcctctcgaggacaaactacccggattgggcgctcctgatgcgcgtcaacctgcaggcgcaggggctgtggacggcgatcgatcccggctacgcggagtttcgtgaagattgggcggctctctcggcaatccttcaggcggtgccgcgtgagatgttgcgcgggctggcaaagcatgacacggcgaaggcggcgtgggacgccatcaagaccatgcgggtcggcgttgaccgtgtgcgtgaggcgaaggagcagggcttccgtcgtcaatttgagtcgatgcgattcaaggagagggagacgccggaggagtttgcgatgcggctcactgccgtcgtcgcggacattcgcgacatgggtggagtcatggaagatgaacacgtcaacaagaagctgctgcgcgttgttcccaagaagtataagccggtggctatctctctcgagcagctgctcgatgtgaagaccatggcgctggaggagctagttgggcggctgtcaacagtggattcttacagcgatgatgaggagggaagcgatggcggaaaattgtacctcacggaggaacaatggcaggcacgtgtgaagcagcgggagcaggagggctccggcaacagcggcaataagggccgcggcgcgcccggcacgcagaatcaccgaggcaagcccggtgggtcgccaaagggcaaagaggcggccactggtgcgaacagcagccgcgacatctcgagggtaaagtgcttcaattgtgatgaatttggtcactatgcaaggcagtgccgcaagccacgacgccaacgccggggagaggcgaacctggtgcaagccgccgaggaagaaccgacgttgcttatggcacatgtcgtaggggtgtcacttgctggcgaggcgacactcggacgaacacctggtggacaggaggtacacctcacggagaagaaggtgatcctggaccacgaggatggtggtgaggaggaggtgacaagagattggtttctggataccggcgccaccaaccacatgactggagtgcgttcggcgttcgccgagctcgacaccggcgttgttgggacggtgaagtttggcgacggctctgtgattgaaatccaggggcgcgggaccgtggtgttccgatgcaagaatggtgatcatcggtctctcgacacggtgtactacatcccgaagctgcgcaagaacatcatcagtgtcggccgtctcgacgcgcgcggctacgacgcacatatctggggcggggtctgcacactccgtgatcccgatggtcttctcctcgcaaaggtaaaacgagacataaattatctctatatactcaagctgcatattgcaaatccagtctgcatggcggcgagcggtggcgacacggcatggcggtggcatgcgcgtttcggacacttgaacttccagtcgctccggaggctggcccaggggaacatggtccgcgggcttccgatcattgatcacactgatcaactgtgcgacggttgtctcgcgggcaagcaacgacgactcccgttcccggaggaggccaagtttagagcacaggaggcgctcgaactggtgcacggcgacttgtgtgggccgatcacgcctgcgaccccaggcggcaggaagtatttcctgctcctcgtcgacgatatgagccggcatatgtggatacggctcctctccggcaagcatgaagcggcgacggcgatcaagcagttccaagtcggcgttgagctggagtccgggcgaaagctgcgggctctgaggacagatcgtgggggggaatttacctccgtggagttcatggactactgcgccgatcatgggatgaggcgagagctcactgctccttactcccctcagcagaacggagtcgtggagcggcggaatcagaccgtggttgcggcggcgcgctccatgcttaaggcggctgggatgccggcgtgcttctggggggaggcggttgtggcggcggtgtatgtgctgaaccggtcgccgacgaaggcattgaatggcgtgaccccccatgaggcgtggcatgggcgacgtccctcggtcgaacacttgagggtgtttggctgtgtaggctacgtcaagacggtgaagccgaacctgcgcaagctcgacgatcgaggtacgaggatggtgtttattggctatgaacaggggtcgaaggcgtatcgcatgtatgaccctgtggtgcggcgcgtttgcgtgtcgcgtgatgtcgtcttcgacgaggcggcgacatgggcgtggcgtgatcctgagacagaggcgactgaagaggaggaattcacggtggatttctttgtgaatcccgtggactctgttgttgccgacttgggcgaacaggctagcacgcctgtgcagggaggcacgtacccggcgtcgacggccactccgccctcaccaccggaagtgccggcgggggtggagttttgctcaccaccaaactctgtcacgccagggacaaatgaaggccctatcaggtatcgccgagtgcaggatatcctatctgctactgaacctgtccttgattttgattatagcgaccaatgcttgctggcaagtgaggaaccaatgagtcttgcagaagctgaacaacagttgtgttggaggcaggcaatgcaagaggagctaaagtccattgaagacaatcagacttggagctttgctgagctccctgttggacataaagcaattgggttaaagtgggtctataaggtgaaaaaggatccatcaggagttgtggtgaaacacaaagcaaggttggtagcaaagggatatgtgcaacaacaaggaattgattttgaggaagtgtttgccccagtggctagaatggaaactgtgaggctcctgattgcagtagctgcaaacaaaggatgggagattcatcacatggatgtgaagtctgctttcctgaatggtgatttggaagaggaagtttatgttgtgcagccacctggttttattgagaaaggaaaagaaggccaggtgttgaggctcaagaaagctttgtatgggctaaagcaggctccccgagcatggaatgcaaaactgcacaacactttgatttctctgaatttcatcaagtctgaaactgagagtgcagtgtatgtgagaggaacaggaagctcaaggttgatagtgggagtgtatgtggatgatctgattatcagtggggctcaagcaagtgaaattgatttttttcaaggaggagatgaagaagaaatttcgcatgagtgacttaggtctgctgagttactatctgggaatggaggttgtccaaaaggatgatggagtgtttctgtcacaaactgcttatgcagcaaaaatcctagaaaagacaggaatggaaggctgcaattctactcaagttcccatggaagctaggttgaaactgaagagggagagtggaggggaaggagttgattcaaccatgtatagaagcactgtgggaagtctcaggtatttggtgaacacaaggccagatcttgcttactctgtcgggtatgtgagcagatttatggagaaaccaacttctgaacattgggcagcagtgaagcatattctgagatacattgcaggtactcttgatgttggctgctggtttgggagaagggaaaagggtgaactcagattgattgggttcagtgacagtgatatggctggggatttggatgataggaagagcaccacaggtgtactgtatatgctgggagacagtttgatcagctggcaatctcagaaacaaaaggtggtagctttgtcgtcatgtgaagctgagtatattgctgctactactggtgcttgtcaagggatttggctcaataggctattggcagaattacttggagaggaccctggccaaactgtgatgaaagttgataacaaatcagcaatcaatctctgcaagaatccggtactccatgatcgaagtaagcacattgacactcgatttcattttatcagggagtgtgtggagaagaagcaaatcgctgtggagtatgtgcgaacagaagatcagcttgcagatatactgactaagcctgttggacgagttcggtttcttgaactccggaagaagatgggtttggagcaggcacatcaagattaggggggaaattgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaggtttttcagcaccaaaactctgtttttgctctgtttttctatgttgtcgtattttcgtcagatactgttcatcgttctgaactactcagacaagctaggatagccacaatctcgcgtgtgttcagagtgttctagctaacacaggtggtgtcgttcgcctgcggcggcttcaccgtggcgtggggcaccaaccatgtcgtcgtggacgggagagccctgagcatgctcgtcggctcgtggtccgagctcgcgcggtcgggaacgctcgccgccggagcacggcccaaccacgaccgctccgtgttccggccgcgcgccacgccgtcgtacgacgcgtcgctcgacgaggcgttcacgccgctggacggcgacggcgagcgccagatcaacgtcctgacgagcgacgagagcttcgtcggcgtgcgcctgtactacatcgaggcggcggacatcgcccggctacgcgagcaggcgcgggcgacgcgggtacaggcggtgtccgcgtacctgtggaaggccctcgccgcggtggtgggctcgcgcgacgcgcgctgccgcatggtgtggtgggtggacggccgccggcgtctcactctctcctcctcgccggagctccgcgccgcgatgcgcagctacgtgggcaacgtcacgaccttcgcggaacatgtgtctatttgccgtgtgtagattatatcaattaacccttgtgtctaatttatttcaggaacatgctctgctcagtatgtccaaatcatggtgctgcacttctcaaaggtagcttatatgaactaaatttagtactaggccagattacttacagacacattctaatgattctcttttcttccttgtgatgatttacttgaactaaatgtactcctagttcagactactaatagccacagtttactatttctcttttctttcttatgatgcagtagcatggtgttttgttattgcttttacctgctaaactcacttttaatttatttgttatgcatctgggcatactgcacactgttacgaaatggtcaataaaattctcaatttttatggcagtgcaactatttctttgtaagatataccaactgcagaaaaatacatgtactgattactccttttagtgaggtttcactgaaaagagatttcattgtttcatttattcatcaagtgacaaactactcgggatgttatatgtgtttttcttctcccattaggttgatcatagctcaggcaatggtaatatgatgcaatgatcctgctatcaagggtctatcttcgatgaagaaatcagtctatcttcgatgaataaatcattctcacttgttggacagcatatttatatgtacttttgcttaatgccctattgttgatgtgacttttggatctgtaaaccgttatgtttattttgctttatcctctattaccttgtcagttctttggaactacagatatctttcgttaccatgtccttttgttaagacttgtgttcggactggtatgatattatcgattaatctatggtatttgagttattgttatgtagtaatattgtcttgtaatttttgtactatagagattttggttgatatggtatgtgaatatgctattggcacaactggttacaaagatgcaattcactcttgatcacacacattgatacacacattgatatgtgcatgatataatttactatttgattatgaggtgtagccagccaacagacaatctattgtactagtagctagctttagcaatgggctattagtcagcaactggctatactattagccttgctcttacctctctcctccacataagcttatagtagtcttatagctcactattatacttgctctaatccccaagccaggtggcagcgaggtgtctccccttctccaaatgtctttccacaccattgctcccactacctcctatccactgcagatttaacgctgccgcggctgaccccatctaccaccttcctcccaacaccttggctctagcagtatagccgccatctgccgccgaccacctccccgtgcgcccttccgtctaaagcagtcctcaccgtcccctatcccgctccacctcctgacccccgaaatccttattctagaattattttgatgttgctagacaccgatgttgggaaagatgaagggatcgttgaggaacttgatgtcgtcattgctggtaagccatggtagccacctcaccctctctcccatctattgcctcaccgccctcactggtccatgctggcgctgtcttcaggttgtcgctggagaagacgtgctcatcgtaggaggggaaaatatatagtgtaaacaacatatctagtgaaacctggaattaccacaagatgtaaaaatggagagtaaaagttttactcatagtaacgtgaacaaatttcatagatccatttttgtattctatggtaatttttatgtttctacgatactagaaaaaatacccgtgcgttgcaacgggtgaagactattttaatcttattactgttatattcttcagttaaggtgaaattcattatggtaatttgcttggatatattttctttttaaaaatcatgaggtgcggttaggagtctgatcatctcaagttagcatgcaagttcttttaaggatatttcttatatgactccttttgtatttgcgaaagcgaacaaacttaaaagccgactcacatacagacatgtattttcaaaaacgaacgaatttaaaaaccgattcatacacggatgacgtaccaaaataccggcaaaaacatcttcaatagtagagatatatgtttttttcttgtaggacaagacctgctcactggtgaggaggaatttgattgaaattgtaaaaacttcgggtgactaaactctagcaataacctaaattttcttggcccagctatatatatacagatcgactcaatatgaagtcacgcatataatttgttttactaatctggttgtatagtttttacctgccaaatatgcttatgatttatactaattaataatgggtacaaactttgactttttgattttatagtatgtctccaaaaaaaaaaacagagggactagctagtgaagttgagttttgaaacaagacctagtgtgtacgtgactccaaacaagcactgacgtacgttgcgatgatacgaggatgcatagatggatcaattctaaaatcaaacaaagtccgataaattaattaagttgttggttaatcattattccttaaaccaaatgagcatgatctcagacttcttgaacgaacactcaacacgtacactaatttcataatttgattccaagcatccaaaggaaaacattccacaggtcaatactatgcttggttctcatgaaaaccactactagactaaaactgtggatcatctgcgattggcacctgcgacatttcagctatttgcagatccatgtgcgtacgtagtctgatgtctccttcgaatgaaggaaattttagggcttattcggtttggacgagtttgaattcacaggaaaagaaaaggtagaggaatagtaatggttgcacatattaattgattttttccgagtggtttgaatggatagaaaaattcctatgttttcccgtacaactggtagaaaaatgtgatgtgacaacttgtataaccctcttacattatgttgttgtacgcgcttttagtattactagctagttagtgcatgaaaaacgatgtaaaccattagtatatgattaattaattattatccattgtacacttcgaaaattggattaatttgatatttttagagaaacttctctatataaagttttagcacgaaacacacaaacccaggttgggaaacgtggtcgcgttaaaccagagattagtccagctcaaacccagtttagagcaggtacaataacagaatataagccaactataaacatattttaaagagataaaagatgggagagaagagtagcgagctacagatctgtagccagctgcagtacggactctaagatacaatgcgtgtatgatatgtgtgatcaaatattaatagtgtagtaagtacctattgtacgaattggctattaatttggctatagatgatttggagctagtagttaggtatactattaaactttctcttaatcttaatttagaacacgaccttaaacgtcgtgaaacacacaagattcttttgacttcacaaaggtcacacgccaataaatatactgtacaccatcattcgacaatcagcgagctatacattattcactcgaccagcttacaaagcactgcatgccctatagctagtttcagtagctagcaagccattaggaagacacacatcaacaagaatggccagctgcatcaatggcggcgagctgcacgtccgtgttgttcaccggcgactcgtgaaggcctccgacgagtccatccggcctcacgtcctcgccgtctccaacctcgacctcatcccgcggaccatccaggtctccatgttctgcatctaccccaagccttccaccggcggcgatttccacgacgtcgtcgcggcgttcgccgccggcttgccgtcgttgctcaaccacttcttcccgctcgccggccgcatcgtctccaacccttgctccggcctccccgagatccactgccacaaccaaggcgcggagctcgtcgtcggcgaggccgacgtggccctcgctagcctggactacggtacggtgggcgcgtcggtcgggaagatcctgttgccgtacgccggcgacgtggcgctgtcggtgcaggtggtgtcgttcgcctgcggcggcttcaccgtggcgtggggcaccaaccatgtcgtcgtggacgggagcgccctgagcatgctcgtcagcgcgtggtcggagctcgcgcggtcgggaacgctcgccgccggagcacggccgaaccacgaccgctccgtgttccggccgcgctccccgccgtcgtacggcgcgtcgctcgacgaggcgttcacgccgctcgacggcgcgcgccaggtcaacgtcctgacgagcgacgagagctcgcctgtactacatcgaggcggcggacatcgcccggctacgcgagcaggcgcgggcgacgcgggtacaggcagtgtccgcgtacctgtggaaggccctcgccgcggtggtgggctcgcgcgacgcgcgctgccgcatggtgtggtgggtggacggccgccggcgtctcactctctcctcctcgccggagctccgcgccgcgatgcgcagctacgtgggcaacgtcacgaccttcgcggtcgcggaggccaccatggaggagatccagcggaagcccctggcggaggtggcgtccatggcgcgcgacgcgatcgccgcgccggcgtacggcgagcacttccaggagctcgtggactgggtcgaggagcacaaggccgggaagcagcggtacatcgacacggcgagcgtcgggctgggcagcccggcggtgagcgtgacggcgttcgcgtcgttcgaggtggacaccgacttcggccacggccacgccgcgatggcgctgcccacgtcgtcctccagcgcgaggctgtgcacggggttcgtgcagatcgccgcgcggcctggcggcggcgacgggtcgtggatcgcgagcgcgctgctgtggccgaggctggcggcggcgctcgagtccgacgagcggctggggcgcatcttcaagccggtgacggcggagtatcttggtctccggccagcgagtggtagctcggcgaagcgggcaggcatgatcacctctaaaatctgaactccaatagactttgcctatgcgggattcaatatttcagaaatttgactgaatttgaataaattttgctatgtacaaaataataaggatgatgattcttccgctgtcttttgtttttttgcaatagtggaatgcaattctgatttaactaattaatgagctgtgcgcatacatgtgcctatctcaggatgaaaatggtcgggaaagtactccaacctataagtgccttatagggaactcagaatattttttcacatgtatttgaaatacactcgtaattcctaaattactagtgaaaaaagtcaccggtatgcttggccgaagatggtattatgccaaatcgcaccatcacacttgagcacgttatgtgcaactcacaatggcacacggagacgcgccaccgtaggagaaggtagatgctgccaaacaaacacccaggaaagacagcgtcagaatgtacgcacgttggtttgttctaaacttagtaggccagttaggatgccctctaatgctatagagatgagaacaattgaaggaccggaggaaaatatactttagaataggtagcaagaagtaggaagatgcagaatatagagggtttaggtaataaattgattttgatgatcgattgattgttgtttcaattgatcttggctctcaatacttataagagtgatatacttgatatacttgcttcccagggtcttttccacttcaattaaacgtagagatcaattagctaggactctaaaatcttaagtccaagcaagaaaccccaagagagattaattggatttggagtcggactctgccgttctaaccggccacatgccgttggtcagaccgatcacctgctgtcggtttgaccgaccctatgagtactgtcaaaccggcctcgcatggcaagccgagtcattttcaaatttaatcacatttttatattcttattctaggtgctaacacatggttaacaagcggaaaaaccattattcagaattgctaccacaaaattatgcggaaaatcagttgatttcgttgaaatcctttatgaatatggatctcagtcgattcattcatatatacaaaatcgcttcggcattactaaatgatgaaattgtcggcggtgttggcatgacgcgagagccttgtggctttgcttttttgagatggtctgaagtcaaaaggaatttttcgtgtatttcaccggggaacaagttaattaagacgaatatttcgtgctaatgcctatgatttggacgagttaggagaaaacataaactatgacagatcgagagtttattaaaataaccatcttgggaactatatatgaaaacagtgtagatcctcagtatttgcctttatattttgaatatgactatacgagaccaaaacatagccttgactcagcgatttctttctttagaggccagagatatctaatctgacacgtatcttgtttattgcatttcgaaggatttagccccttgttagtccaaaaggaaggacaaacaagcgctatatcaaattcacgtgttcaccttattgtttcctcgaacacgtgtaaattgttctattttattggcttttttttaaaaaaaaagggctaaaacagctattacacgtgactagatggattaccattcatcagcgtctaataagcaagaccggttcaaaataaaagaacgtcatatgcctcattgcctcctatatatacagttataatttccaaattttattattaaatcaaggaaaataattaattaaagaggcgactatacatggcattagtgaacgataaagatagtgaagatgatgtcaatgcacctgcctgtgcacgacgagccgctcctctggtcatcggggcgccatggggtttcgtccttcaacttgcaagaagactaggggaatgcgaaccccgcgacttccgagcgaggaagatggcggtaggagttgcttattgcaggcggagctaattcgcacgccggcccacggcccacgcgcgcggcccctaccacgtccgtcccctcctttgttttttccttttttttttccgcgtgtctttcccttttttgcgattttttttctccttctctgattttttttcgtgccaactagcaagttttaaatcatgacttaaaaattttcaaatctcgagttgaaagctttcaaatctcaagttgaaagttttcaaaattttcaaatctagacttgaaagttttcgaatctcgagttgaaaattttcaaatctcaagttgaaagttttcaaaattttcaaatctggacttgaaagttttcaaatctcgagttgaaagttattaaatctcaagttgaaagtttttgaatctgagatgaaagttttcaaatctcaagttgaaagttttcaaaaatttcaaatctggacttgaaagttttcgaatctcgagttgaaagttttcaaatctgagttgaatgttttcaaaatttgactttaaaatttaaatcttaaattgaaagtttttaaatctaactaaaaaattttcaatctgttagtaaaaaaatcttaaaaatattttctaattactatcattagtgttaagtgttaactaatatagataattaggtggtcaggaaagtgagggctagcagcgcgtacgcgcctgctaggcgcccccgcttattgcacggtcaacaagcgattgtccacgcgaggccctaatggaataattaactatttaccactcttacgagtggtgctaaattatttgccactggacccatatgtcatagacacatgagggcccacatgttatagacagcgagtggcaaataattaattgccacatcttaaaagtggcatggagttaaatgtcccggccctaataggccgcgcttcaacctaacaagtgggtctagctgacatagagggatcctagcttggcctggtaaggctaatcgttttggtatcgccaaaaaaatcctagctccaaggagcgaactagcccaaaggggtgagaaaaggctggctcaccagggagagccaaatcggctcgcttccataaaaaaaattaatgatacacgcgaagtgattttctcctaaacctaccaacaactggcccatatctcaccttcctcttcctcaatattcttggccgaactctggggttagtagtcattaataaaacactttatttttttattgtttcttgaataatgaaccataactcttgtttttcagataatttctttttgcgcattatctctgttgtttagtaagaatactcgtatatatatagtcttattatgctacttgcggaaaaattacaggccactaatcgtaaccaaagagagcaaacgaaccaaatgctgcagaattacagcgagcctagcaagccggcatggcgatgagttggtttgcctttgccgagctaggctagctagctctgccctcgatcgtgtcgtcttcaagattcttaaaaccagtgattttgtgttaatggtactgaagagatggtattatgtgaaaaataaataaaatctatggttatgcgttacattgatcccaaaactcggttttctgaaattcactctttataaagtagtataaactaggcaaaaatagatatgtttgatttaggataaagctaaaatgatagattaatttgaaatctacacatctaatagcatttgtgttatcaatccagtccatatatcaagaactcatggaagctcaatgtatagcacgctgcccgacgccgtgccgtaccggagtaccgagaggctagccggcggcattgtcatcgactgcacgatcggtggataaatctttgaccatcgcttctataaataaataaatctaagatttatccaggatatttaagtcacagcaagtttgagatgcatataatatagagtatatgcccagaaccagtcactcgaatggaagaggacataatggaatatataattttttgggttcatagttccagcaaagcacaaaatcaaaacaattcacatagttatatacacatgctaaacgtcaacattcctatttgaaaaagaagattcgacactccaagaatccaaaatactctgcaggcctgatttataggttgggtgaagaagctttacaccaagttcctcttttagccgagcattagagacccgcttctcagcagctacgattctgtcctgagtagctggtagtactacagaatccattatcaggccaggatgcttcctctcaaccaagctccgagcaaatgcgaaaacctcagatcttggggcagggtcgtcatccactacgttgtatatcctcctagaaataaagttgccacacatacatggaatcagttatcaaccttcaaaggttgtttcttctaatggaaatgggggagctcatgctctcctagttcaaaaaaaaatcaaccttcaaaggtccagtagaaaggtacagtacgtaaataggttactgggattacaaagggagtaacactatcagtatcaggacctgattttagttcttggtttgatggtatacaacaccacaaccaaatattgtacccaaagtggttatactcagatacagtattttactaataaaaacagtggttgctactacatagaaattttatgatacctgaatattttgtggaaaagtgattatgaaaatggttctgtgctgtggacagatatacagccaaagtgagtctcttttggcagtgcagtctcataatttgttcttgtgagagttgcacaaggtaatactaaggaagattcaaactagtttgaaaatatgattgaaggcagaaaaactggaaaagtagcagccgttttgaagacctgaagtaaaaaataaaaaataaacaaacaaaccttgcacttctgatgctcatgctagccaggatagcctgacaaatgtcagccacatgaattcgtgcagtgtactgtttggattccctcgatttctgtcttcgtgacaaagatttgctcttggctattgtgtccactgcactgcaataatcaacacaaagggtcataatagtggcacttttagaaagcaagtattgggaactgtaacaaaagcctcccatgaaaaagttctcattttcatccattacatacttgacaagtttgtagcacaagttgtacaccgtattggttgaaatcagataaaaagtgctccaaatctttaattttaaaaggttgattttattggtggaattcagaatttcagtagccaagtcatgcagttctggagtaaatataacttttggttcaaagactacaaaataaaatggattgaaattttagcagactgaaaccttcttcctggcccatatattccacctaaacgaaatacaaaggctgatagatctaagtcatctataacattcaaccatcctttttcggcagcatatcttaatttcacagactcggtcttcggattcaccgtatgactgcatgaatagcagattcttcagctttcagttaaacaattattgcagaagcacttacagaaagccacttatcttactcctcatcaacccatgcaccaccacaatcaccatacacacctgaaaaatgataataataattacaagttattgtatggcagaaaaatttttcagggctagtttgcacatttatgatacgttcagttaacctgaaaagttggtatcgacttttgaatgctagctaggattttataagagatgtgagtatgatgcattgtttgccatgaaaatggtgttgttgcctgatgtacctcagatcgaatcgagcattgaaccaaggaaaaaacaatttctgcaagccattgcaggtgacaattactcacaccttggtgcaatgcaggggtcagttcacaagtccagggaggaatcccagtctggataaactcattcttgattccacattggtcattggtatgcttggtacataaaaggttccagcacctgtgtcatcctggtgaccaaggaaggagagaatagccgtatgtttggcagcaaacgtgcaacattttactagctcaatatctcttaggtagtgaactaggcaggatatggttgcttatctagtttactcaagtagtcctttctgtgttagctaggtaacggttgtttgttttcttccctagaaacagcagtccactagccatgtagtttggttgctgtgttgtgcccataccaccaaaaaagcccacaccaccaacttctcttctatgttaatggaacgagaagcagatattatgcgtgtttagaaaactaacataaaaaagatgttgctacagttgaaggacgaattgaaattatgcaggtcatactagagatgatcagatgagcatatgtgcacttacttgttgaagaaaggtaacatagccattgaaggttactattgcttagtgtagtttgcaggttggaatgtgaagaaagcaactgtagatattagatgcaaatttaatcattattatgttaaatttagatggaatttaagtcaatcgaactgacatcaacaagcaattgagaacgtacaggatcaccaattcccgggatgggtggaatggagatgagcaaatgagttgcatcttgcaaagaccggagatttgtcagactgtaattgacatagacatcagcaatcatgtaaactcatttgaaacataacaatgcacagaaacacaaacaaattggcaacacatgctgaacaaatgagagatggtagacatcatatcagcacaagagttgtgcatcgaacctaaaaggaacaagaacaagaaccggagatttgtcagactgtaaattgacatagacatcagcaatcatgtaaacggattcgaaacacaacaaatcatgtgcaggaacacaaaaatgtagcaacgcatgctgaacaacaatgagggatggcagacatcacatcggcgcaaaggatttgcaattactattgtgcatctaacctcgaaggaacaaagaacaagaagagcaagaagaagaagaagaagcagcacctgctgcttgtggcatcgaagatcgaagcatccatgcccagcatctcgagctccgtcttcttggcagggctggtgcacgtcccggacacccttctgcatccaccaatcaatgaatccagccgcaaaatcgggaatggtccgtaggagaaacgtacggcggcaatagcagcagaatccgatccaaaatggaggagcaggggaagtaagtagctggccatccttgcgcgaggaggcgctgggagacgtatcgggcgaccaaaccggtgccgaacacgagcatgtgcccgggcctcggctgcggcggcaaggcggaggcggcggcggccgccatcggcttgggggagcggacgcctcgtggaagagccatggggattgagattctgcagcaaagcggcggccgccgtggtgggtggggggaagcgaggattaaacggtggcgacccgagagctatcggcgagcggcgagcgccaccgcggcggaggaagcggcggatcctgtggggttttttgcggcggcgcctccctgccacttcaggctgagggtatagatggcgaattttttttatttataattttttttattaaaagttttacaaaaataattttccattttgaaaattaacggaaggagtcgcctaccgccctctgggagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccggcctccgctagggcgattttgtactgtgggggggggccgcctgcaaatgggcggcgagggggcatggaattttgcaggtgacccccttgctgtcctgggggagggcgatttttgcctctccccctataaagcccagtccctcctatgtgaaatttcattatattcactaaaaatccaaaaaaaacaaaagagagagaggggagggcagcagcaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtcgaaatggcttttgaatggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggattatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttatggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccatcattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtaatgggaacaaccaggttctacctatggctttagcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagcc

SEQ ID NO: 69415 - DNA, 878 bp, Oryza sativa
  unsure (1)..(878): unsure at all n locations
tatttgaccttgtttttacaattttntaattagtgaatgctgtntctnaacactttttattttttgggatcannnanatcttntgtgttgtntntgtgttntnatannnnnnnnnnnnnnnaatggtttgatgacnttttgataacnnctgccngnagccnngcagncnactctagaggatcccctcgagagattgctggctggttgatacccgtgcgtaaccaaaaagtctcttattaaatgtatcctaaatcaaatatcggacgagcagggtctgttataacaaaaaatcgatttaatagacacattaacagcactgtttttatgtgtgcgataatttataatatttcggacggttgcaaaattgttaatgaataactgtcaggtagggagcctgatatgcctgtcgactttctaacctctgaccaaaaacagaattacggttgttatgctgcagaacctaatgacgtgcaactggcgcgctattttcatcttgatgaacgggatctggccttcattaaccaacgacggggcaaacataataggctgggcattgcgcttcagctcaccacagcccgttttctgggaacatttctgacggatttaactcaggttctgcctggtgttcaacattttgtcgcggtacagcttaatatccaccggccaaaaggttttttactgtctaggctaacgggagccttcctctaaaggaaattctggttttaataaaggaaattaccggtattatgaaattggggattgcccaggtctttcggctgaagggttgctttatcggcggaattggattggaactaaaacggaagggttggtttttaatattggccgggaatggatgttttaaaaatggattgccaacg

SEQ ID NO: 69416 - DNA, 39546 bp, Oryza sativa
gtcatacattaaaatacggaggcagtagtatactcagatcagatgccaacggttgccttacacaaggggatagaattatatgtactctgctgccacttgtgcgttggttgcttgagagtaccatatgcatgatgcatcagagtatcagacatggctggtagcccaacaagtcatctttcaatctcccggccgttttctttttcttccttttgctatgttttgtttttatctcttatccattgcaaattgcagatagtgtttgattgggggaaagcaggaagataatgcgaccgcagacagcaacacattttggttttgcacatcttcttcagtaatgggtacaatgctttgacaaatacagcactaagcactacgggagatttcagatacaaaaatattagtattaaccacattgccgtgctgcagcacaagtacaagaaggttgacaaacagcgtccacaaccgagcaagagtgatacaggtaacacggcaagtgaagtgaagtgaagtctcccatctgtttagtactctgaatctcacaaaatttgtgatgcttccaacttcagtttcagaccatgcaaactccatgctcacattcacaagcaaaacaccctctaagctgtaatgtcatatatcttcttttcatagagttaatacagacagaaatatgctgaagaaacactagtgaattttcattgaattccaaagttgaaaacacttttggtataacatttgcaaaacaagtatctgtatttttctgacaaaaaaaggctgaaatttcctattgtaacatctccaaacacagcagcaggatagtttcctggcgggaaaagagggggaagaaaaaaaagagataacaagagagagcagtagaggtcacttcctctgtgtccttgtgatccaatccaaaacgtggcaacaatcatcatccccacggaacaccctgttctcagaacggtaggtcttgagatcacggctctcgtgcctgcaactctccctcttcatttccagtgaatcaggaaccagccttgcagcacggtcatggtaagcatcacagataaactgcgcaatggcgtcgaaaggctgcgaggcatcaacccactggtaaatcttctcgttgcggaaccatgtcatctgcctctttgagaagttcctggaggcagtctgaaacttggtcaggaactccaagaactcttgtggggagctgctgcctccgttgtgcctacactgaagcaagtactccatggcttgcctgtagccgattgcgcaggtagccgagttcatgccaggactcaagccgatgtcgaggagccaggaggcttcagagagtaggccacctgtgtcggccagcatctcttcgcacctcagatcgattgatctgtagagctcaacgcgtgggcacgcgaggaagatgcagaggaagtcgtagtccagctccagctccgtgggttgatcggcttggttggtgagactgagacgacggtggtgattgagattgtaagcattgtagggcaaggagaaggcagagggaggtgagcctgaagacctgatgatctcaaggcttctccttaaccttgaccagttgttgactgacaggtcccgagctttggggtcgccggcgttggcaaccaggtcgacggcttcttcccagcggccggtgtcccggaagcgggagagctcggaccagacggcggaggtgacgtccatggaagactgcgggacactgggcttgccatagatgtaccagcggaggtagaggccagtccctccggcgacaatggggacgcgggctcgggcgaggaggtggtcggttgctgcgcgggcgtcgtggaagaagtccccggcggagtagtcgtcggaggcgtggaggatgtcgatgaggtggtgcggcacggcggccctgtcggaagaggagggcttggcggagccgacgtcgaggccccggtagacctggacggagtcggcgctgatgatctccccggagagcctcttggcgaggtccaaggcgagcctggtcttgccggcgccggtggggcctgagatgacgatgaccttgttcttggtggcggcggcggcagccggggaccaacttctcttccacacggcggggcgcctgcatccatactgcataccgcactgggagatctgatggcgcgcggaggaggaaggaggaggagctttctggttctgggcggccggccggcgggcggcggcttcgtgtggaagggaagggaagaggatagaggaggagatggatgggatttctgaaagagagcctgtgcagatgtagaggcccaaaacaaacaaacaagtattgggctttcaggcccaaattggacattctattttggaataagttcaccgaaggtccctcaacttaacagcgagcttttttaagatcatttaaccacaaaaccagaaatctctgctcctaaactatacaaaactgtgtaaaaaaggtcccttgatctctggttttgctgacgtgtcagcaaaaaataaaaaaaaattatgggacccacatataagtgagaagaaaaaatgtgggacccacacttctttttgcttttcttttctcttttctttctcctattcgagtatcttctctactctttctccgaggctgccggcggcatagggagcctaagagagagggggcagcggccgctggcgagcgcggcagtgggcggctggaaagggggggagaggcggccggtgagcctgggagggaggagagggggcggttggagtcgatgccatggtggagcggctcgtggggctcctcccatcggagctacggggagaggcggaggatggaggggttgggggcgcactccgggaggaacgatgccgtcccagtgggatcccaccacgcccgcgcgcccggccatgttcgactgcccgcccaggatgaacaccaccttgttcgacggagggagctcaccgccggacacagccgccgtcggaagcagcagcatcatcatccgccgcattgttgcttgctaccgttgggcgttgggactaataatcaagcaaatttgaaatctactcttcctccctactcgtagtcaatttatactgcaactagcggcatgtctgtttgagtttgtttgacccaaccaaaccaaccaaccaacgaaagaaatactccactaaaacgaaacaacatccacccatgtcgatcgtgcgctgctacccccttcgtctccgcctaccgtaggttcctcctcaccggcgtccacatcgccctcgacgccgccctctgctcctcccgcacccggagccgccgcttgaaaccgcctgccgccgccgatgctcctcccgagcccggagcctccgcttcgcagccgcactcgcccgccgcgccccctgcgtcccaagctcctctccacctcccgagcccagagtcgctgctcgcccgccgccgcgctcgcccgccgtttgccaccgccgccgctccacagcctcgctcaccgtcgaagcagcacgagaggcacctagcgcggcgacctcgcctccctccgagcggcagcggcgaccttgtcttcctccgcgctcgcccgtcgccgcctgcctgctccgtccgccgctgcccggcccgccatcctctcaggctcgggggaagaatagagagcaaagagaagagaagaaaaaaaagaaaaagaaaataggagaagagaggacgctgacgtgtggtcccaccacatgccacgtcagccaaaccggggaaaaattagatcaatactgactagggactttttttttcacggttttatattgtttaggggtgaagatttctgattttatggataagggactttaaaaaatatcgctattaagttgagggacctccgatgaacttattccttctattttgcttcttttccacctgcaatttcttcccttattttctcaacgcttttatttatgttgaattccataattttcaatattaataagagcaagacaaaaacatgtgtaacgctccgcttttcgtgagtcgttaaaaactaactcggtaaaatcctaattgcgaaaattttcgttctttgtgtgagagtctaagttgtgccaaggatctcaatttaatcccgttgttccctctcatcgaaatcaaaatcctccccctcatccaaattcctcttccgattcgagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgactcctccttgagttttccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctcgttttctcgctccctctctgtttctctctcgcgccgacaccgcttcccgccgtcgccgcccaaaacctccaccgccttcgcccattcccgcgtgcgcctcgcgaggtggccgaccggccggtcgccgccgacgccatgcgctgccgccttgcccccgctccatgccaaaccgaccgccgccgtcatcgtcgacgtcatccatggccccccgccactccacgccgcacccgtccaagagtgggagaagcagctgccctccctctcctcctcctcctcactctccctctcctcattatggcaagggaccaagcccctttttccccttctttttccctttcccgaccactgccggtgtcactgcctctgcgccgcttgaccgaccacgccaactcgctctccttgaccgcgccagcccgcactcccgcggttcgatttccgccgctcgatccaccgccttcgctgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtctccgcctcgctcgaaacacccacgcctttgttgccggccgccagctgctcgcccccgccccgctgtcgcgaccacctcgccacgactccctccgcgtcgccaacgttgctcctctctcgccggtgagctcctcgcccaaattcttgccatttgcatcatcttggataagccccgagccgttcggttgctcgctcgtccccctaaacgtgtcgccccgccgttgctctgcttcgccgccgccgcgcccgactgtgcaccgccatgggccccctcgccaatccctcgcgccaccaccgtccttgagctccctaggacctccccaaaccattccctagcgccgtcgccgcccggcacggcctcgccgccattgccgcccgctcccgaagaccgtctctcgtcgccagcgaatctcggtgccgctccgtccaatccgacgccggaaacggattccttgaaccccggagatgctcccacccctttgaatcgaaccctcgtcgtctcgtcgtgttttccccttttgctctccggtgattgccgccgccgcaatccaccgtcgttggctcctctcgcgtcgattcctctcgccgccacgctcccggggatccccatgacctccccctggctgcccaaaggccgtcggccttctcctttgtctccgcgccgtgtcgccgcttccgccgccgcctaacgccgccgcgcgtgcgtcgccggtgaccatcgggtcccgcgtccccgcgtgcgcatcgcggtcgcgtaccgtttcggctaggcccgagtccgcgcccccttgtcccttccctcgcgcgaccacatccccgatccgacgagcttggtcgccgccgccagccaccgtcgtacctcccctctcaaatccgtgccgttaaacggattccccctaacctcctctagctgccggcggtagccgctcgctccggttcgccgccgctcgctggaacgcctcgtgcgtcgtcggccgtccgatcccgggcgcctccttctcctcctcctcccctttcgcccctgcccgcgtggccgaccacgtggcagccacctcagccccgggcccgcttgactgggtcaagtcacgcccagtcagcctcctccctccgtcttccctcccgtgcgcgcggtccacagcaagccgtgcggctgcacgtgggctcgccgccatccgtccacccggcgcgccgcgcccgaaccgcgcgcacccgaaaccctagcgcctgcccccgcgtgcgccctccccaccgtgaacccaaccaccgccatgtgggtcccgcgcggtggaccgcgcccaccccgtcgggcctccctctctccccgcgcgccctaatgggccgcctccccgtggccgcgctcggcccaatgggtggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggtttttgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaatcgacggacctacccagtagtcgcactaatttccgtaggtcgtactaccctgattccttgtcgctccacccttgtggtacctcggtattcgtgctctctgagcgcgtataccaaatatcccacatacaccgttgtttgttgaaaacttgggaaatgggtttgtgaagccttcaaaacccgacatgtggtgtcggtgtgtttgaaaataaaatgaattatgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatgtcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgtagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgagaagtaatgatctgacccgggaggtcggtacattgccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtctgtgtcgtcggttgtattctcgggctgtctgagctgcaacctaagttaaggtaaataagtcatctatttattttaaagattgctatgatttatatctgtcaccgtgggtaccagcactatgtcctgggactggtaccgagatcgcggtttcgtaggaagcggttcgcgccgttttccctacgacatgctcctgtcaggtgccgttgtacggcggtatcagattggggtgtgataacatgtttatgttttgttctagtataacactgagcttgtcgagaaatgcaaatatctgagagaggaaagggagttcagaaatgctgcaaacagtctaacagcctcatcatcgttgcgctcatgcttataagccaaaatgtgttttttttaaaaaaaataattttaaacttgatcttgtgaatttttatcgcagttttatttatacaacatttgctttctaatcgccaaagtcatttacataaaaattttagccatcagtatttttttcgttgctaataagtggtaggaataggcataagcataagcaaaaacaatatgaccaagaaagaggaaaaaaggtgtttagaaatgctagaaaaatttgataatatttgaaagagaaaaaaagagatgaaggaatgtcaaaataattgaggaagaggaaaaaaggagtttagatttgctgccaaaagttgaaaaatatttgaaagagagttcacaaaaccagaaatggtgcacaaaaaggtgtttgggaatgctagaaaaaattgagaatatttgaaagagaaaaaaagagatgaaggaatgtgaaaataattgaagaggaggaaaaaaggagttcagaaatgcgatgaaggaatgtgaaaataattaaagaagaggaaaaaaggagttctgaaatgctgccaaaagttgaaaatatttgaaagagagttcataaaaacagaaatggtgcaaaaaaattaagtgaaaattaagatacaatagaaatggtgcaaaaaaaataattaagaaatggtgcaaaaaaagtgaattaagtgaaaattaagaaacggtgcaaaaaaaagtgcaaaaaaaattaagtgaaaattaagataaaatagaaattgtgcaaaaaaaaagaaatggtgcaaaaaaaattaagtggaaattaagataaaatagaaatggtgcaaaaaaaaaagtgaaaattaagtgtagatgcggggtatcgatccccgtacctctcacatgctaagcgagcgctctaccatctgagccacatccccatttgatagagagcttttcacttcctagtaacaaaacaaacaattgagacgagcgaccctgacaagagagagaagcaaagataagaggccgaaacctgcagccacaagcaagcagcacggcctcccgcttccacgtctcatctgccatggccaccaccgcctccctccacctccacctccacctcctcctctcctcctcccgccgccgctgccgcctcctcgtcccccgtgcccacaccgattccatctccaccggccgacgccgcttcattgccgacaccgccaccgcctccgctgccgctgccgtgggtcccctcgtcctaccccggaccccgcttgcgcgtgccgaccagccgccgtcgctctccgagtgggagcgcgtcctcctccccatcgaccccggcgtcgtcctcctcgacatcgccttcgtccccgacgacccttcccacggtaccctacgctacttccttctatctatctatctatgactatatatgccacttacctttgccaatgctatgcttatacatttacatgctatgccagcaatattgcagtgcatacaactttaatttctaccacctccgtcccaaattagtggtcgctttaacttttttcctgtaacgtttgaccatttgtttcatttgaaacattagtgtaaatataaaaaaaatgataagtcacacttaaagtacttttgataataaaacaaatcataaacaaaataaataataattccataattttttgaataagacggatgattaaacattacaaacaaaaactcaaagtgacaagtattgtgggacggaggtagtacttatcactcactgctttgtctttgtctttgtctttgtcttcgtgtctgcactttttttactcacccaatctttacaactcttgttatttttcctactgaatgtagctcaactgtttaagaaacactgacctttgtaaattttcaacggggatcaaaatgttacgtatattgctatttgattgatggatacacattcgaaaagcatctgtctcttgtggagatgtgctgttattaacgtgtactaccattttataagaaggaaaacgcctcattaatttggaacacagtatattgtcttctctagtttcaactcatcaaaagctttcttcatggatatgcatgcatatgttaccaaaaccaaaaaaaaaaagatgagtgatacaatgttccttatctttctaggttttcttcttgggacgagacagacgatattggaaacaaaaaatggaggaaacacatggttccctcgctccatcccgtccgccgaggatgaagatttcaactacaggttcaattctgtaagcttcatgggcaaagaaggatggattattggcaagcctgcaattttgttgcacacttctgatgctggagacagctgggaaagaatacccttgagtgcccagcttcctgggaacatggtaagtttgcatatacatccgtgttgtctgcgctttaacaaggatgaatcatgaacggaaacctaaaattggtagttgctgtgatatgacaggtttacataaaagctacaggtgagcaaagtgcagagatggtcaccgacgagggagcaatttatgttacttccaatcgagggtacaactggaaggccgctgtgcaagagactgtctcagccactcttaacaggtaggaaaaaattagaacgaatttgtgaaatggattttttttttagataatggaatgagaagtagagttctttcttagatgtatttacataatttgaagtgctacatttttttgaagtagctacctaatcgtctttacaaaatcattgcaccggatgtccatttaagccacgacaaattgggcatgtcatgtcatataacatctgatgggctgaaatgctaccacctccaaacttatttgaaaaataatataatactacatttcttcttagcttttctttactcttctcaggccatcatgcatgactaggtggtctatacataatatttgctccaatattttgcctttttgtttctggtgcagaacagtttcaagtggaattagcggagcgagttactacactggtactttcaacacagtgaaccggtcacctgatgggcgttatgttgctgtctccagccgtgggaacttctatctgacctgggaacctgggcaggttcggtagctcgagagtagctaacttcacattgttttggttatattgtctgcggtcacctggaaggtgtattttgaattttatgtaaatctgtttttgcagccattttggcagccacacaacagggcagtggcacgtagaatacagaatatgggatggagagcagatggtggcctttggcttctagtgcgcggtggtggactctttctgagtaaaggaagtggagtgaggactcttttcagctcaagttcactctaacttatttgtactagtttagttccaattcttctatcgaggccttaatgacgctcatgctatatcttatcttcatccaccaaaccagataactgaagactttgaggaagcgtcagtgcaaagccgggggtttggaattcttgatgttggctaccgctcaaaggtaagtgaaatggacttgccaaccacaaaattagcatgtgtgtgggcaaaatagattaaaaagctctgcattccatttgcaggatgaagcatgggccgccggtggaagtggtgtcctgctaaaaacaacaaatggcgggaagacctgggtgcgcgacaaagctgctgataacatcgcagccaatctctactctgtaaagtaagcagatatgggatatgcattctgaagatttaatttagctcattgctctgaaagtttatgtgggggtatacaaatgacattgagtgaatggctgatcgggcgatatcttgcgtatatgcaggttccttggtgacaacaaaggatacgtgcttgggaacgacggcgtcttgcttcgatatgttggctgacgtgcaaagtgcttcagtttgcctgtatcgtccttagacttttttgtacgtaatatgaacctacacttgtttacacggtcaggtatctatctatgtacctactgcaaaaggctgctgattcgtgttgaattcatccacaaaagagtgtaaattcttgtctgtaactgtagcgactgttccaatatgtgaactgcacatccacatgtaatatctgatatatataaaatggagcttgtaaagtgagaaggattcagatattgcggcctttgcaactcatgggagtgcccaaatgccacttctgttggaacagtacagtgatatatagagttgaattgcttgaaaaatgatttctaaaatttgcctcctttggatggtatcaaaatttaggtatgaacattgaactttcaaatccgatttattttacagtaaaaaaaggtaagaatattgcagaaaccgcataatctcatgatgccactcttgttgaattccggcattgaagacagtttgatatgaaacactagtttagtagtatccagaatgcatgctgaaaaagctttcttttacttaatcgatcacagcttcaaatagaatacacctcgtgtgagtgtatcaatggacgggatttcaggggaaagaaggaatttttgtgacaagtaactgaggatcacatcacgatcggcaaccttatcttgtctcgaaactgaaaagagagaggatttgcaactgatgatgcctgattggtactcctagccctaggaagaaaaaaagtggctttttttgaaggaaaaaaaataaaaaataaggattttttttccgttgcgggacgggagtgaaggcacaccaaccgcctcaccactcggataaacacacacacacacacacacacacacactccctctctctttctgtacagtgtcattccttccccttccgccgcttcgaattcgatcctcgtcgccggccgccgccgctaccccattccgagtaagcgaacgtgaaaacccttcaacatgcgcttgtgcgtgggatctgtgtatttttagcgccggccttatgcggccctccactttttgtgccatcccttttccaacaatttaaccttccttccgctccgccgtttctgggattttttttcccgctctagctagattcttcttcttcttcttcttcttcttcttcttcttcttcttcttcttctgtataatctgttcctcctccgcgcagcttcaacctttgtttgattctgcatgcaatctgatgaatccccgaggtctatgtctatctcgatcccctcccgcctccctttgttttcctttgtgtcattttcattcatcatcatcaacagataaacagtaatctctcctccagctccacgagtacccttttttatttcttcacccatcgattcggctcgtattactgtccgattagcgatttcactatgttgtgtgatcgattcaaaggcgatcaactgctcgaccaagtccggattacccagatttgttcatgttcctgccgatcatatatatatatatatatatatatgatattattactgagtggtcatgttgatcctcaagacaagcttttggtctttgatacctagtataattgcttttaatgggcttttgttgtttgcacctccctaggttttgtgctctatcgattatgcttgtaccttttgctgactagtcagctcatacgtgtacaactcacgctgctccaaactatatctgtttctgctaatttagcggagctagttgatggcttgtatcccctttcttttctcaacgccattctcgtggtgaactgaaggcagttcgtgttggttggttggtgggtttcgtattgaacatgctcatgttaattgtcaatgcaggctctccatctcatgccgtatgcacttgaagtgactgacagaaggccacagagcgtaccacacactcggtgtagcacattggtcgatcataacacaaacatcagcttttcaaaggttaatttatgcctggttgtatataagccttgtcttattcactaggtagattaccggtctcatctattcattcatggaaatttgctgacttggtattctttctttcattcatcagggccacctaatacacaagcctgagaacaggtaaacatccaaacaacatccattggatttgagtatgcttgatctgatctagtgtaaacttaagaggaacatatccgatactacaaacttgaacgggaatatctttaacggtttttgaacatatagataattcgggagaagaaataattattcccatttatccaaaaacatcaccttgctctagaacactgaagttaaggaaatatgtgtcgcttactgagcttcctcccacctgtatatgataagttatcaacagaaatatttcttcatcttattatatgattttgctcttctgctactttattaatgttgtatggctacctcaagtcctcaacctgtatgtaccaccatgttttttttccttattattattctgtctgaatgtctatttatgataccagcaatcaccgtactcaaatactttgtacctcaatatccttgtttttttttctcatttccctttgactggtatccatttctattctgatatctgtcattcatatatctggaaagctacatgtttactgtctgtttgtgctgttgcaggaacattacatttgcaactatttccattgggcacaactcggatcagaaattggtgccttttcttcctaacatattacaagatatcaacaagagaagctgtttcgcatcaggagctgctggcacagagatcattcagttcccacagccaataatactttactggttagactgtccaaatgaaaagaacatgcacgatcaagtcgatcattctaaaccattttccagtggaagtccaccaccaggaagcaccttaagacagcgtcagcataggagaaaaatcaaaaagtcattgacagcactccctcccagcaatgtgcttgtaaataattcttccagatctgttactgctcctgtaagatctgattctgatattctgcatgatgatgataagcctccaagaaagagccctaaaaagaaaggaaacaagaaagggaaacattacaggagagcagtctgcaaagggctcaatttgccatcagaaacccattgtgaagagaatattgatgctgcttctcctgttgaggtacttactgatctgctggctgataaattgtcagaaacctcatcctctgctagctcattggttaaggaagctcattttggtgaagagaatggcggggattctggatgtacaggttcatctaatagaactgtaggtgagatatttagctgcaaggatgttcattacttgaatgatgaatcaaacaattacgagagatcactatgtgcacgtgtttctaactctaatgatgcaatagcatattcattgtttaagaagttggaaagggacaacagtgtgaactgcagtgtcaatgatgaggtgagggattcatgccatccgataggggcccatttaagcataactcatgctgaagattcaaatgattcctttggatgcagctcatgctgctcaaagaatgttgctgatagcagtaatcatactgaaagagtcaagtgcagtagtgaagcctgcagcagcaagacttctcttccagttattcctgggaggagcagacaagattaaaggaaatatctagctacagtttgactgcaactaatggagtaataggcactaataagacaagcatagtggaaaatacagttcaacttctgtgtggcaaaaagtagaaaaacttaatgtggagaacacatctagagcaggatgtatggttgattcagctattcagaacaaggatgtactggaaaacattaacaaggttgcacaacataatctaacaaggtcaatgaaaataaatcagaggagaaaagcatgtaatcagcattcaccagacgagagaattgaaatggagcatgccaaagaaaatgatgcactaaactcatgtcaagcattttccagatataagtacaagaagcaaacatcaatactgtaccaacaaacaagtttatcttctgaccagggtacttctcagtcatcagggaactaccatgctcctaagaacggtattgtcatggtgccaaagaatcacttgcaacagaaagatggattgcctatgatgcaactagtatatgacaaggactccagtgttgatactggagtaggtagcaacggctcagctgatggagatgggagctcacaatctggttttgagaaagcagcgctagcatcttgcaacatgggttcttatttggtcccacaagacacatgcgaggaatgtacatcaaccatgcaagcggatcctcattattcctcaaccgaaaataaggccatatccccaaattcgaattccaggaacctatgtgctgatccttcccctgcagaaatggacgaaagttgttatgtgaagttgacaatggagaatactcctcaagaatgccctaagttgtattctgctactggaaaacaatgtaagttgtactctgctgctgcacacgtttcacagaaatgggttgctgttgggaagaaaaatatactccacttcgatggttcagagacttctgctgttgattcctcagttctaactaattgtattcctatttctgctaatattggtgttgaaaccaatgtttctagtgttcttgcatcagctaacaatgaagtcaacaaattagctgctgagatatctgataaaccaaactcgtctggacatcttgatttgagatgtcaaccgcatactgatactggtactgatttcaacaagatgagagaagctgtttgtgatgcttacagggcccaacagagagtggaagacgtccaagttatcattggcaggcctcttgctgattttgaacaatttatttcctctgcttctccggttctgtactgtagcacttgccctgctgatagaaacttttgctcaccggaatgggtaagagatggcctgtgctttcatcagagtactgatatcactctaagtagaatttggcagtggtatgaagaaccttgctgctatggtctggaagtaaaggctcaagatttccgtaggtctaaaggcttgtggaatagtcctcatcagttcaccacctactttgtgccatatctatctgcggttcaattatttgggcaagctaagagagctagcactggaagagttgataaggaagcagctggtatggatgtcacatctaaaacatctccatgtccgagctctctcccaatcttaacgaaacttctgccacagcaattgcgtgaaacaattagctcatctgatttgtatactaaaggtgatcagcagtttggaaatggagagctcatatttgaattttttgaatctgaacaaccattttggcgacgacagttgtttgacaagtaagtacataatcaagacctctgagaatctgggctttcgttctatcatatgttgtcagactgtactagaaacgaatcagaacaaatggttgataaaaatttgctctgtaaaaattgaaacgcttcaatgtttgtgagtaataatgagggcattgtacatctgcaggtaccaaatgttgtgcatatagttcgagtatgcatgatgtcttacgctgatatcattttattattcttgcactcttccctaagagtcactattgattttgaacatttcattactgcacacttagactcttgttaggatatttacttgtaagatgttcttattgaagtatattaaatgtgaatagggtaaaggagctgattagtggtgtgaagccatcaagctgccaaatatcaggagacccaaagaatttggagctcagcctgtgtgatctccatcctgcctcctggtgcgttgtatgctcaagtattactttcccgttgccgtctatcaaccttttttggatgtagacgcacagaaaaactaattgtgatcgcttgcttaaagaagagtactgtgttgaatttcaggtattgtgttgcatggtatcccatataccgtatacctgacggtaaatttcaggcagcattcttaacataccattcacttgggcactggattgttcagggcgcatcagagcaagctgatgacagtcgtgttgttttgccagtcacaggtcttgagtcttacaatgacaaggtactaaatgactgctactccatgaatcctgaaacatacatgcaggttgactgaagatggcttaatcttggtgatgcaaagaccccaagcaaggcttaaaagaattcttatacttgtaatgcaatgcaatgcagggggagtggtggtttgaggtgggcagatgcagtggtgaagaagatgcagcagagtcgagagaagaagagtcagtgtggagggaagcatccgaggtagtgaaagagagagtgcggacgctgaaggaagctgcaacggtgatgtccagggcaaaggtggtgatgtccaacagatcaaacagacatccagaccatgacttcttcttgtcccggcaactctatcaggagccaaggaagaaccactaaccagctgcatgcctgcctgtacatacatacttactactagtgtgtcttagtgccgtaacaactctcattaattactgtgtctgtctaagttgtgtgtacatatgtagtagtatgcaattagcgttgtaacataaggaaggaaaagccttcgttctcttcttgtacgtaggctgagaaagcaagtttgatgtgagcatcttcatcgtcaatgacaagaagaaaagaaatagaagagaatcatgatatgtttgttttattcctggtgctggagattgaagaaagtagaaaggcatctattatatagagcagtcctatgtagtagctaagctagtagtgacagccagagagatgtagggattgaacatcaagatgcatggaacacatacgtacacatactaccaagtacattgtactctgatctctctgagagcaatagcagcagctaataggaaggaaggaatcatgggcacttgagcttgccgttgtgtggattaaccatggtgtcgtagcaagggcagaggtggcgggtgtcctgcccacttcccgggggaacgcagttgcatcggttgcagcagacgttgcacatcttgttgcacatctccttcttccagttgttggcgcatcgccccgagcacgtcccctggcagtctatacatttagtggtaccattttaatttattagtacaattccatcgcctttcctctcctgcctgtaatgtatcatttacatacctatctttggagcctgcaggagggatctcgccctcttcacctgcatctgctgcacctgctacatcatcatatcatatcatatatgtcgttcaaattaaggcaagaactatatatagataagtagtagtatgtttgggtttgtgttccttaccagctgtggatgggaagaagaagaagcagcagcagcagaagcatcgacatggatgaagaagaagatgagcaagaggaggaagcatggcgccattgcagttgcaggagaagggacgaagaagccattgttggtcttggacttggagccggaggaggccatggatggatctgattctgagctagcttggagtagttaggaagaagaagaagaattaacaagggacagggtttagctagagttgagaggtgctgtgtgtatatatatatatatactcctagctagcagagtgagtgaagaaggtaataagcaggaaattaaataaacaaataaataaagcgataggtgatgcatttgcagatgcagggtaggaggaagctgcctgccctggccgacatggatcttgaccactgtcccagccgcgcggaccatcaccgatcaattgcaatcttagtggtagcagcagcttaaattagtaatgcccaattgtacgtactagctagtagattaatccctagctagctatgtgctcatttacttgtcaccgttggtcatgtgtatttcaacttttactataaacaatttatttattcttaattaaagctatatgatatactatatttgtgacacaatatgcattgctaatatagtatacctatacgaagaatatataacttcataagtaaaaaggacgagcactcaacattaaaaagtatctagtgacaattacatgaaaccgcaagaaacatcagcagtagtaatagcatgaaggggtagtattaaagagtattgctatacgcacccagttgtataactagagacatgcaaccgtagatcaatcatcaaaataagagatcatattcatatgtattgtagtcgtttataatcattgatcaaattcagtcacacttgagtcgaatagttagatcgtttacataataattctcttaaagtaatcaatcaagcaggtggagagggagggaaggttgttgcatctgaatatgtacacacactatactctactctagcagacgatagagtaaaaagtgaaggaacaattaagaagaagacagcagagcacgtacgcacgcacatgcacatggacatggcattgctgagtgcctgcgcttgttgttgttgagcacatgaatgcacgcatcgctactttgatctgttgttgggttggaagatgggaaccaactatgcccgtgccaccacatcacatgccttgtctggtctctgctgctaatagactacggctctcttcttttggaggggtagcaacccctccgggaatcccttccattcacacctaaaatagagcgatgaattaacacatgattaattaaaaattagcttaaaagttttagaaaatggattacaataacttttgtatagaaactttttgcaaaaaaaaaagcacgattagcagtttgagagaagcgtgcacaataaaaacgagagaggtgaggttgggaaccttgagggaagaagacagcctatagagcctactagggtttatattgttgttttctttgggttggaaactaatatctgttagctggacagaaacacttttgatcaactttgtacgaaaaccaaccaaaaccattcgattttcacatccttatctctaacggtttcgtaaaaccggacaacttccatagcttttcgatggtatcgcagactttgatacgcaatgatctgtactaggatagttttctcaagattcactgtctccctctccttcaagaccttaaggattgtacaatcataggctactaatatattaattaacatgcggtgctagttcatgtatacccatgatatacataaatcatgcgcgtgtcaccaacacaagtaacttagggcaccatgccctttgcacaattgatcgatcacaccatcttcttttctaccttctcttcttctaactctaaaatgtcaggcatatgcgaccatcttcttttccaccttctcttctaataatccttatatcttggcttttttataaagattatatatgcacaaattaaattttgtcatgcgtactattaaattgatttacaatttgtgacgctttgaaaggatgtcttcaacttggtggatattggcaaaggaatatatcgagaacccgtggacaggagaacataggtaaaaaagcagattgagaggtcaggtgaagggaggtggcggaggggaggactgcgggtgtatggatttgttgcttgtcagccttttgatttccaaatgggactatggtgtatggagatttgttcttttaagaaaacagtgtccgactcaatcaaagcaacataaatttggaagacttctcaggaacatgtagaaaacaaatatccgatcacatcagaactgcgagggtgtgttttgcgtgggagacaaagtgacagatcactcgaggcatagaagacggacaaattaaaatttgtttggaagccagcttttattttttataataggtaaagataaaagattatggagtaatgccaaacgttattggcttcgttatatgtatgggggtatgaaaacgggccgggcctcttctctaaagtgtgaaggttggaacttggaagtcggagagctctcaatgacttgctgctcccttcctttcggtgggcagcaatggcgatggcggacctttgctttgctccaaatgcaaatgcccctcctcctaccactagcagcccccttaccccaactttcttaagcaagccccaatccctacctaaggcttgccttccttcctagcttgggttacttgagattaaggaggcatatgccactcccactctcctccgccaacgacgactccaattcatccgttagttcacttgccttgcctcctcgtacttactagtctagtactatttacttctttacttcattcataccaacagcaggaataacatcccaacactgcttccaaattgctttacctttcttcttcatattgatattggctggggagtggggaacccccttaattctttccttttcctttttttttactttcgctaaccatcatctcttgttaaacaatttcttcccaactaacataaatagtataaatttaactgcctaaacaatttccaatttcatcctgcattgtacctaaaaatggaaattgtgttccttccgatggtgccaaccaccatttgtcctgtactattatacctcaccaatcacaccgcacccgccgtaataggatactaagagccccatcggttggccaagagttgattatgggtctatttggattgctaccatgccattttttggtagagttttggcactatcaattttttggcagggcaaaattgtatttggcttgctaccaatataaagccaatatatgaattcttgtgaagattattctagattcatgccaatatgaattctagtgaagattattctagattgatgccaaatctagcatgggcattaccaataatttggttttaatccaaaccaagcacaagcacatgtactatttgaactaccaaaatattggcagggctaagctttggtagcaatccaaaatgatttattagtgactacaataatttctggcttaaaagtcattgctggaaaagaaattacattgaaaatgccctaaatttaacttcaaaaattatgttttacaacaaattttggcaacggctgattctttttagaccaaacggtgaggccttaactgtaggatcgaatcacaacaactaagccaactagaggggggggggtgaatggttggtatacccaaaaactgaaaacttttagcggaaataaaagttaccatcgaattcgatgaagatcggtctgaccgagattgatctgccggtctgaccgcacctgtgccgtcggtctgaccggtgtagatcgatcagtccgactgctgaagttgcctgcctgcgcctgtcgccgccgccggtctgaccgccgtgtgctcgccggtctgaccgccgtgtgctcgccggtctgaccgccacgatgccggcggtctgaccgctggtgcgccaccggttagaccgctgaaacccggtgaaacacaaatcaaagaactcttaaagtggataacgactttattgattctctctgtgtttacaaagtacaccaacagcactccttacaaaaatttcgactaaactcgaaaccctaactcaactctcaactcaattgctctcaaaagcgataccgggaagcctcacactccccctctatttatacccgaggtaggcagcctaaagctatgaaccaaactcatactagaagtcctaaacaccttaggaaacactctagtacaagacacaaattttacataaccaatcataccaaatttagactcctttcaaattcgactccgcatcccatacgcacacaatacctccatcgtatgccatatggaatcttcaccaaccacgtgcatcaactctagcctaagtatcccgcatgatctctgaccaccacggacgtcgtcttatccccaagtcgactcctggtccatcaccgcaaatactctcccgaggcatcgagtcacctacacatagaacaaacaaagaaaccatattccgagatcaagctatctccaacttgactcatgagtagcaaacaacagtattacatacgtatagtatccatctagaagtcaaaacaatgaaacaatcacggatatccaaacaaacaacccaaaaccgaaaccgacacagagtcggccggtcagaccgcgggctggccggtctgaccgcacgcataccgccggtctgaccggcaacccttgcccggtctgatcggtcacataaaataacagcacctgtaattcacctgtaaatccaattatctccaaaaccacttcgtaaataaattccaaatatcaaaaccaataatctccaatgccaattgttcatcacaaaataacaattaaaaacacctttgattttacattaacaacaattcttcttttctatcttagggctgtgtgcttggatcttatggtagctctttaagcctccgaggtgccacacttaattgctgcagtttctgaactgttgtcttcagtccatctaactgattttatcatatgcaattggttagttgcttatctgtcccaaacttatccggtatcctacttcttactccctccatttcttttgacaccattaactttttaagcatatatttgaccgtcttgttaaaaacttttgtaaaatatataaaactatatgtatacatataagtatatttaacaatgaatcaaatgataggaaaagaattaataattacttaattttttttaaataagatgaacggtcaaatatattttaaaattttaaaaaatcaacggtgtataatatttagaaacggagaattacaaacttatagagcatacacacttcattatcacaagcacacaacaggcgtttgtgggtatcttgactacctgtacacattgcaaactgtttttttatgtcatctgcagggctatctgaactgaaccccaaccgaaccgttatttaagaaaaagttcataacaaagacatccaattcacttaactagcaaaaaaaatggaaatagaaaccaggaaagaaccatttcgaaaatccaaatgcaaacaagacaattgaccattttgaaatgatgaaacaggtccatacgaattagagtacaaatagagccaggggaagcccagcttttatgaaatagtgggatagagtctacagataatgtgaaatagaatggtgtgtcccagaaacacacaacatgatagcatgtggcttcagaagtcttgcatacttcttatttgaggcttcccatgatgaacaactaagtgcaatcaaatgggaggcaatttaaaggctaactgatagtagtagccaagcgaagcagtagtagaattctaacagtagaacatgacattcttgacgctgtccttgagtgcaggaaggggcctgacggctccaccacctgcagcacgagtgctgcgcgatgtagacgaacctcctccacgaccactcgccattgaaccactgtccgagctatctgactccatgtagaaacgggctctgaacgccgccagatgagcatagtatgctggtggaactgcaacagcaaaattggttgttaattcagccaccacaaatctcttactcccaacatatttatttattaactaattatgcatggaaaagatttcgcagcaactgtcacttaccaatagatacggatcgtgtgcacctcgcataactgcacaacaagtgattgcaagttaagagagagagagactgttcctcgttcaagcccctgagaacaactgatcatggggtaaagaaaaacttacgtgtaacagaggttgttggtgagggtctgcaacgcatcagctgtgaagttgttttcatcccacaggacgtggtaatgagcgggacggcttgtgccctacggagagatgggagttcatcatttcaattctcaacttgtgtatattatgatgatagatggtagaatgtctctcattgttgtttaccttgattccagcatggctgcacaagaagaagtcaaactccgtaggatggcaaatcttggagtcaacaacagtacctgcaatgcaaatgaagaatcaacgacaactccataaacagcgacactagcaaacccgaagctatagccaacctgcataataacgacagaagaacaatactcaccaggcaatatgttcccactcctgtcgactgaattctgatcattgtggttgtgtgcaaataatctcgtgtggtggcgcttctgaaccacaatgaaagtcacctgcggttggtaatttgcttcgagtgatgcacaagcctgagagggagcaagacacaaagattaagagaagtcataaagtctgaaaaataggggaaagttttacctttcggattgcatcaagctcatgcaatagaacctggtaaaattgcccttcactaacaccatccctgtgaaaaggcaaaacttcagctttatacttaagtgtactgatgcggcttttctaatcaaactcaaccctaaactccatgataaaaatcaaccagaaaacaaacatggccttcagctcaagttttctgcatagggaaattaacttgttttgatttcatggctccagtgagcctcaaataataaaatgtcaagaatcatattggctcagtcaagcatcaaagactgctgagattcaacaacctactaccgccaaggatttccagtagtcagcctgaaaccgctaagtatttgaagaatcagcttggctcagacaagcttgagtggtaatttatgcaagaacatacctatagaatattatccgttgaggcttttgaccagttgatcttttgaaggatataagaagttccctgaaaatgtggacatcaccaattaatactttgtgctaaaaagaaatagaaggacacagagaggagagatgttgagtgtggcatgggcatatacctgaccattccaccgcagatgggccctctatgaggatcatgcgtgatgttatacagatcatctattaactcttgtctgtgagattgagcagaaactaaaccagcatactttgtcacttcaggccaatcttgggaggccacaacctgcagggcaacatacatttgttcgcagattttgacaagaatggtcactaaatataaagcattagcttgttcaacttacagcagcaatggatgggctgctatcttcgccagggtgaggatgggtgacatcagcaccgaatataatagtaggcctgtcagttaccaacggaatgcgtctcgacactgcatcaaccagtacagtgttccttcccccaacctataagataaaatttatgttacacaaaacctgaaggaatccatacaaagatgagtagagatatcactagaccaccacccttcacattattcttcagagcaagatttgctaggatttgtttgttcattttaaacacttgctttgtgcacaagcactgggaaaccaatccaaggtcaatttggcatatacgcttcaaatcacctgataccaacagagtcagcatttgacttgaattttgagcacaataggacataaatcaatacaagttaaccattcagagttgcaaatttatataccataaagagaaccattgttatcaggaagcagtccgataagtaaatcgagctccttgtgctgtggcccaagtatgttcattgcatcatggaacctggctttcagagctcgttccacttgatcaggacgtgcatacatagatggaagaacaggctccaaagcaaagtcctacaattgcttgtaaaacagttactactgtacacaagtaaatgtctaaatgatgtaaaattgaatgcactatatagatgcttctgtatgtcaatgggcaaatgcatctggaagcattaagggatacttgccattcctgaggcctggcacatgcgggccagttcacgacaaaatccactagcaacactctcttgcacatttcgagcaaaattgacacatatccagctcctgactctaccaccatttaccattttctggatagcgagaaatgaaaatgataaggtttgagataaaacaggaacacctatttgattaaccaaacttaagaaacaaaatataatagctaggactagagtaagcacaatcaacattgccatatgagtgtcataaagtatgtgcaatgcagacaaagttcaaaagctgtaaaaaaaactgaacataatgatttgtaaaaactagccactacttatgcattaagtattatcactaccttgttcatcatattccactgaccaactctaggcaagcaatccttctctctgccagtctcattatacttgagctgcatgaacaaataggaggattgcgaggttaaaaatgttaaaaggagtttgaagcgatgttaatcatccaatttttttatgtgccttctcatttgaccattgaagctatgcttcatccatccagaaaagggtgacaacatgataaaaatgaacttgaaaaaccattgtttctacatgaattggtttccacctacccgaggggcaggtaaaatccgtgcctcaaccaaggccagacgctcgctgatcttaatgccaaactcctttgcataaggatcttcatggtaggagttgtgattcaccatctgcatacacacaaaagaaaatgtttttttatgtaagcatgtgaacttacacgtacaatggtagagcgtcataattctatgcaaggtgtgacatacctgaattatgtcacgctccctatcgtgtgggcgctgacatgtctcctctaaaagagcccttatctgattctggttcagtctcttggagtacctctgtccttccactattttgcagacctgaataagcataaaagttaagtatgcacccccccccttccaaaaaaaaaatagaattgaaaattttggcaggacaagttaaacaaggaaacagaacaatatcatagagctttgctagctaacctccattggtaggtaatttggacgctgctgattgccaacttgcagacaaggaagataggtatgctggatcgcaaatccatatgtctcttgaaaatattgtacaacagatttcactgtgcctccttgatcaacaggaaaactgtggcaaaatgaacattaatttcaggaagacaataatagtggcataggattgccatctactagtgacttaaaaggcaaatagcatttgttatgaacaaaaagagagagagatcaatacgtcagttcccgagttgcctgagatgtcaaaccagatatccgatacttccggcgcatgttgccacggtgagtaactcctaccttcactcctcttaaggccttcttgatctagggtgttgcataataacataaaattcgttatttaattagttgacaaaaatgatatacaaataagctagacatatgattcaaaaacataagacaaaacaaagccgttgaaactaaagattaatcattgggaacagatgcaataattatctgtatatcttctgtattacaacaaatatactgagttcatttgaggaatagctcttccaatgaaataaaaggtaaagatgagtaaaacaggatcaccagcataccttgacacgctcagcatctgataagggcctcgagcggatgtcagtatttaaaagctgtatgacaaaatctatgactggtaacggctcaaagaaagcagttgccgacatatctgaaaaggcaggaaaagaaaagaagatataaattgagggcaaaatgttcaaaaagtaagagtactaatatacaaaggcatctctgtttaaagttcaagattgatatttatgagttaacatgtaaattttatgtacatgagatccttcatgacatgatcataagcctggggaaaaaaatcaaagctaagtttttcaaattcagaaatgtgcagcaaacatggcattggtgataggataaaaaaaattggacagaccagttggcctcagcctgatgttttaaggcaaaggatttatgaaaaccaggctactttattgctggttccatgagtcttcaatgttttttttttgactggggtcttcaatgtattattacatacaaacataaatgcacatatgcacaagatcatacccatattcatgattcatgagaaagatcatgcgacagaaacagagagagttttaccaatattcagtgacaagcccatttgagtaggacgaatgctctgataaaacccacgccaggtttctagtccctcaccgagggatcgtctcctccccaggtcaggagagaagaaggatcgaccaaagggtgcatatctgtaagaaaaatgggattggaaggatgactcaatagtttggattgattctcctattatctgaatatacattctacgtaatgtttcaaagaaatctaccttgctgttggcaactctcgcaagacaatatcaagaacttgcaaggcctcctggggagcctctgcctgccttccagctagaaattgctcaagacggtgaagatcagctcttgcagcaaacttaatcaccacgttatatgttttctgacgcctagatcatagaaagaagagtcagaatatacaagatgatttgccctggtactagaatatcatggtgatcaaaaaaggaataggggcacacctctccgaaccagaaccatcatcttcctcaagcaaagagatgcgaaattcttttgaagtaaacggcaatggaccggccgtgtaaaggctcttcctaccatcataggctggaagacgtcctcccaagtatgacatcttgtgcagtctcaccaactcttccatcacagcacggctccgaattcgtgatgtaagctccggggtgattgaaacctgtcaaagatgaaccacaaggtggcaaataaaaactgagagattgaaaaacatgtaggaggagcaaggaggaatgtggcatggaaaaacaaacgcacgtcatactgatgaagatccttgtctggcagttgagcaaagaagtgattcgccttcactaaacatctggttccaatactcccacttccagggcggtgaggaaatttaaatgatttggtggacacaggaacatgttggacaatctcttcctggctctcacttaattggtactgcacagacaagtcctgaagctgctctgtgacctcaagagcaagagaccgtggtgatgatgcctccggagaggctgcttctggtgaggagacattggcaggaggctcatgtggagcatccattgcttggagcagctcgggagctatggcagacggaccataatagtgctgtggtctcacactgctgttgtagggctgttgatggcccaaatgctcagcagcagcagtagcaggacgccattgctgcaccaccattgcgccgcgaggttgaggagcagcaccatggtagtagcctgctcctccacggacaccatgtccttgtgggtggtattgctgtgcctgtgggtagtagctgccacggccacggccacctcctcctctcccaccaccacgaggctcacagtcctcaccaaacccaggcagtcttggtctccttgatcccattcagtcgaccaactcaatcaactgccacaaaggagagttaagttgacttcttaccataatccagacaacttcatattcacaaaatctatacagctgcagtccagacattatacaggttgttggtaaattacaaaggcaagctaacgaggtcaatatcaaatactacttgtttattactccagtgtttaggttcaacacggtgttgtttgtaagaatatataccatctatctagacttagctcggatagcatcggagaatatatatgcttcggacgcacggagcatgaactaattaatcaggaatagaaacaatttacagaggaactaacaggatggtaaaggtaaacaaattaaaacaggagttgaagaagtggagaacacgacagtaggctcaccataaagcacacacccaccaaatggcttaaaaccagagagagaaagaagcaaacctaacaaactgatcgagctttttttaagatcaaacaagagagttctgcatattgaactagccaaattaaacactcaagtacattcagttttaccaatggctcaaacatgtgaagagatcgaagaacactgttatgttgggaaaatagagtatataagaaaagtaagaaccagataaggcagggcttttaaacgccgaagatcacgtctttcatagaaaaaacaataaaaatgtggaacatttccgcatatcaatgcgttttaccactagggtattagcagggatagaacaagggagcgtatcccatgcacataggcactcgcgtatacacaccgtgtacaccaactaaaaattatcataaaaaattctagaaaaattcattcatgtacttttaatagtattacatctacgtgcaaaattgcatcttcaaattcattctacatagagaataacaaaaaagataaaattctgacaaaattgcaaccttaaaactgtcagattttttgttacggctaaaatataatgaatttgatgttaagattttaaccctaggtgtaatacaattgaaagtatgtgtatgattttttctagattttttggtgacattttttagttgatgtgcacgtgtctacacgtgaggtcctgtgtgcatagatatgtttatgttgccatagaataaaggataacggaagaacaggaacatcctgaaaactgaacactgcgcatagaagggaaaggcccaaccttttcccaacaaaacaactcacaaaccgggatatttttaggtagtctcacagacgtcgattaaaaagaaaaatcgcagcatgtaagtaaagaaagatagcatcaactcaaaagaagaaagcaaagaaagaagaaaataaacagaaagaggcgcatttcatatgcaagtcggtgttgcaaatcaactcgaacacattacattgttggacgataagcaaacagaaagggagaagcgaaggaatcagtaatcaaagcacaagaaactcgagatatttttcttgtttgaaagtaagggaagtcgagaaagaagttgcaggatagcgggaaaccaactgaaggaaagaaatgaagaaagagaaaacagatcgaagcatcttggatggtaggagggaggagctaagaactggcgatcaccttgggcagacggagagattcagctcacatccagacgaacctcgctgggcggaagatgaagaagagtgggagggtgatgtactagtactagtagaaggagatgagggaaaacgccaagaagaagaagaagaagagaggagagagctttacgctcccactaccagtaatgcagtgctcctgtttctactctctgccctgcttacctctgcttctaccactatctaatatactaccactcctacttaacaagattatttacagtagtaatttcatttctggttggttgcctgcttgctgagatattttatgttaatatatgcatacagtattgacataaaatatctgcatagggcgagtttagattggggtgtaaagttttatcgtgtcacgtcgggtattatatagggtgtcgtatgaggtgttcagacactaatataaaaactaattacagaatccattagtaaaccgcgagacgaatttattaaacctaattaatccgttattacaacatgtttactatagcaacacattatcaaatcatggagcaattagacttaaaagattcgtcttgcaaattagtcacaaactgtacagatagttattttttaatatgtatttaatacttcatcgaggtgtttaaacgttcaatgtgacagggtgtaaaattttatggtgggatataaacacacatagatgtttagactgacaatattatgctttgtaacccaatcagagtcagcatgcttaggcactaataaaaaaataaattacaaattccgcatgtatactgcgaatcaaatttattaagtctaattaattcgtcattagtaaatgtttactgtagcaccacattatcaaatcattaagtaattaggcttaaaagattcgtttcctaatttatactcaatctatgtaattagctttttatctatatttaatattttatacatgtatcaaacataggatggtaactaaactggaccttggttgtgtgtccatggccatgctgcctgggatacaactataactactcccagccatttcatttcaggcaaagcttttgattttagtggtctgtacggtaatacttctagtacaagagaaaagaggataggtttgcttaaccccgaaggccgagtgaggaattattaaagccaacaacaacacaacagtgcagtttacaacagtacgagtggtccacagtggagtactacgctctatatagtgagcagtgggccctttcgagtaggacccacacaagatctctcttcttcaatacttcaacacaagtagaagtatactcgtagtagtagtaattttttaagggcatgtttaagatctgtaatttttttcaccctatcacatcggaaatttaaacacctacataaagtattaaatataggataaaaaataactaattgtaattgatttgtgggacgaatcttttaaacctaattgctacatgatttgacaatgttgcgctgcattgcagtttacaggcggaatctataatttattttgttattagggggtgtttggatccagggactaaactttagtccctatcacatcggatgtttgacactaatttgaagtattaaacatagactacttacaaaactaattgaataaatgagagctaatatgtgagacgatttttttaagcctaattaatccataggctaatcatggattaattaagctcaatagaatcgtctcgcgaattagtccagggttatagaatgggttttgttattagtccacgtttaatacttctaattagtgtctaacatccgatatgatagggactaaatatttctagccccatccaaccagccccttaaactacgttaaatacttcaaatacatgtccgtatatccgatgtgacacgacaaaaaaaaatttaagctctgaatctaaacacagcttgagtgatcgagtgctaaggtttttactgcctcacaattaatgatggatgtgatgatcatcttcattagtattatgcgccagtatcacaattaactcatccggattcaggaggaggggaacgatcattttgataagcggggctttggctttggctttggctttgcaagtgataagtgagccaaacaattgcagtaagcaatggcatccatccatcagcttggcattggcactttggcagtggcagtggcaggaaacacatgcatgataggaggatcgtcctttgttttgcttttgtacgataggaggatcttttcggtttcaaggcatccatcatccaatcctttggcatttaaaccctacgacgattctcagtactattccttttcaactttagtgtacaactttttttttcttctcctctgaccaatcgaccctccttccttccttccctccttccctcccaactcgctattaataatagaacaagtttgttattgcagaacaagaaagctatcgatacatgattaatagagtacagcatttgcattacgtagggtaggattggattgtactaccagataaatgtcctgctaattgtgctcatactgctattaattagagtaccggatcgatcactcctttcaagcgaggagtgatcagcataggcatagcagcatggattccagtaaagtttgctttgctcactgatcatgaattggcttgggcggctataaagttagttaggcggcgtcaccagtgcactaatacgatcaatatgaatatgaaaaatgctagaatgatttatactgtaaatcggagggagtagtatatacacttctgcaccatgttttagtatttagtactactagtatatactccaagaaattgtatcagtacacgtacgttactactttatcttgcatgacgtcaggatcgagatcaaaactacgcgctcggcgccgtgcggcaaatcaaacttgaaagcttgttggatggatcattgcacattttagtaagttagttggagcagcttttgttttcactttaaagtaaaacgttgtctagttggtgcttggatgaatggatcttcatgtttcagacatgtcatttgttactcatgcattatcttaatccatctaaacctttatcttaagcaaaccaaccaagcaccggtacttcatggtatggcaaagctggcagcatattagttctgtccaaatttttatttctaacttaattttagagttgtttttttttctcatcatactctactttccagcattagcttttaatgtaggttggagaaagacccagggatttgttatgcccacaaacttgaaacaaaattaggaaaaaaaatccactttaactctcttaaatataggccagatcttaccctactaaaatcagatataatgactcttttaactattaaaagtaataaaaatgacttctaaaataatattaaggggatattggttaacattgccgtcagtccaatcatcataggaattgaaaaatagagagggggcatatgccatcccacctctctctctctactttcttccctatcccctcctctctagggatgcaaacgggtttgtccgcgaatccgtttataggtaaaattagtgggtaacccacgggtttaactcactagggttacaagcgggcttatcagcaaatccgcttataggcaaaattagtgggtaacccgcgggtttgactcactggttacctattaacttaacctataaatgagttcataaattgacccacttgcatctctagatgcgataaaccggatcacgacacaaaaatccattagttatcatctatttaacctataagtaaattcgtgtatcggtcctgcttgcatccctcctctcttccccaatatttcctcaacatcgtagcagtgcaatgcacataccagcgacggaagcagcagcatagaatgctctcgtggcctgataggcgatagtggaggcaatccaaactgctgcctccaagcatcattcactcattcctcatcacacgagagtcatcgtcctggtcagtagcgctcgatctccatgccctgctccacggatcctcctcctagccgcaagcatccttcttcaccttcgatggcgtccttcgttcctcttccttgcaactgtcggactgtccttcgaaacggtatatttagcgtcgcaacctttctggaggcgtcattcttttttagtgtctctgctttgtagtgtcgttgtacttgtaggctcagcgatgatcggttcggtacttgactcctttctcagtagtatgtgtttgtgtggttggtggtctgtcaagcttttcggattgtgcactatagtgcatgtttctcgacaaccaactatcaataaaaacatacttgtaacttttttcttctatcttaatatcatttggatgacctttcttcggtcatccgaaaacaaaccacaacagcatacgtcaatgagaaacatggcccttttctagttttcaactgccccagcagctagatcctcatatgtccggttcccttttttactcctagggactgtatttttctcccgctatatttaatggataggcatagtctcgtgttgttttcctttaaaatttttttggcattgatctgatgtggggataatcatcgatttttgggccacgtttgtggctttgtgcatagatcgtgaaacacagctgcccatgggcctacttgggctgcatttgaaaccatatccatgcaattcttcttctgactttggtgactcgttcgctatgaactgcggagccaagtccgtatcttatttgtttacactttactagaaaaggtatctatgcgttacaaaacattaaataactctaaaaatacattttgtttcataatctatgctcgtgcgttgaaacgagaaaaactaaagtacatcagacattaaataactttaaaacgattttttaaggaaaaaatacgaattaccccccaaaccatcgtggtcgaccgagttaccccctaaaccataaaaccgaacattcttcacccccaactatgcaaaccggataattaccccccccccccccgcctcaatccgcgatggtttaatcttatgtggcagtccagtcagcaaatcttttaataaaaaaatcggtgggcccacctgtcagttccccacccctctctacctctctctctcttctccctccctcaccggatctcaccggcacgggctacggtgtaacaccctgaaaattcgaccgacaaaatcaaaactctaaaaatacggattttcaaaaactttttaaactaattacatcatgccgatcttattggtctatttaatcgggatttgatctcgaagattattaatcgtgagtaaagaatagttaattaggaataaactttaaaaacaaattggtaaaataaatccaaattaaaataaagattaggtggggatagaaataaataaaatgttatcgcgaccatatttggatcaattaaatttaaatacgatggaataagaattaacctctaattaaaactcaaataaattatataaaaataaaatatgagtaatattaatctagggtgaattcattagttaagataacacaaatattgagtaaaatgcatatatgcaaaattaggaattgtggaatcaaatttatatggaaaatacactaaaatcgggttaattagaaaacagcactattcattgccccctaggtgttagatcgcgttccctagccctagccccttctctgcggcgttgccctcgcgccccgctcgccgtgcgccgct

SEQ ID NO: 69417 - DNA, 569 bp, Oryza sativa
atctcgctaatctccgtggctgtcagcatcctaaacactgcaaaaacagaacgtaacaaaggtcgacatggacaatttcttttagtttcttttgttactcggttagcacttacgtacggttagtcgtccaccccctcctggacggaaacacgtccatgtccagctaacgtcgacgtctctattgcagatttgtaggtctaaccctcctgcttaactaaccaagcgccgtaacgaaaaccggcgagcttcttcctccaccgccgccggcctctgcaccggcggcgacgagccggagagagccagcgtctctcataaaaggagattaaaagttactacctccgttttaaattataagactttttaacattgctcacattcatataaatgttaataaatatctggattcattgacatatataaatgctagaaagttttataatataaaacggaggaagtactatataagacaacgatagtagcagctttaggttcgcgaatatttatatcaaaatctatggagaatttggcttctctagctatcctgttggatagattcgaggccgacttca

SEQ ID NO: 69418 - DNA, 740 bp, Oryza sativa
  unsure (1)..(740): unsure at all n locations
cgtgtcncatganatgcaacncagcttcgnacccataattaagnttgaaaatttaaaatttagcttttttttctgcttaatgggcaatccgatgggagccttaattaccccgactagacccctattaaggatccaaagaacttttaccaataaaggagctcgagcaccagccgctggtgtcaccattctcctcttgcaatttcaccaccaccgccacggcctctgcctctcgctctctctctctaggcggcgcaaatggcagcctgcgtcgataagtggccggcggcgtacccgtgccgcctgccggataagttctactgcgccttgccggactgcaccaccacggaccgtccggtggcgccggcgccggcggctagcgggagcagcggcgactacgtgtgggacgcgctgcgcgccgaggcgcaggacgacgcggacgacgagccgctcctccgcaagttctaccacgacctcgttctgtcgcggacgtcgctggagtccgcgctcggctcgctgttggcggccaagctttgcatccccggcgcgctggcggaggaccagctacgggaccttctcggtggcgcgactcgcaggcaaccccgtatgtccggcacggcgtgcgcaaccgaccttgctgagattatacacagcatccggcgctgaccaaatacggctacgtggtttctgtgctcaacgggttaaactgcttgaattacccatgacggagaacaccttttttt

SEQ ID NO: 69419 - DNA, 24638 bp, Oryza sativa
agggttggttcgaaccactatgtgtatccttcattgggaaaaagctctcaaaaaaggtaccatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccatttatttcacaaagatctgaatgtaggagttctagtggtgccaagtttctctcctcggcagccttgtgaggcttgcgagattgctttgattgcacacaactatggcacttaaaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaattagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattagaacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggagctagttttgcaataatgcacccggccacaaatttgtcgggtaagacacacttaaggagttcgagttccttagccatggtttgtatctcatgagcctgttcgactacagaacggttgttagccattttgtagtcatgaaactgctccatgatatacagatcattgctagcatcagtagcaccgaatttagtattcagtgcatcccacaactccttagcgtcggtcatatgcatatacacctggaccagacgatcgccaagaacgctaagaatgcatcccacaaagagagtagtggcttcctcgaattgcttctgctgttcagcagtaagaactccttcaggtttgccagtactcacccagaagcatttcatagctatcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgatattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaaacgcttcccaaaaaccttattgccgccttctcccggtgcagaacgtcgaaggcagaggttccggagacctactctcccgatcgccggtgcacgccggcgagcgggatggagtagtctatgagcgacggtgcagtacagagtaggaggcaaaccctagattgattttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgccgcctgccctgcccggcccggcccggccaggcgaggtgagcgagcgcgcgcgtatgtttcccctcttctctccaccacacatgcttcaagcgactaggagggcatcctcccttttaaggaggtccccctctcctagaataagcaaggcggtactaaactccacatgcatgccatcccatgaggtgggcttttgtgattttccaaagaattaatcttcgagtgggctaaggcccattcattaattccaacataaaatgttggattactctgtaaattaaaaaaaatgtgtggattgaagcgaaaaattttaagagttgacatgaaaaatggaattcacccctagagtcacttcgcatcatgggataaatagattagagaaatatgatcttgtcctatgtgtcactctgataccctcttcgagttcccttagaccattcctagtggagttttattttgtggttttcaagggtgccatataatctaaattttcgtggtttcatattctactaactaggaaggtggcccgcgcgtatgcgcgggcacttatattattgaaaggtaagactattgtttgttcagaaattttgtctcatagattaagggcaaactaaagtttagataatgttattttataataatttaagggttctatttttcttaacgtatcttaaaaaactattcacaaacttttgagaaggagatggattaagtacttacgatttttgaatcatgtttcttttttctcgagtaaagaaaaaactattgctagttaattatcatatagtccatctatatgcgtaccgtgtagtatgaccgcaaatgaaaaatgcgagtgcaagatactcaaaattctttgattaaattgtctcatgaaggtgcatgatatagtaataaagagagggaagcatatgcatgggaaaaaaaaagaagaaggagaaaaaatgaaaaaagggaggggaaacatacgtacccatgcaggtaggtgcgtacctatgtcgtgggaggagaggtgggacctcgtagtatttagtttgttctaagatcaatttaatctaacggtttataatattggacctagcgatttaagtgaaaaatcaagaaatagatactttgtttttttcttagaatttctaatatttgccctaatttattagagcaccacgtcgcagcttgagagcattttaaggaattttaaatgacttaacacatgtaattagaatattaactgtgcaatatatatgtatgggacatatggtaatatttgttctagcttcgtccatgtttatatacatatagagtgaaattaattttgtggcttgcaagccattagatgtctaattaatagcaattatgacacctatttacaattgttcagagtaactcttacatattcatgttgcgactttaataatttatcaccatgactcgcatgaaaaaaaatgtagtacttaaggtttaggatagctgaaattgatgaattatataatttatgtgatattattttgagggtataaacgaatgaattgacttctaaaaagttagaatgttgttaatttaaagaatacactatttagaaacttggaaagcgtgcaaacaaaaatccaaaatataaaatcgggaaaaaaaagagagggccttaaactccttttatcacccttatcgtagtaagagttctattaatattcgtcaatattgcgctcacatttataacataataattcctttcacctatacgaacaaatagtacaaaatccaaatacgacataacatagatacattataattattatgtaatcaactctcggtttcaacttaaacagagctaattagtgttgagaaaaacacaatccattgtgcttaattattctctcgtgcatcacacatttaattttctttttatgttattaacaaaattaatcatctctatatatgatttgatttgtggcaaagtggtagctctacagcggttgtgatcaccttatatgtctcagacactacactttgtcacacgtgcgaaaggcaaaggtgcagacgtgtattatgcagcgggcaaaaagaaaatttcggacgctttatttattagcaaacaatagatccgatgattataataataagtccaccagttctagtgtaagttaaattagttaatatagattttaaattgttaatttaatgggtacgcaatataatggtgtagatcttattttgaaacagtgcattacttgagaataatataccaatgtaataaaaagtagatccgatgatttatataatggggccatcagtttaaacgcatgtataaattagttaatatagatattgtttatttaataggtacatatcaatataattgtgtaaaatttattttaaaatagtgcattatttgaaagaaagattctttgttatatgatggtagattctttgttttgtaaaattatgattatttaaaaaatatatccattatatatatataaatggaaaaaggaaaaaaaggaaaaaaaaggaaaagaaaggaagaatacatacatgtacgtacgtatatactccacctgccaacgcgcgggaggaggataggtgggacccatggtatttagtttattttaagatcaattttatctaacggtgtataatattggacttacaaatttaagtgaaaattaaggggtagatgatttgttttatcttagaatttcgaggattttctctattttattagagcaccacttggcggcttgagagcgtttaatagggtcagaatataaatgtgtaaaatttatttttaaatagtgcattattagaaaggaagtttctttgttatatgatggtagattctttgttttgtaaaattatgattatttaaaagaaatatatccattatatatatatatgcgtatatatatgcgtatgtgtgtgtgtgtatatatatatgtatatatatatgtgtgtgtgtgtgtatatatgtatatatgtatatgtatgtatgtatgtgtgtgtgtatatatatatatatgtatatatatatatatatatgtatatatatatatatgtatatatatacatatatatatatatacatatatatatatatatgtatgtatgtatgtatgtatgtatgtatgtatgtatgtatgtatgtatgtatgtatgtatatatatatacacacatatatacatatacatacacacatacatatatatatatatatacatacatacatacatatatatatatatatacatatatttatatatatacatacacacatatatatatatatatatatatttatgcaaatgaacaatttaccttaattctacccctagtagctagagatcactgcaacagttgtcaaaatcaatgtttccattggccaatgcaagttgagcttgcaacttatgcagcgccccatgttatgaattgatcgtaaaaacaacctagtacatccatctgacgacatctactctttctgttccaaaatataagaatgtaggactgggtgggacgtttcatatagtataacgtatctggacagccctccgttccaaaatataagaacctagaaccggatgaaatgtttcttagtataacgcatctggacagacggacatatacattgtactgtgaacaattccatccggttctaagttcttatattttagggcggagggagtacatctgtttttaaatatcaaaatcatcaataattttcatcaaaaaaaccataaatcattagtagacgaaataaattatgatttaataaataaaaatagtgttagtatattttttgtgaaaacacttttatattgctatacttttatattttttttataaatatatataagttaaaaatgtaatgatcagatatttacattccacgttatgtcaatgtctaaaacgacatgtaaaaataaaaactaatgtagtagtactatttttacatctcattgtcatgctttgagatgcatgcttactaagctgaagtccttagtctctatatattaggggtttcaacgtcatttactccgtcatggataagatggaaaagtagccatattatatcgatcttagctaaaaaggccaatacctactcccattcttttcaagaatttgttgaatctggactaatcgctgaaagagtgaaagtcacccgaaagcacagttaattcaaaggcacggaacatagaattcattcatcaccacatattaaggaaccagcagacggactgactcaggacgatatgtgcaaaacaagaagaaagacttgaccaacagcaacatcaaatggtgatatggtaggtaggcactcgtagacttattactctcgccggttaatacagtaaccaaacggacggtacaaatcacactttggcgcaatccgccggagcgaaggagaaaatcccgccgtcgagatcgtagagcaggtgcatgtccatctgcatcacgttgcctatgacagacatcggctggtcacccttcgccggcagcatcatcaagcacgctacggtcacactgccctgcgagtccgtctcaactccggcgaagtaagttggcacggcgtactcagctccgccatcgaagcgcagcaccagactcggcacggttatgccgccgccgccgccgccggtactcttgaagcacaggtccaagccgcgcgtgccgttcaccgtggtcacgtcagccgtctgggacaggaaggcctgcttcaccatctcgtagccgtctttggcgaggtacgtgagcgtggtgccggagtccacgatcgtgccgccgccgaggccgttctgcgtgaagccgaacgtgctggtcgtcaccgggaggtccgtctcaccgacggtgatgccggtgaggttgacgtagtagtacgaggggtgtaccgcggggttgttgacgaacggcgtcgactggacatttccgtccgtaagattggccagggagccgaacagtatcgggctggcgccggcggcagagccggagcggaggcagtacgagaaccggccgacgccgagctgcggtatgagggacagcgcgccgcggccaagacccgcgatgcccgacgtcgagttgcccacgccgttctccgtgctgcacccgaacgcgacgctggggaaagaggcgtccccgactttgagcgtctcggtggcgaggtagcccgcggtgtagccgctgccgtacttgtagttgtagacgcagccggtggcgttgcacgtgcggatggagttgggtaggaactggcagaaggagctggtgcacgggagcttggagaaggtggaggagctcgccggctggaatggcggcgcaggctgctggaagcatttggtgcacggcgcgcactgcgtccagatgaggtcactgccggtgtcggccacgaccgagaaggtgagtagcggcgtgccgacggagatgttcatgttgtaccctcccacgccgttctcaagcagtgcctggaaactgaccgacgagttggtggtggtggccttgccggctgcggtggcgtcggagagaaaagcgatgcggtggctgtcgcggcgtaccgcttccgagtatttgccgggggagagctcgtggatgcgagtaagagtggcgcggaagccatgaagatcgccggcgagagttatcggcgggaggaggatgatgacgagggctagtatggcagcagtgctggatgacatgtttcctgtgtccctccttgtcgtctttttcgtggtgttggtttgatgaaggttactcgatcttatatacactattcaacaactcatagttgatccaagttgcatttgaaatttcccttaaactgctattagaaaccgcgtgctaataattcaaccaaccgttagtttgtgtcaaatctaataacttattaaaggaataaaaaaaagcatccacgttcgctctcacggcctagaaattctcatattaatcggagaaaaagaaaaataaagtccatatagaaatacaatttagaaatagttaaaattcagaattaaaaaataagtaatattagaagaggagactagagtccatatattaatataatttagaaataactaaaattcgaaattaaaaattaaataacattagaagcagagtatagagtccttatagaaatacaattaagaaattaagaaattatagaaattcggaattaaaaataaggaatattagaagtagagtatagagtatatataggaatttaaaactaacgaaaattcggaataaatataataaaattaaaagtagagtttagagtccgtataaaaatacaatttacaaataactaaaattagaaattaaaaaaaacatgggaagaagagtctaaagacaatataggaattcaatttagaagtaactgaaattcaaaattaaaattaaagaatattgaaagatgagtttaaagtccattagaaataataaaaattcagaattaaaaataaataatattaaaagaagagcctagagtctacagataacgaaaattagaaattaaaaaataagaaacattcaaagacgagtccagagtccatattggaatataatttagaaataactaaaatttgatattaaaaataattaataactaacacatgtataaaatacaatatgaatattacacacttgtagtttgtaaagttggttcaaaatttaaaattatgctgtcattttaatatattttaataataaattgagaaaacatatatgttattatatgagaaaaaaatataatgatgctagccgcgaaatctacgcgggccaccaagctagtatatgtaaaaataaaagtaaaacttaaagttatactaatacgtattacaactgaaaataaaagaaaagttggtgaagtgctagagatgtgtcatgactctacgtctccatccactattttttctttcgaaaccacttatgttcaaataaatcttgatggatatggttttcatctcttgaggagatgccccattgtcatttgcattgtcatctaaatagttataacaaaactgaaaaaaattaacaatatagattaatataaaatatatcactccacaaacatgcaagccaaattcaacttctataagttgtaacaaaaagaacaaaataaactgaaaatagttattgtacattcgtagctatatttattattttttgttacaacttgtaaaagttaaattttaacttgcatgcctgtggagtgatatatttcatattatttttgcgacaacttgtaacatttgaattttaacttgcatgtttgtggagtgatatatttcatattatttttgcgacaacttgtaacatttgaattttaacttgcatgtttgtggagtgatatatttcatattaatctatcttaccaatttttttcaaagttttcagtgactatttaggtggcaagcacaaaatgaggggatatttcatcgagggatgaaatcactttcccaatctttgatacattagagtaaagtacacagccggtccttaaagttggagcgtgctgtcacttaggtccatgatcttggaaaatcgatattagggtccgtgatcttgtttaagtgaatcattgtggtccaaatacgtctaactgggttaactaccttacgtggcggtccagcgtggcaacatatttgcagtttggcccctgcattattttgcttccccctcgtctgatccagcctctacttagcatggcgcgcaacgatgtggccgatggcaccgacgaacgcgcggcgcggagcgtgcggtcaatcttggattaattcaaggaccgcgttgcgccggatgccaacgacatgaggtgagtgctctaccgggtaagggtcggtggctggttggattgctccgaggagattgcgttcttggagagcgaactgtgtgcacagctggacggcgtgacgagaacagcaatgacgttctcgtcatgaacagcttaatagtgtttttgtgtactgccgcgtcacgttgttcgatgacattcaccgactgagatgacgacgacgcggccaagtgggcaaagaggcccggctgcgagaggatggccacggcgctcgatggctgctcggctatcctcgccagcagcgcgatgctttctccggccaggtcgtcgcggtcggtggagagcaaggtggcgagggctgacacagtgcccgcggcgatggccctgccctggttggctgctctctggagcagctcgtacaggctgaccatggtgttcttctggtcgcggtacacgccgtctaggatgagctggaccagtgttgggatcacctccgggatgcatccgggttgttcgacgagaggtagaagaggatggccgctacgttatgctgcgccacggccttggcaacgacgttgatcacgtcgacaacgaggccgacgcctccgacctccatgatggtcatctgcccggcggggtgcttcaagaggttgagcagcgacgccacggcattatcctgtatggcggcggtggtggaggagaggaagcatagcagccaaggcacggccttgtcgtccacgaggcacgcccaacagaacacgttgtgcttcgacaacttccgtgcctccgatgtcaccttcctccactcctccgtcgaccccctggagagctgcgcgacgttgtactcgacggcgagcgtgcggcggccgtgccgaacgacacggtcgtgatcgcaacggcgccttggcagtagccaccgtgggtagagaagaagatttggggaagaagggggtaggatacgcgaggaaagtaaaatgcggggggccaaaatgcaaatatgttgccaagttggaccgccacgcaaggcaatcaacccggtcagatgtgttttggaccgtaatgatacactacaacaaaacatgtgtttagagatatcttatttatagtctagagacattttgaaccgtctttaggcatacatagagtcacttctgcaaagcgtcccagaagcgtctccgttaggaccgtctcaaaattataaagacgctccatatagcatctctacaagatctgagacatgaaatagcgtccctacgttagttgagacgcttttgtaaatgagatccaataacgtgtctcatggtgcgtccttatgagtaactgagacgtgtacatacgattcattgtaggatgccatgcttggcatatttacagcattcacatctgagcagtatatatcgccatcaacatatataccaaaatgacagtaaacagtaaaacactccaatagatgaaaggtaattatattaaggacaattgtgattcacaagtcagctaaacagccatacagaaaaaagagatttgcgtcatctcttagaaaaataaatttataactcttcctaagataattcttgttttatctcctcccttcttcacagcatgataaaatatatctataactgttcttaagataattcttgctttatctcctcctccttcacagcatgatgtagcaatcctttacaatcttcagtatcttctaaaatgaattgtgtaaaccaaatcagtgtacatgataagatttctaaaaaatgtaagaaagctagctaagtttactaggccataaacagagaattagacaatctatacatgtattgattcatagaagatacacccatcacatatttcataattgtcaggagcttattcctagcattgtttactagcttcagtaaagatttattgaaatcgacccttaataaagtaaaacaaaataaagcacttcaatttgtatatttctgaacaaagagactatagccatactacagtattaacatgagaatattctcctacagatatccaacaatttaccttaatagctacttgttctatactttttatgtggctagaatttctcatcatcactataagtaacaggtaaaaacttatgatggccatacctttgacactttagcagttgctctccctcctgcatgtaaatactttggaaacttcagcatatagaaagcaaatctcccattttggaccagcatctctattcctttactcatatgccaccgaaggacagtatgaagaaccatcgcatcattcagaactagtgtccgagatccaagttaaacaagcattaataccaatatttatttcaaagtgaatcgattagaagattgagttgagtcaaagcaatgcctctctgtgttttaatgtgattttgttgctaaaactacttaattaatgctgaactaaagcaggggaaagaacacagcgttatgcaatccaatactccaaataaattttttgcaagcgataccaaattaccaagtgattatccttctgaacaaagtatacaacaatcccaaagtatcatcatcagaattttttcctaaaaatctgcaaaaaaaaaaaagttaccttcaacaatactcatctgtatttttgtgccttcttgaagctaaaattccaaatgtagtcatcaaatggaatggaatcagtagcaaaaaagaatttataatgagcccttaatgatcgacatattggtattgattgatccacagaggttcacaaatcatcaaattgattatcagatctgcatcatgcaagtattggtattagcatttcgtcaaacaactagtacgatggttcatccctgaagcagaaagaacgaaaggtacagatcaatatttactcttttatacttctgcaggattacgaaataatccgatggggtagaactcaacataaagtctggacaaattgaatcacacaaacaaatcaaagcacctttgtagttccttaagccttacagattaggggatgagagagcatacctaccaagctaccaccgtggagttgtcgctgggctggtgaaggcaactgagggagggacgcgttggcgacggggagtcgctgataaggcggcaaactgccagcggtggctcctatggcgaggatcagagcaggcagtggtgggcggcggcctgaggaggaggaggcagatgtggcattgactcgccgaggatgaggcgccgctggcccccggtcgaggacgagccggcggcaggcatcgagatggcgaccggtggaagataggcggcggcaccaagcaggcagttcaatctagatgggagtttgttgcagcacgcagagaggatgaggacgtgggtggtttccaggagaaaaaaaaattcaatgtaaatcttaatttttgagaaatcaatgtaaaactagggcgttatttaaaacgtctcataaaccgtctttattggcggggtagcctagaaaatagagacgatttaagtctcgtctccagccaaatgtctttatttgttgttttgttgcagtggattcacttaaataagatcacggaccctaatatcgattttctaagatcattaacctaagtgacaccgcgctctaactttaaggaccggccgtgtactttactccttataaatactatagtttaagacaatggcgatgggacgtctgctgggattgtcagcaatactactgatgcagtagtagacactgacgtgtggacccgcacccacatgttagccgctgctactgcatcagcaatactagagaggatgtgcatccattggacgctagtgacgagagggctccaatggtccacagtgacggaggagaagagaagggaggcaggaaccgacgagctcatagtcctacggctgtggcttgtcgtcacaggcggcttgctctttttttattagagaaggaaattttttttagcctttatgtccaaccggatgtataaagccttcttaaactagtaacttaacccttaaataatctaatcttaaattaacttagcccttaacctttaggctacatgcagtttgacaagcggcttgctcttgtaagactcggagctgtcgaggagctccgacgccgcggcaggggagaaagctcggaccgtgtcccaacaagcccagagccagccacgtggaggccgagcggaagcgctggaagaagctgaaccgccagttatacgacctccgcgttcccgcatggcaagcctcctttctcgctgatgccgccgcgcacttcggcgacctccacgcccgcgtggccggctcgaggtcgacgcaagcctgaattgaaaaaaaggcttatttggctgatcagcctaagagcaagttctactaattttaaatcatctatagccaatgaaatagccaattcatacaatagttgattactatactattaatacatagtctcacatgtcatatacacattatgtcttggagtccgtgctgcagctgctggttgctcttctctctcttccttttatctctttaaaatatatttatagctggcttatagcctgctattgtatctactctaagaatactagatgaataccccgtcgcgttgctgcggtctgctctaagaatactagatgaataccccgccgcgttgctgcggaaaattaagttacataatatgtacaaataaaatataatttgattatcaaaactaaaacaatttgatacaattttaagcctaaaaaattgagattttatgttttatgagagaagaaagaaaagaccatttagactatagatctatcattcaaaagctaaaaataattgagatgatgtggcttaatgagagaaaagagaaataacattaactaaacttagtggggatgaactatataagtactgcaccatccgtcccaaaaaaagtgcagttttgcactattaacgttcaacgtttgaccattcattttatttaaaaaatttttatatctagtatttttattactattagatgataaaacatgaacagtagtttatgtgtgactaaatacttttaatttttttacaaattttttaaataaaacggacggttaaacgttgggtacggatatctacggctgcacttattttgggacggaggtagtatataggatacttaccgatgaggacccccagctccgacagcagtgcgtatactatcacccacaatgtactccctccgtactcgtaaaggaagtcgtttgggacaatgtttaagtcaaaccttgggaatataaatcatgaataactctcaagttgttgagtttgaaaatgtaaaaattatatgaatagatttgccttgaaaaatattttcataaaagtatacatatatcacttttcaataaatatttttatataaacaagaagtcaaaattatgttttggagaccgtgtcgctgtttaaaacgacttcctttacgagttgagggagtacttggcaaggggagagaaggggggatgctaatgcgtgcgcgcagccgcgcacgcccctccccctgcgacgccccctagtccactgttcactattgttccgttatacaaggacatggcccatcattatagttgggccgtccagctaggtgcggcctgttgggcccaaacgaatttgcgagtgacgtgtggcctgtaacaggccacctgttacacttgacaggatcgatggtcttctcttccgctgccaatcacttgtcggcgtacggggagccctggctaactgagaatttggggatcacttcggcacgtcatgcagtcatgctatagctctggcaacggatctggtatggtgtgttgtactgctgtttcgatcgatttcagtagcaaacaatagcaacacaaaatgcatcgaaagcttgatagaatggcaggcaaatacgtcaaaactcattcaacacatacgctataataatatactccaactagtactaacgacttccgatcctcaaattcttgccgactcagcagttgggctttgcaatatttagcacgatggcgacgaccaaggtgaccgcgataagcaccgggaggaatgtccgcaagagagttttggccaagaagcttgtcacgaaacaccacaagaactcttccaaactggacggacaccggtgaagattcgtgagccctcgccatccggcgcgcctccagatcaccttcccgaggcagaacggcgcccagatgcccgggaagcagagcagcaccgatgccgagcacagcgcgtggacgaacaccaccagccaccggctgtccgcgccgccgccgagcgcgacctggagcccgaacgcgaacgcggcgaccatgaactgcgccccggccgtcacgagcgcccacgccgacccctggtaggcgcggagacggcccctgctcggccggacctccctcgcctcgccgacgacgaggaggcaggtgcccacgatggagcagaggaacgccatggtgtccgacaccgcgaacgccctgaaggcgaaccgcccggccgacgccgccgtcccggcgttcgggtggtcgtcggcgacgtagccccccggaacggtgagagccgccgcgaacgtcaccgtggcgatcagcacggacgcgactgttccggtggatgtcacgccaccactgtccttgggagcatcggcatcctccatggccgatgggatgccagtcctagcatgatccccttctagggtaaccggtgctctggtgcagtagaagagattctttaccacggctcgaggattctgtacacaaaaattatcacaagaaagaagacagattaattggccaagtaaacaggacagcacatgaaacgattctctgcagctgcgtgataaccaattgtgatgaactaatgaactgaaccgtgttccattaccagaaaatagtgcaaaccaggttgcagatggcgataagcaaggtcagcagcagttagaccatccctgttggtaatggctacatcgacgctcatcgtctccaagagtaaactgaccatccttgggtgcccatactcggcggccaaatggaggggagtatttccttcattgtccattgcattcatcaggataccaaacctgtcatctcggcaaatgtagcgaactatgctttccttgttatgttcaacagcacaatgcagaaaatttcttcctcgatcatcgaccaaatcgttgtagttgttggggcatttctgtatgagctcaacgacgatcctaacactgcccatcacagcagcaacatgcaaaggaaatgatccttggatatcacaaaccagagctagggagggctctgcatctaggaacagctgaaacacgtcaaaccgctcaatttgtgatgatatagcaaagtggagaggtgttctgcccgacgaatcagctttggttagcagtgttcgaccctctggcttccagtccagtatttctcgcgcgatttctgattaaagacataaattgactttgaattttcatgtgtcattcacaaattgctcgcgtgtttgtgatcatacctttgctagtagttgccgcagaatgcaaagctgtccgtccgtccggaccagcggccgaggccggcgagggcgttccatcaggcaacgggtggagcagcgcccggacaatgtccacggagccaaccgtcgccgccaggtacagcggcgagacgccaccgtcgttggccacggaggccagctcgggagcctccgccatgaggagagccaccaccccggcgtggccgttccgcacggcctcgtgcaaggcggtggcgcccaggcagttcgtcgcccgccgcagcggcagcgccgctgacgccgcgccgccggctcgcagcatctctgacaggaggcaggccgccacgtcgcggtgcccggacttggccgcgcagtgcagaggcgtgtcgaggaacctgttgcgcgtggcggccagcgcgggcgccgtcgcgcagaccagcgccgcgagcgcggcgtgcccgcgggtggcggccacgtgcagcgccgtgttgccgttgcccgtcgtcacgccaaggaggcggctcgctcccgccggcgcgcggccgtcgtcgtcgtcgtcgacgcgtatcgccacctgggacagggagtggccatggccacggcgttctctgcccagcaggtccgccatgcggacctcgtcgccggaggtcagcacgtgtagcagttcggtgtcgagcgtctcgttgcaaggtccgaaatccatggacgcaccgtgaccgtgagtttcggctatggctttggctggtctagacgagaaggtgaaaggtaattgatctaaacccggttgaaaaatccatttcgcgctattccattccatcacttgatttcgctgaaacggagactagtagtcaacaaaaaaaaaatccccatatagctaccggcaaaagcaacacaggtgagttggcatgcgaggattgggggtctcacgagtggcagtggcggcaaaaagccgtattctctctcctcccctcgcgctgcaagtcccaactgcagaactgctcagcttttaaaattgaaacagataaaccgaaaatatgtggtgcaaacctaaaagttatcattagataaaaatagatgcatggaatttgttaattttatcaagggtaaaagttttacttgtaaatttaattatgagtaaaagttttactgggagtaaattttttttactcttgagtcttaatgacgtagacaaatttttaaaagtctatttttggattcaacagtaattttcactatatatttttcttaaatataaacggttcctcttttttccttcgtttcttggacaacgttgatgatggtctcccagtaagatcagaaggcatgcaatggttcagaaaccatctcagagacaccatacagcaccaaaaagtaaactgataaaaacatccactaaattataatttaatcaaaaggaaatgccctccaggggcaaaacgttatgcaaattaagcatcatgagaagctaaatcagttctctacaatacacaccaaacctcagctagaaacagagcgcaactgacgatcacctgaaaaatcactcaggggtgtttagatccagaggtgtaatccgtcattagcaaatgtttactgtagcactacattgtcaaatcatagagcaattaggcttaaaagatttgtcttgcaaattagtcgcaatatgtgcaattagttatttttttaccctatatttaatacttcatgcaggtgctcaaacgttcaatataataggatgaaaaattttacggtggggtcttaacagagcctaattcaatttgtaggatcgaaacacaagaactaagccaaccaaaggggggagaatggttggcttacccaaaaaccaaaacttttagcggaattaaaagttaccctcaaattcgacagattgcggtctgaccgaagtgtatatgccgatctgactgcctgaagaacgtcggtctgaccgaagttggaacttcggtcgaaccgctgagatcgcctgccagctcctgtcgccgccgccggtttgatgagcaccgctcctccgccggtctgaccgacgcgatgccaccggtctgactgccggtgtctcgccggttggaccgccgcacccaagaaaacacaaatagaagaactctcaaagtagatgacaactttattgcttttctctgtgtttacaaagtacaccaacagcactccttacaaaaatttcgactaaactcaaaaccctaactaaactagaaactcaatttctcttagaagcgataccgggaagtctcacgctccctctctatttatatatgaggtaggcagcctaaagccacgaaccaaactcatactagaagttctaatcaccctaggaaaccttctcgtacaagaaataaactttacataaccaatcataccaaatttgtactccttccaaattcgactccacaacccatacgtacacaatacctccatcatatgccatatagaatcatcaccaaccacgtgcattgaactctagccaaagtatctcgcatgatatctaacagtcacggacatcgccttaccaccaagtcgactctcgatccatcaccgcaaatactctcccgaggcatcaagtcacctacacatgaatcaaacaaagaaaccatattcccagaccaagctatccccaacttgacttattagtagcaaacaacagtattacatatgtatagtatccatctagaagccataaatatgaaacaatcaataaacaacccgaaaccgaaaccgacacagcgtcgaccagtcagaccgcgagctggccgatctgaccgcttgatcaccgccggtctgatcggcatacacagcctggtctgaccgaacccaaaccgcagcagttcctgtagatcacctgaaaattccaatcatctccaaaaccatttcgcaaataaattccaaatatcaaaaccaataaactccaattccaattgttcatcacagaataataatcaaaaacacctttgattttacacaattctacaaaaccatcatgctccagtcaattatagagacaacgagacaaatatccgcaaacaacaagaaacttcccctctttctaccctaggccgagttgtaaagagaagttcaggagagctacttcacgattttctgtgagcaccattctcagactacttcccccgtcctaaaatatagtctttttaagattgacacgggtattaagaaagtatgtgagaatgattgtaggaagtgtgtgatttgttgaaaagagaaagtaagtaaagaagaatggttgtgattggttgagaggaggaggtaggtgaagaaatagcttcatcttgtgacaagacattgtgctaaaatagctacattttaggacagaggtaatacttaaacattatattttttctaggagtttcttttaaaaaaattaaataaatctatttttaagttttcaatagcttttacttaattagtcatatcctaatgacttattttgttttccgtgctaaaaaaaagctcaccccaacctaaatttcaaaccaagccttatccatttcccatgcatttttgcgaatgcctatcgcatagacgcatagtatgtcatagcgcttgtaatcttgtatactccatccatccaaagaccaatcctagcattccaatgtaaatttaatgggagaaaacttgaaaccgaagtttcagtaaatttgcaattcaaggaagagactttgaagcgtgcaaactaatgtcatctcggctgttctaggtatatgtctgttgagtgcaaatcaatatgaacaaatgaatgttcatgcaccagctctgctcggtggacggtctaatcttcaaatcaatctgaaaatcaatatgagcctagtgataagcagtttggtcatgtaccacctctgctcgttagacgttcgcgcaacaggaacatcgccgctgccagtaagagcaaggccaagaaattcctgaagagggacgttgtcattcacgggcagctcatatgttgggtttagtcctacatcagtaatttattatggaggaacatgacttaaaaggtagggacggacctcaccgatcagattagtcttttgggttgtataggcctagaacctaaagttgtagctccggttgggcctgtgatggagcagatccaatgtgacctgggtggcccacggttggtgggccaagtggtatcaaagcccaggattggaacccggaacaataggtaacagggccaagtggtatcaaagcccaggattggaacccgaaataataggtaacaagtcttttgggtcatggtgaacaataggtaacaagttttcggggtcatggtatgggttgatgtgatgtgattgataatgggtagcacgacttacgtcaaagattgttgggtttagtctgacatcgagaattgatatcgggggtcacatcggtaattgtaattgatgatcggtaattgatgatggggagcgtgacttaaaggtgggggcagtcctcacctatcatactattttttgggttgtgcagacccaagacctaaagttgtggctccggttgggcttgtggtggagcaggcctaatgtgtcctgggtggcccacggttggtgggcctaacaagtggtatcagagcccaagtttgaaaatggttttgtcccacatcgggaattgatatcggggtcacatgggttgatgtgacgggggagattgttgggtttagtcccacatcggtaattgatgatcggtaggggagcgtgacttaaaaggtgggggcagtcctcacctaaaagattgggttgtgcagacccaggacctaaagttgtggctccggttgggcatgtggtggagcaggcccaatgtgacctaggtggcccatggtcggtgggcctaacaagtggtatcagagcccaggtttgaaaaccggaacaattgttatgttcattcccacatcggtaattgaacaattgttagatttagttccacatcggtaattgatgagagggaagcacgacttaaaaggtggtgcagtcctcacctatgagactagtcttttgggttgtgtagtcctatgacctaaagttgtggctccggttgagcatgtggtggagcaggcccaatgtgacctgggtggcccacgtaccctagaacctaaagttgtggctccggttaggcctctggtgaagtaggaccaatgcgacctgggtggcccacggttggtggggctaacaagttgtatcagagcccaagtttggaaaccggaacaattgttatgtttagtcccataacggtaactgatgatgggggagcacgacttaaaaggtgggggcaatcctcacctatcaaactagtatttttggttgtgtagacctatgacctaaagttgtgactccggttggacctgtagtggagcagacctaatgtgacctgggtggcccatggttgctcctgttgggcctgtggtggagcaggcccaatgtgacatgggtggcccatggttggtaggcctaacaagtggtattagagcccaggtttggaaaccggaacaattgttaggtttagtcccatatcggtaattgatgatgggggtgcacgacttaaaagctgggggcaatcatcacttatcagactaatcttttgggttttgtaggcccatgacgtaaagttgtggctccggttgggcatgtggtggagcaggcccaatgtgacttgggtgacccatggttggtaggcctaacaagtagtcccgcattggtaattgatgatggaggagcacaacttaaaaggtggaggcaaacatcacctattagactagtcttttgggttgtgtaggcccatgacctaaagttgtggttctggttggatctgaggtggagcgggcccaatgtgacatgggtagcccatggttggtaggcctaacaagtgggatcagagcccagagtcttttgggttgtgtagacccatcataaagttgtggttccggctgagcctgtggtggagcaggcccaatgtgacctgggtggcctatagttggttagtaggcctaacaagtggtatcagagcccagagtctggcccaatgtgacttgggtggcctatggttggtaggcctaacaagtggtgtcagaggcagagtcttttgtattgtgtaggcccatgatctaaagttgtggttccggttgagcctgtggtggagcaggtccaggactagttttttttgggttgtgcaggtctaagacttaaagttgtggctctggttgaacttgtggtggaacaagcccaatgtgacatgggtggcctacgattggtggacctaacatcatcatcagggagggcggcagcatgtcagcgactgcaaatgtggcagtgtggatttttcaccgtgccaaaaaaataaaaatgagatgggtttgggtcgagagccttactgagagataggggagggatttgcacaaatttt

SEQ ID NO: 69420 - DNA, 1861 bp, Oryza sativa
gtaatagtatttcggtcgaaatcccgagttaattataaaaatatgtttcttgatcagattagattaaaattggtagtaatttagatataattaataactaaacaattagatgaattcttatagattattatagattatttttggtaatcttcataagtcatcggttcacggtagaaattcggatttaattactaggaatcttagccgtgtattatatttaatcgtttagtcatagactaaattaaactgtataatatttctaggatttcgtccgatatttagctcgtaatagaaatttctaacctattatatggatataatgctcgggaagagtaaattaaaaacttatgacaacaaaatatttatacctgcaaaatagtttaagccgaaattgggtttgccgtagttcgcagatagtaaagttaataaaaaggaatcgactttcacattcgactttcatttggatttttatttgaattctaaccgaattcaaatcaatttttgcacgtaactatagagcccgagggagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaattatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaattaaaacaactgttttcgactggggcagacggaggatttgggtggtatctggaacaggctagtaccgtccccagtcaattaaggaccgagccatgaagttaagcatgaaacgacccccgtacaaccgtacttctcgaatgggtatagacctagcggattagatagccgagcggaggcaatattcctgcatagatggttcacctctgagtgaggcaggtgcgctacgatgggacagccgttgaggtagggccaagaggcgtgccctacatcggtgttgccattggtaggactgccatgagtgtgtgagagagagaacttaacttgaaccataatttaatatgcgtgtgagacttctctttccccgggagcgccagaactcctctcactgctagaaacatggacacctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcagttattgagcaccgggacatgtattacacttggctagactctaaaattctttaacttgtgtgggatgggatatcgcatgacaatttttatgctgatggagccacttcctgagaggcgggaatgtggacgtcctcagaaaaccataacgactcaatggcgggaagctatccttgggatcacaatggatggtggacagaaccgtcattgtttaatatgaacattggtattaaaacttgaacagtctatgctaggtcttaggcttgtgaaaagaattacaaaacttgctttgtgcaaaagaaccatggccatcctttgaattcctctgtcatgtgcatcattgctgtgatggcttgctga

SEQ ID NO: 69421 - DNA, 8841 bp, Oryza sativa
ttttttaatagatactgttgacttttgagcacatgttttgattattcgtcttattaaaaaaatatgcaaatgtataagatataaatcatacttaaagtacttcgagtgataaaacaattcacaacaaaatgaattataattacgtaattttttaataagacaaatgatcaaacgagcgacaaaaagtcaacggcgttatctattaaaaaaacggagatagaatataggtaaggtaaatttattattaaagcattcttgcttggtagtatttttatagttggtatgtggagtaaaaagaaggaaacaataatattgccatgctagattaatgaaacagattgtacataaaggcaagacaagaggagaagacacagctcacctgtgctatgtagccgtagaagtgcagatgcagtcggaggaggatattcgctgtgtctttctcctctcatctcaagtggttcggtttccattttgaccgagccatccatttgctgaataaatgaatggtgacggctgatgccacttccctctcctgtctgcaactcatctgtcacagtttcagcgaaagcgagtaaaatgcaaggagcaagatataaacaagagtagacattttttacagtatatacaagattcataaccgcattttccccatatctatatatacagtcgtcgataaattctacaggtacgttcaaatagaacgagaagaaggagcagaacagtatatatacgcgtacggtaggaagagggtatgcacgtcaaaagaagattgaagaagaggaatgcattgcaggcagagtgcagtgcagtctccatcgcatgtatattcagatgcaatgtattccggcggcttgctaaggctagtccacgctagtatatatgatgaactgaacttgttctattgacgtgcactgcaacagtgcaagtactctaataagctttagctaccactgctactactagtcagcaaatcaaagagtcttccaaaaaaaaaaaagggtcagcaaatcaaagggaaacacaaacgccaagtcctacacgtcttgagttgctgcacgctgtttttcctcgccttctttgctccaccacacaatgctgctactgctagtcctgtttctggtgcacccagccacccctgcccacacctatagaaaaccatgcatgtcttacatgatcatgataactttaaacgatgtattttttataaaaaaaattctatctacaaaaattttctataggaaagttgctttgaaaaatcatattaatctatttttaaaatttaaaatagttaatactcaattaatcatgcactaatggctcacttcgttttgtgtatctttctaatcttctcaatccccttctccccaaagtcagtcttacatgattgagagagaagagtgacattatgcaacacactagtcttgctcagtagtaggctcatactggcaggtggcaccgttccatatcctgcaaaattatactccctccattttttaatagatgacgccgttgactttttctcgcatgtttgaccattcgtcttattcaaaaattttatgcaaatgtataagatataaatcacacttaaagtactatgagtgataaaaaaactcataagaaaataaattataattacataaattttttgaatgagacgaatggtcaaacatgtgagaaaaaaatcaacggcatcatctatttaaaaaacggaggtagtatatatactacttatgtcacaaaataacttcaattttatacataattctctggagtatttcagaaaataccctaaaaaacaaactacgtactccctccgtcctataaaaaaccaacctaatactaaatatgacacatcctaatattataaatttagacatacctctatccagattcattgcactagaatatatcacatctagtaatagattcgttttttttttggaacggaaggagtatgagttatgaccagtaagcagcactgactctctcaacgataaactcaacagtatgtaactgaagggatcagtacttgagatgaaaaagaaacaaggacagagtagtaaaatcaggctaccatccatttagggcatgtttggagcagagtataaaacatgtgaataacacaggaaacaaaacttaggaatttgtttgtattgaaaaacacagcaaattaatgtgtatgaacaaaagtaataacaaaacacctgaatcatttttctcgtatcatgtcccttgtgatctttattacttctacttcgattccactggtataaacagattttcgtttttgacattggtatggtattcagatagaatacagcttcaataattaatttatattgtactaatatgtttgtaaagaacttggtccaaaaaaaatgtgtttgtaaaaacataacgaacatataatacttttcaaggtaaatctatgcatatgtattgtatgcatctaacattaatattttagtataaataaaaatgtgatgtatgtattattataaaacctgcaatttgaaaaaaaagagagagagagagatacccaaaacaaaaaaagaaaactagtgaaaaatgctacaactaaaagaagacttttccttaggccactatagaaggttttctatcacctgtcctccttggtccaactatgtcgagaatcgatgaagagcgggcccagcgtcaccaaacgggtgtatggtgtgtattcttctcctccaaagttgcaatcttgcctctgtgtgtgtggtactgtagcggtgctctttctttggtgggtgccacgtaggagaaacccagcaggagtcatttccaagtgtcaccagtgagagggcaggagggcatgtgagttggcgataaccctatcctcctcctgtcctggcccttgtcttcttcacgtctctccctccctccctctctagagcctatagccatagctcatcatccaccctctcttccttccttccttccttccttccacacagaccagaccaggcatcccgacactacacgcagactctcgactttgtcactagcatcattgcttgatgatcgatgctgagctgcaaccaagcaccagcatatcctttccttcattccttcctggtgctggtagaagaagaacaagctagctagagtgataagaggtaattgtttcctccaactcattccaaccttgccttttgcctgccaaactcctcatcctctgccactgcataccatacgtgtgcgcgcctgaatgcctgcctgcctgcctgatactgatacatacacacagcacacacgccccgctattgtaagtgcggccaccactagctgtgtttctgctctctgtgtttatcaccaaattaaagcaacgacactcacttggtctgtttctttttaaaatattatttctcctcctcacctcacacatacctgcatattatttgcagctagctaccttgcagatcgatctccggccagcgattgatcccatccagtataataatggcggccatcacgctcctacgttcagcgtctcttccgggcctctccgacgccctcgcccgggacgctgctgccgtccaacatgtctgctcctcctacctgcccaacaacaaggagaagaagaggaggtggatcctctgctcgctcaagtacgcctgccttggcgtcgaccctgccccgggcgagattgcccggacctcgccggtgtactccagcctcaccgtcacccctgctggagaggccgtcatctcctcggagcagaaggtgtacgacgtcgtcctcaagcaggcagcattgctcaaacgccacctgcgcccacaaccacacaccattcccatcgttcccaaggacctggacctgccaagaaacggcctcaagcaggcctatcatcgctgcggagagatctgcgaggagtatgccaagaccttttaccttggtatgtagtatgtctatcttcttaattttcacccctgccttgcagcgtgccatccattttttcttgccatgcatcatatcatggaattcatgctgctttctcatggcaggaactatgctcatgacggaggaccgacggcgcgccatatgggccatctatggtacttcaacaatcaccatgtcttgctccactgttccattgcttccctaactatgtatcagtaaatattaaaagcggaggtaatttaattttttaattcaaatcatcagatatcccctcacgtttaatatgagttgaaggtcactatatagtactccctccgtttcaaaatgtttgacaccattgactttttaatacatgtttgaccattcgtcttattcaaaaaaatttgtgaaatatgtaaaactatatctgtatatgaaagtatatttaacaatgaatcaaatgatatgaaaagaataaataattacttatattttttgaataagacgaatggtcaaacacgtactaaaaagtcaacggtgtcaagtattttgaaacgaatggagtattgaatagtaacctactgtttgagttgaaggttgctgtactacttactatttaacagcgactagcaagacacaaattggtcaagttttgatgtaatggtcagaattaggttattgatgggagttataacagacagaaactttgtcgtcagacttcacttgcatgcgatgcatctgtagatacaaagtcaatgaagaataaagtactaatagtactagtgcatttcttttaaaaccactatctatgcaagcatcacaattggacttgtagtaggctaaatggctccaactgtttcaagacatgtgaaaaaggttgagagaacatgttctctgagatgccaaatgaatatgaatccgtactactaacaatttcaaacttttaaatgagctagttcaggcatgaattttgaaatctgatgtatacctttttttttttgcagtgtggtgtaggaggacagatgagcttgtagatggaccaaatgcctcgcacatcacaccgtcagccctggaccggtgggagaagaggcttgatgatctcttcaccggacgcccctacgacatgcttgatgctgcactttctgataccatctccaagtttcctatagatattcaggtaactagctggtatatgcatatagcgaaaatccaaatgatgtaatactgctagactatattggttgctaatccctatggattccctgcacatcgcaattctagtgcaagaagaatagacctactaagttgacgaccaaatagttgatcggtcaacaatatcatatgacttgtcagccattagtctctgatgccactgttaacttttcacacaatttattgggcttagtccaggactccatgtggccacaatgcacagtattagtctaggaaaaagatcaatccaaggacagatatggtaggacttttcagaacagacaactgatagagcacagcccatcaagtagaatactaaggggaaggccataattcctatgcaattctatggagttgttaacctgaattaagcaggttctatacagaataaaagaacttgctcattatctatgatgacaaaaaaggaaggaaaagttccactgagaattttactgaacacatgaaaacccacaattggaaacttatcatctgtcctttgagtttttacagaccacatggtgtataataatatgactaatcaaatgcaatgcacgtatgccagcctttcagggacatgatagaagggatgcggtcagacctcagaaagactagatacaagaacttcgacgagctctacatgtactgctactatgttgctggaactgtggggctaatgagtgttcctgtgatgggtattgcacccgagtcgaaggcaacaactgaaagtgtgtacagtgctgctttggctctcggcattgcaaaccagctcacaaatatactccgtgacgttggagaggagtaagtgtcaatacagtggttttcactaatggtcataagctgtagaacagaatgtcggcatatatatagttcactgatcctaatacttcattttattttcacagcgcgagaagagggaggatatatttaccacaagatgaacttgcagaggcagggctctctgatgaggacatcttcaatggcgttgtgactaacaaatggagaagcttcatgaagagacagatcaagagagctaggatgttttttgaggaggcagagagaggggtgaccgagctcagccaggcaagccggtggccggtaagaagagtcacttgattctcaaggaaacataaagcagattattattgtcggtgcttctatgccatggtgtcaaaaggaaaataaaatatcattgcattgccccgttgcaggtctgggcgtctctgttgttataccggcaaatccttgacgagatagaagcaaacgattacaacaacttcacaaagagggcgtacgttgggaaggcgaagaaattgctagcgcttccagttgcatatggtagatcattgctgatgccctactcactgagaaatagccagaagtaggaggcgggaagaggagataaagggaagatgatgagcaggttaggcttagataggaaaaatcagacagcatctgccttccgattaatgttgaggaaattatattattgtgtgtatcatacatagcatgtatagggaaaatgctgcaggcaggcaggcaggctaggtgatggttgaatatttccttcacatcatgtatgtatatccttccttgatgctacagcacatatgtatgtatgactctgaagaaagagcaacctgtatagtagctaaccggctatggcctatgtatgggccgcagaggtgagcaaacaaaaatcatcatccatggattgattgattgattgattgatacagtactactaaagcaagcatacatacattatccagggaaaatgcagaatgagtaacaaacttgagagagagagagagagagagagagagcaaagcaagtactccatgagcgaacaagtcagttggtcggttgacgaaggagattgcaggaggacctcacctcaccatgtggagtccgtggggcggcgcacgctgtggcctggacatcactggccggcaggggattattggggttggggccattccttcacacgaccggaagaggagggccagccgccgccgccgccggcggcggtggcaggagtggagtctggagggtgcggagagttcatggctgttgaagttgggctttttttagtttgggcccaatataagctgtagcatgaattcccgcgctttatgggtttgggcgggattcccttctccgtgtcttcatttgccaaaaagctagcactagtactatagctaaggtggtgttcttttggtggtgtttgagttcctatttggatcagggattgaagttttagtacatgtcatatcatgtcatatcggatgtttggatattaattataactatcaaacgtagattattgacaaaactcattccataaccctggactaattcgcgagacgaatgtattaagcctaattaattcatgattagcccatgtattgctacagtaaacgtagtctaattatagattaattaggcttaaaaaatttgtctcgcaaattagctctcatttatgcaattagttttgtatttagtctatgtttaatactttggattagcgtccaaatatctgatgtgacagggacttaaagtttagtccctggatccaaacaccacttgaatcttctgaagataaaaattaagtgtttcacataaaacaatgtggtaataacatgtgattaattgagttttactccctccgtccccaaaaaaggcaacctcgtatttgatgtgacattttctagtacaacgaatctggaaaggaaatgccacctccaatactgggttgtctttttttggatggagggagtaattattacaaacttgaaaaatggattaatctgatattttagaacaactttcatataaaaattttcacacgaaacgcatcgtttagcagtttgaaatgcgtgtcacgaaaatccaaaactttatccactacttgtagtggaaacgaacatgacctttctcctaaagacgaagattaagtttttttacgcaaaaaagactagttctacctacgaacctggacacgtgtgttcaggttcctagctaggaattcctttttttagagaaagtagtaatacttaattaatcatagaaaaaaagtatgaattaccccctgaagtatcaagtgagtacgagttgcccccctaaaatagaaaaccagtcatttttcacccttaactatcgataccggatgaacccacccccctctcccccccgagcagatttgtaagcgtttttggtctgggtggcaacctagtcagcaagttttttattaaaaaaaaggatagggcccacctgtcagatatctcttctctctatctctttccctctcaccccctctctctctcccgtcagatgccggcggttgcggctcacgcgctgacagcagtgggcgcctcctccgctcaccgccgtcccctcctcccgcggtcgtcaatttcccctcctcgcgaatgcctcgattttgccggttggtgcggtcatcgaagcgcacgccgaacgcaagaaggaggtcggtgttgtcgacggcgtagttggcgtacactgtgccatgcatcccgagcatccgcagggagagggggccgtcgctggggaagtttccgatgcccatgagggtggtcgtcaacgggatgcccgtcagctccacgaagcagcgcagttcatcgccagacgcggagcagccgccgactgatgtagaggacgggttttctggcgtcgcggacgagacagatgacttcgttgagcaagttg

SEQ ID NO: 69422 - DNA, 7981 bp, Oryza sativa
  unsure (1)..(7981): unsure at all n locations
tccatttcctcacaggcagtggtggccgccacctccacatccagcatgacttggattggtggtgtattgctggcattggtgccatgtgtggtcagctaaggactatccatcagctcttcggcgtccacgaccacgtctttcatcatctacccacaaatgtgacacaagattaaaacatattgcattgtaatatggacaaccagttgctcttgatacaaatcaaacaggagaatattaacaatattaaaaaactacagcaaccaaaatctgatagatgaaggtcagaaatgttatgaatgactacaaacctgcaagtccttgaaatccaacctgaatacaaactagctgtattttacatttccacatgcggtgtcttccgccgcaggtgcattacttggtctataccaacaaatataataacatcgaagttaagctatagagtacacagatttgcagcagcagaaatagagaacaagtaatgaggcagttacatgcaatatggcggcccccatcgttcacagttatttctacccgtcagcataaacaaggaatggcaaagtatatatgttctgtactgtttgggaaaatgaatttctatccaacactaggttttcaagccttacagattttttcatctttagcacattaaacatggcttagatgttttcatcagcacatgataaatcatcaagctgcacttcaagaagaaaaaaaaatcaagggcttcaagggcttagttgaagcaagatgcaaactgaaatcagtaggcagtacacaaaatattgtgtgtaaaaatgacttcgttgccctcgccagtgtcgaatctaggacaaaaattgaggataggctggactgatagtctaagtctaaattgataatgctaaaataaggcacataccattatcaagtcaaatgtaacacttacatgattaaataaaaaagcatacttataaaagacgtaccttgactttcgactaaccagtaaaatgctcattttcaccggatatgtcctcaattagtaatgcataaatggtagaagtaaacaaatgttaactaaaataagtaacataccacaaaatgcagcatccttttccacactatgttccaagcaatcaaatcgaaccaattctgttgaaaggatctccaaatcttaccatctaatgtcctaggaaaaacatgtccaggtgctctatttggaccattcaacaaatatgcccttctcacttcatctctaactagtaatttgcatgtgctaacgctacggctatatttaacaatacagatcaaatatatgattcagacaatcaaaagaatggaatcatatattgctaattatataaccatgtacaactacatgtttcccacagtatatattgcttcaagctaacattttgcatactctatatatacgcaaggcaaaccatttgcaagtacagaagaataaataatcaagcttcattgaaattgtatttcaaaccggaatagaaacaaaagtaaacacttcagcatcgctcatcttgctggtgttgatgcttccaacagctgcatcacatcactgaactctgaacaaagctgaatctaaagcagcaaagatggcaattacccaaggccaccttttgtctaggttcttcctgagatcatccagcatgctcgtcctgttgatgcttccgacatctacaacacattaagacaatgtcaggtgcaaactaatgtgcaaagttacagatggatctgtcatcttcagctagctttgtcagatggtcagatgcagtgtttttcagaattcaaacacagaggtaagaacctacctcttgacttcagctcaatagctttttatcagaacaattaatcacaggcattttgcaatgccatctaccttaaaaccttggtttagcaaacatttaaagactataaattagttgaaatttgattttaattttaattcagttgtacatatcaaagacaaattaggagatagatagtattagatatagggataatacctactaaaactgtctcaactcattgaagcaatggagatattttcaccctacagctatcaatatcaaatatctatggtgcaacaagcaatgccaacatcgaattgttgccctcagaaacgattatatgctactgaagcagaacatggaagcagctcatttacctagcgaccctagaaataaggggatcaggtgacctggtcggagagcttgcggccgtggacgaagaggaagaacatggcgacaaatcatacatggtgccccatcatcagtcatttataataaaaagattatacaagcgctgttgcttttgacagattgcattatcaccaggaaacaaaatcagtccactgacaaaaaaattggaggcataaaagcagaacaaaatgaagcccagaggcattatagcatcttgcatctggaaaaatgagtaggctaacaatatagggtagattacaatcttgttggttcctgttgttaatcatctggcctattatacaacaaaaggccttcaatcctcaccaatctagttggctgagacgcagtagtactcgtggccaccccaacggagataccctctatgaatcaaggttattcatctgaacagggcaaaaatatattaacaatctcatttgtaaaagggagtaatctggattgcatgtagctaatccaattttcatcggtatgaaattaaaattgaataaataccccagatacattagacaagatagtgagtactgataaatcactctatccatttaaaaaatattgattaaataataagtgtataactttatcaccggttgtgatacaatgagaaatacttgacatgcattaatatcagacactccctccatcataaaaagaaacataggaggggatgtgacctctctatggacaatgtatccgaaattagtttttttattcgtatccgaaattagtttttttcattcgtatccagaaaccccttccaatatcccgtcaaacatccgatgtgacacccaaaaaatttcttttcacgaactaaacacaccctaaacaagaaaaaatgcaacgctgtcatccttgtgtcattagcagaaaaatgttaatagcaccaatcaacagtggtcaccgaggaaaatggttaagcaatcaaagtgatgaaaaaacttgatagtgaagccattacttcccttttgtgtagttttagtgctattgagcatgttagacaggtaccatgacatggttcagttagatgctcataagaatttactgtttgatacgcattttaatcaaaacactgaagggctcaaaaaaattgaatcggtgagtttaacaccatatcgtgctatcagcattttcagataaggtgctgtattattcaccaattgttccaccaaacataaaaaacatatggaaaacacaacagaaaaaagcctcatatcaaacataaaactgagacgatacactgaaaaagtgagtagctagcaccctgaaacctggcctgcgtggagttgatgcgagcaggcgccgagaaatcgggggagcgacgacttgacagcgtggcgacagtacggtcattgtcattttgtagttaaatccaaacgaaactgaaatggagggcaacactacaagagaagttattgactccccccaaataacacttctaattaatccatttaaacatgagcgtatgaatatgatgcatgcatgtgatactaataatctagctaaatggtggtgattcacgatttgatcagttaattaaattgttcatatcaaagaacaaaaagagtaccttgcaactgattgttagcgacggcgccagtgcccagtagatatagcacttgcagcaaaatcagtcaggctagcggtgatagccacgctcgcaacggtgacggcggcgtccggcggcgacggcgaggacggaataggaggcagaacgccagcagcggaggaggcaacgtccacgtgcacggccagcgtgatgatgccaaagccatgctgtagcagaccgagcttcgtggcatcgacgtcgtgcgcctcctccggcctagacatggcgctgctcttgccgtggccgagctgatcggcggagcggcgagagcaggtccatggccgccgtcacggacatcgcctgcgtcaacgtagccctcgcgggcttgctggacccggacgagcggtcggaggacgatgacgacaacgaggtgggcgccgccaccggcgagacaagctgctgctgcggctgcaccggctggggcgggaggatcggtggcggcgtgaacgacggtgccacggcctcccggtgcgccgtcgccgccgccggcggctctgaggcccggttgccgccgagcccgagccccgcgcggcctgtcccgccggagcgcagcttgttcttggagcgggacttgcggttctggaaccagtagaagacgttggcgtcgccgacctggccgtactcctgcagctgcatgcggatgcgcgggatctcgtcgcgcggcgggttgaccatgccggagttgaagatggcctccaggatccggatctgctccggccgcgggttccgccgcggcttcgggtccggaaccctctcctcgcccactgcaacaaccacaaaaatcccaaatcaattccctcctaccgatcgatctcgatcccctctaacctcgcaaaacgaaaccctacctaccaagcgcaaacagtagcatgcacggatgatgcgggacctacctgacgagaagggcgaggacttgagggagaagccgccgccgccggtccggtggccgtgacttcgaggcagcattgggtagggaggatcgcgggtgatggtgagggtctgagggatacttaagggcgaggtggaggggatccggtgggtggcggcgtttagggctgggagacgcattctttttggcagaatatatagcgagtgcatgatttttttttcttttctgaaatcgccgcgagtgcgtgattttaggagagatccgcggcatgcgtgcagcggtgcaggtgggtgggagaggcatgcacgcgcaggtgggaggaatcagttggcggagatatgcgtggggaggtgggataaatctgagacgttggatcttagcgagataatctggaccgttccatgagaaataaaataatgagtaataagtaaaaccatttgttaaactgtagggtagataattttacaataatcatatattggtattcgtttttgctggatcggcaaaaattttattaggatcaaattccactaggtgcctctttggtctgtttgtgctctcatcagttataggtgtatcacttaaatggcttgtatagtaattaagcaatgtcgttttcttctccattacaaatctaccaacaaatcaaaatactaggaaatgtaaatggtaacaagtaacaaataacaatgaagaagtaaaaaaacagtatagctcactgcctcactcacactgtcacttaagactcacttagagactccggcagccagggccctgtggccgacccctccacgcctgccacccccgtggacaatgatggcagggcactgctccttgagccaccgccgccgccgccgaacacgatcaccgccaaaagtgtcatcgtcgcgtagcgggccggacacgtaggcgcgcgagggaggcggtggcacgcctaaggccatcatcgtggtcgcctctgccgccgccgtcgcggtcctcgtgctgcttgctctgccacgacagctccagtgggctgaccgcgccgctgctgagctactccacctagtcgttgttgttggactgcaacgccgtccatgtctggtcggtcgaatcgacggaattgggctcccacgagggcgtccacgcgtttgccggcaaagctgttgctcccaccggattcctgcggctccgcctcgccatggatgtcacgcacgaagacgtacttgtgcaggctcgactccatcagctcatccttcacaacaacctgtcaacctcctacacaacgatgtgtgtgccaccgccggcgaccttgccgtcgccgtacctcccgtttgacaagcacttgccattggccgaccggtccaacttgaagctcttgttttccgacgacaaggagttgaggtccgcgaccattgttgtcgtcgagctccgccatggggttgcaacggtatggctagtgctcggccttccgcgacgagctccggctcagagatggcctcgtgcgccggctgcagccccttctccctggctgcagccacttcctggacgcagttggcatgcgccgcttctccctggtcaggaccgacaccgtcttcccagctgctgctgcggccgcccccgcgcaccgctgtgcacacctgcgcacgcgagagagagatatattaggaagaggtgaagagagagaaagaccggtgggtcccacccttttttttaaaaaaaaaaatgctgactagattgccacgcgtacaccacgtaagacgaaactgctcgggattgagtcgaggggggtaattcgtccggtattgaaagttcagggtgagtttcgttaaaaaaaaaaagttcagagtaagcaatgtttggtttttgggttaaagggggtaattcggtcgaccacgatagttcgggccgaggtggggggagggggtaattcgtactttttcctattcttttatacattggtacaatagcaagtcagattattaacacttcggttgtgtggaattatataatcatatactccatccattctataatataaaggagatttggggtggatgtgccgtctgtccagattctttgtgttagnatgtgtcncatccccccaaaatcccttatatatattatgggacggatagagtatatatatatgtaataatacctatgatatgcttcatatgacatggttttttgtaagttaaaccacaatacccaaattcatatgaaattatattgaatttgaataataccggtacttctattcgtggagaatatatatataaattaaacattctgaaatttatatgggaaacagttgtacggctcactgtcactggtgcgggtgcctgagaaagaccgcaggcatcggcatgggagatcactattggcatagatcatcaatggttggaaaatcaaccattaggatacaaatagtcattatataagtacaattgatcatgattgacaatgattttaatcgtatatagtccgtggtgcttggaagttgtcgacgtttgatgtcgcaattctgatatttgcatagtatggggatcgtcggtgctaggatatacgtgatactgaggtaaaacagatggagacagggatttttatacaggtttgggcccttgaattgtcaggtaataaccctacatcttgttggccgaagccggtattgctcttattcatgataatcacaccagtacaatattttgggtagcctatctaactgttgtcgacatggcagtcgtacgatctgactcgtagtcgacaacaggatagcctttctccttaaatccgtgcccggcgagatcaaagatagcactttcatctctcctgacagtatccggagacaccgtagggtactagccgtgcttatccctaaagtcaatattcggcgacgtgtcttggtgtatgtaggcttttatgttgtggcttctatatcgattgtgttggatgttgatcccccatggtgggtgtgtggattctcttgtgtatgttgattctgtcccctctcctcctatggggccttatatttatactcatagatgtctccttgtccaagtagaaatagggaaaccaatatggatacaatccgagtagtacttgttgtttccatgtagaattttggttgtcttttcttatctggaactcctcctatattcacaggttgtttccgtataagacatgatatgtgatgggtcctgccgagatttagtcaactactattaggtatgtggtatccataatcctgacagaagttgattggaccgaatagacggctgctcatcaaagaaa

SEQ ID NO: 69423 - DNA, 26773 bp, Oryza sativa
cggggttaccgtgccccggcggtaaacacggttaccgcgcggtaaccgtggtaaccgtgaaaaaccgtacgaaacattgtttaatttatcaaaaattcaaattattttttaaatttatttgaatataaggaggttactgcggtatttatattactgtacccccgcgataagcccggtaaccgcggtagtcgcgcgggtaccggcggtaaatcgaacactggcaagattgaccttactaaggttggaggggtcattgcaccccgatagtaagcttggtaaccttgcagttatgcaatgaataatggaaaaactagctaggtaatatttaccagaagtttcaaaatttcatttcattttctttttatagcatctcggtcgtaagcttggttaccgatcaaaggaaaccctaggtgaggaacgtccctctcgtaagtcgtaaggatgaggtaattgtaagattgtttgtcagcctcaactttagtgtactagcagtccgtaagctgttttgtcagctcatgacatgatgttttgtcgtgtcatctggtacgttgacattacaagtttcatcaggaacgtaacaaaattcaatgggctgcgtggtcaagatggaagggttaggtctcacggagctaagtcagctagcatgaatatatcattcatataattaaactatgagttgactatagcatgaattaatatagcccaaacttttctaggggagttctgaaatctgaagtatgatagagttgacgagttcccgtttctctgtatgattgccgggtgtatgcaattaacgtggactataaaatacagcttgcaactatatgtattttgaaaagaactatgtattttattccacagtagtactctctctgtttcaaaatgtttgacaccgttgactttttagcacatgtttgaccgttcgtcttattcaaaaaaattcgtgaaatatgttaaactatatgtatacatgaaagtatatttatcaatgaatcaaatgatatgaaaagaataaataattacataaattttttgaataagacgaatggtcaaacacatactaaaaaggcaatggcgttaaacattatgaaacgaaggaagtataatactattggttacatacatattgacactttaaaatatatttaggctcccaggaatactggcgccgctgggaagcctccattgatacctaataatttgcttatatattagcccctctcctctgcatatgctacttatttatatatccacgtttggtttttcagcaagcaaagtctacaagaggcacaactctatctgcatagtgttacacattatacaattgttcattattgtggcttccctgcttctgaaagaaactggaccagtcttcatcagtgtcttcagatcgatctcattgccattgaaaattgataatatgtgtactatattttttagatgaaaagcccagtaccgtcctcatgcatgcatgcatggactcgatccttggcttgtgcttgctggcgacgatttccacttgttttttttatggctagtaggtgcagttgtggagaatacgcaacctacacgtagtaccgtttttttttattggagcatccatcagagtcaaacttaaatgcttatttgacctgaatttattttcggcttgaattttgtgttttattaatgtgctatatataggtcaactgtacttatgcaaacctgatggcatgagctgatgagcccccttttttctttcaaaacttctgaagaaaatgacacgcggagctatcttctgaacttttcagttgaaaaactgaagctcgtttttctgcaaaactccgaaacaatgatttgttatttcataacaatagtgataagcagtcttcgctcaggactttcaggttaattaacatactacaaccggtcaacttgaacagcattgcaagtagcactgtggtacgagtgccacctttttattagaacagtacaaatgctgactaatttagcttttataattgttcagagttctaggggcaaataattgaccggtgatttgacttgtcattgaaaatactcccttcgtctcattttaagtgtacctatgagttttcgtgtccaactttaattatccgtcttatttcaatttttttatgattagtatttttattgttattagatgataaaacatgaataatactttatgtatgacttattatttttttaaaaaaaatttcaaacaagataaatgattaaagttggacacgtaaactcatagttgtgtttgaaatgggagagggagtaacaagggagtagtttacaatattacatatagaccccgttcttttctccaacaagagttggatgaagattaagattttcgtgtggcacgtttttcaaactgctaaatggtgtgtttcgtacaaaaactttctatatgaaagttgttctaaaatatcatattaatctattttttcaagtttataataattaaaactcaatcaatcatacgttaataacacctcgttttgcataaaaaacttaatttttattttcatctttatcttcgggagaaaagaacaccaccacactgatacggagcatactgttagccaataagctggacacgtggcacccgtcattaagttgctcccaccaggtaacttcctacgtcccttgtttggatcaccctggcgtcaactgttcgttttgtcaaaccatggcgtcaaataggtgcagtccgaaattcttttggctatgtcaccactagggagtaaattcttagcactttggagtcaaccctcctagctataataacaggagggaaaaattttctttttccacgcaaataaaaagatttatgtataatttgtctttaaaatagatgtagatgaaagtctgggcattgctaaggaaaaattatccgatagtaactaaacgtgaggtacaaagtaaatttgctttgtagttaaactttttgccttcacgtactttacacaatcacatcttgccattatggaaaaataccaatgattcaaatgttaaaaacaatacaggtagtttgataaaaaaaacaaaaacaattgagatgttgtacgtggattcatgctagagacgaagggaacgatttgcaccataaatgaatgatcaaagggttgaaaataattaaagtgatgtgtggctttatgagagaaacgataattatcattaactatactcagtgatgaataactttataattaactttataggattcaaaatgtaactttacacttttgaaacttttcaactcatgttttaaaactttacaaaattgtacgatagtaactaaactttataggagaaaagactatttatttattgttttatagtagaaaattattaaacaacaattaatcgagatacactgtttgaacgaatttacatgtacgtacatgatttatccctggtacaacacacgatggaataacattgtttgttacattatgggttatgtaagctgttgacccacaggattatatcggaactaatctcatatataatacaatcatgtcacatgtgttagagagtactctctccgtcccataaaaactaacctattggatgtgacacattctagtactacgaatctggacatatctttatccatatttattatattagaatatgtcacattcagtcctagctagattcatttcgtttgggacggagggagtaaggacgactattatgttgtagacccatcatataattgtaattgtgattgatgacatgattcaggattctgacaatatattggaaacaacgaagtggatggagtctgttcctacccatggaacaaaaagtaaaggaacaaagggtagggtgtggttaatgggtgatcgatcccatccccctatacgctctctcccccatttctcctccttttcttctttttctactacaccataatttttttaaaaaataaaaaaacaaagttggaaaaacgattatgtatagaaatactatataattttttttgaatttaaatttaaattttaaaccggtatgtaaacttttgacttataaactttgagtctataaactaatatttgaattcaaattcaaatttgaatcgggtatgtaaacttttgacttataaacttttggtatataaactttagttgtatagaaatactatataaaaaaatatttgaattcaaattcaaatttgaatcggatataattcaaattcaaatttgaatcgggtatgtaaacttttgacttataaactttggctctataaactttagatgtatagaaatactatatattaaaaaataattgaattcaaattcaaatttgaatcggatatataaacttttgattgtaaactttagatctctaaactttgtgtataaactttagatgtgtaaacttgaggtgtataaacttttaagtgcataaatttactaaaataggaaagtaatacggtgaaaaaaaaaaaacaggtgtcggaagggagggggatccgtcctagcgatcgattcgcgtgcaacgtgagcgtgacctagcgcacggggcacatgcacggtagcaattccttttggcatggcccatcataggcgaggggtagatttcaagcccattgtctcattatccctatccgttgctgcatatccaggaggtttgggccattcaccgtgaataaagtgcaataagttcactttaggtcctttaatatattgctaagtatgaaattcatccctaacctaaaatactattaatttacaaaaccggatcactcaaggtcctacacaatattatgcccagttttagctgatgtgacatgctgagtaagtgatgtgaaatctggcgccgcgacacacgaaggcatgggaggtctacttaatttcagtgcaggttctaaatcttgatgaggttcggatgtgctagttaatttaatcttgcaactaataaggatgacagaaagaattgaaccaatcaaccgatacagatctgcatcgatccaatggttaaaacgtacatcgactggaagtccaatgcaggtagatttgagtgtatatcgattaaataaccgatacatctgataactaaatcttaaaataatgataactcattggctacagcctcgatgaaacattgcaaaaaaaaagtcctattggcttagggcatctccaacagagggccaaataggttcctaaaaattattttttaggattttggttaaaactaggcctctaacagattgtcaatcacggttctaaaatttacccactcctaaaatcggtgccaatctcatcagaatttgggaagctgtacgccctaccaatcccaccaatcgcgcccattttttttaccgtccgcgccattttttttccgcccgcctcctttttcttctcgctccttcctcgcgtcgttttctttctcgcgagaaacagcgcccacgccgccaggctagggttatgggagctcctcgcgctagctccgtcccgatcgccgtcggctgcctatccaggtcaccgcaagccggccgtccaggtcaccgccggccggccgttcaggtcaccgccggccggacgtacaggtcaccgccgggcgtgcgtccagggctccgacgggcgcttatccgggggattgccggactgccagccgtccatccaggggcagcgtcgccggccgtccgtcaaaggcaccaccacctcgccgtcgaccgtccatccaggttgccccgacgcaacgtgtgctgttactcattcacttcaaggtattttcagagaaacaactttattcttttcaagcttgaagttcctgtactgatttccccacaccgtcaatcccccacatagccatctagttcacagggatatctcccaattttttgatggagatgcaaagctcctcccttaaattgtttaccaaatcactgccacatacctcaattgtagtacttatcttctgaataatgcaataaaaaactgttgtcctgtcctcttcaaatgatttccaatggatcaggcatcggtaaatgaggtatgcggcaataggccttgcaatagagaaacccagatcttcagatatgcacttgatcaacaactcatggatattcagaaaaatatagaagaaaatgttgaggcacaacacctgaacgaattgtgatactgcttgaaaagaagttcagaattactaagcatcatacctgttgctgcttctcagcttcaggatcattcaggccagtcagttgagaattgttctcctagattgaaattaacttttgttaaataaggaactcattttacgaatatactgatcaaatataatttgaggattatactaacatggatgtcacaaaagttactggcctataccaattgttaattcaacagtgtttgcttgcgtttgtgttcagtcagatgcattcttcttcaggttgtatagcaccctaaattaactaaacaatgagcttctatatgtgcagggttttgtttgcttgcagcagtatttgatgaccttttcttagataatttaagtgtttgatgacctgaccagtcagctgctcattggctagatattgctattagcttctagtatcttctgaccttaactttttagccttttgtaatggattcagtgaacatgtctgaattaaattgcagagtcccaagatgctagtacttctacaaacgtattagtagtactgttcttatctgactactaaattaaacaaacatgtactattcgtaggtcctattgataatggaagaagaaggattctatactaatttgatgaatgagggcaacgattccttagattgggatagtttgagtagtatgcctgtggaggatgatatgagtaaccagcttgatgagaatggcatgagtagcgagcctgtcacgcagcagttcccaactgctgagaggactaccgtggctagaccaaatcaaaaaagatcgaagaattttagcgaacaagaagataagatacttgtgtcggcgtggttgcatgtaagtttggatccagtgctaggcacaaatcaaactcgtgctgcatattggactagaatatacgagcacttctacaaaacgagtaaatccacaccagatcgcagccaaaattcacttatgcatcgttgggaaactatacaagagaatgtcaacaagttttgtggatatctgagccagattgagggtagaaggcaaggcggggttagtatacacgacaaggtaatacatagttatgtagcttgtgtttttatgttactttataaataaaaaatgtgatgtttgctaactacattcaccatacttgacttgtgcagattgctcaggcaattgctgtatttaaggagttggaaggaaagccctttcaattccttcactgctggtctctcttgcggtcacaatctaagtggcatgataagatgaagcaaataacatcccagaaaccctgtgccaccaacagacagaagccaagcatagatggttcagcaaaagctacacccacaaatgatgaaactaccaatcatgttggtgaagataatgaacctacagagactgaagagccaaagagaccgatgggtaagaagagagctaaagagcatttgaggcgtggtgaaacatgcacagatgcttttgatcatttgtgggagaaaaaaaaagaagctgatgcagagaagaagaaggagagagatgagaggcaccaaaagtcatatgaactagataagcagaggcttgagttagataaaaaaaagggtcgcgaatgagacggatgagatacagttgaagaggatgttagaagaagagagaattatgacaatggacatttcttccaagcctctctcacagcagcagttctacaagagtgtacaagatgagatcatcgctcgtcgcatgaacagttccggttgataggtttgtgtttcataacagtttacattcagttgagtgcctgtgttcatgcatatacttgttcttgtgtccatcttgttgaaatgctgcctttgcacagttgcactacaccatctgattcttaaatatgttgcatgatccactgatacatgggactacatatatttttaaatatgctgcatgatgcactgccaaatcttggtctgaaccttggtctgtacatgtattctgattcattttcactccatctcattgctatcaacagggaagccaccagatcagagaatgggagggaaggagatggcaatatttggtggcaatcgtacttggagttcagattagttagaaatttacctaggtttactaagtctgtgcaatacaaactatttatattcgcaattgtgtctattttttgtctctaaattaggtgggtttactaagtctatgcaatgcaaactatttaaattcagaattgtctattcagtagttgggtaattccctcatcctgctgtcagtaatgcttctgtctttgttgctgttgacagagtcagaagcctcatatattttgaaatttgtactaatgatcggtcatcttgctgacaagctgatgcatatcttgcaaattatatataagctgaactgtacctatgactaggttgacaagttaaaggaagtgcacttttattaattctcctgtactattcttaaaccgaacagtacaccatttattcaatacatgaaaaacaaattaagatgatttggcaaatcctcacatgtatattatttattacatggaattcaaacatataaataaaacctcaatatttatccggataatgttgccacaagtgctccactaggtcttcacgtagctggtagtgagtttcgtcgtcccttatttttttgtgcatctggataaaatcatcaagatcaggtatttcatcgtgggacactgacattttctcccccctctgggaaccgttcttcccaatcaacttctccctcatcttcaataatcatgttatgcatgataacacaagctttcatgatgtatcctaaggtcttttcatcccaatgtcgagttggccctcgaacaatggcaaatcgagcttgcagaaccccaaaagctcgttcgacatccttccttactgcttcctgtgctttggcaaaatattttctcttgttgccatgtggttctggtatggtcttcacaaatgtggcccaagaaggatatatgccatcagcaagataatatcccatcgtataattgtgaccatttatactatagttcacttcaggagccttgccttcagctagctttgcaaatagcggggatcgatgaagtacattgatatcgttatgagacccaggcataccaaaaaaagcgtgccaaatccagagatcctttgaagcaacggcttctaaaattattgtaggctcgtgcacgtgcccttggtacataccgtgcaattctgtagggcagttcttccacttccaatgcatgcaatctatggagcctaacataccggggaaacctctgtcctcccaagttcaagtaatcgagttgtatcgttctcattgggtgatcttaagtattcatgttcaaaaacttctacaactgctttcacaaaccttctcaggctctctatagcggtactttctgcaataccgagatattcatccaaagcatatgctgctaaaccataagccaactgacgcactgctgcagtgtccttttgatgacaactgaacccaattaaaccagctgcatttctcttctgcacaaaattgtcatcgtgatcctctactgcattcattatgtcgagaaacagaggcctgctcattctattcctgcgaatcataactaatgagacatgcatatctatgcatataacaaaaataaattatataaaatttacttatacaaacctgcgcctgaataaaactgggccataggtaggattatcggaaaaatagtcttggtataatctcaagtgccgtgcttctctgttgcgatcaatcacttcatgtcccatgacagacccaccatgtcttggtgcattgacagagtgccaatagctatggacgatttgtgccgtggcaaaaaaaaaatcatcgtcatcgtcagacgatgattcatccacgagctgttcaaacgaggagcgaggtcgactcatcttggatcaaatcaaccgccaaaccattattcatcataataaattaagtttttccccttgcgacgttgtcagatcaaattaaaaaaaatgtgattgaccttccgtttttccaaatatttattcatcatatcaaattaagtttttttttccatcaagacattgtcagatcagaaacataaaaaaaggaaatagaacaaagtaaaaaacatggttgctagcaaaattttgctactcacgcactgcacaagagcttgtgcctgtcaccaatcgttgctgcttgctgcagttgcctgattgagtgaagtgctaacatcgccggccctgacagaggaagagctctgattgagtgaagtgctaacgccgccggcgctgacagaggaagagctctgtgtgcgtctatagcactgtgtccttcgatcaatttcgtatatcgctgcgtctgatatatagcctcgccaacggtatcagttgcgatctcgcgcgcgactaggatgagcagccatctccttccgtccgcgtgcgtcgcgtcgaccatgcccattcccctccgcatccgcacgccgcgatctcctcctcgcctctcacgcgcgacgcgatctccccctccgctctcgcctgtgattttaacgagcaggtagaaaattagttgggaagggcccactaatgatgatgtggaaaaattttaaaattttgggaaccaaattttagtcatctcttggagaagggggtgtattttaggctaaatatgttcttggctgtctccaatacaggatttttgggagtttaattttagtcatctattggagatgctcttagtagaatcaaacttattagtagcaatataatagatcggacctaactgagacagtataatattgaaaataataagaaaaagatctagttagccgatagatctacaaaaccatgatggatatatcgaaccaatctaaaacaacaatgtgattggaaaaacaataacttactcagaatatcggacctaactgcgagggagtcctaactaaaccgatacgactctaaataacgatgtagttaaaaaatagaaccaatgtatcagatagacaacgattgcaacaacttgaatagaatgtcatacctaactgagaaagttctagccataccgatacaagcgaagttgaggaactacttccttgttggagatcgaaataatgtagcccaactcgaaaaagttctagccataccgatataagcgaagttgacgaaactacttccttgttggagatcgaaacgatgtagcctcacttgatactaagaactcgtcggaataaaaagtggtggtattacaagtggagatgaatagatgatttacaaagaccacaagtgtacgtatttatacgcttgggttgatacaagtcttgatcggacaatagataagacacctaacaagaaaatgaaaataactaatcctttctatttaaaacatataatacacatatgaaactgccctaccgtggttttcaccatatgatcagcttggctggtaccgtgctcggcctagcccattactagaatctagtccgtcgacgtgaagtgctgaaagcttgggccgtttgcctttaaattccgtccggatttgctgaatcaacaaatgcattcgctctgacgccctgctgtcttgtgtgtgcacgtgttcacgttgatctgtcatctttgcagaatttttcatctccatatggaatttcagctatttgttgtgttgggaaaaccaaaggaccatttctgatactccccctattttatattataagattttctagcattacccatattcatatagatgtgaataaatctatacacatatatatctagattcattaacatccatattaatatgtgcaatgttaaaaagttttataatatgaaacggagtcagtaccaaatactgagtcccatgaaacaactcagaacacatgggcatatcggcagggagcaaagggaggctattattcaactgtactcactgatctcataatcacttggctaaaataaaatcacggagaaaaaggcgtgctgctgatagtagaacacaccgactgcaaccgaatcgccacaaattagcaatcatcaacatacaaaagtatattcacgaaaacaagctaaatatcccagaacacaataatttggagaaaattatctctcaaaatgcggcacaacggtctatcatcagcaatgttcactcatgccggccgcacgtacggccggagggagggaacagccacgtccccaagctacccactggccgtaatggcgtcttgaggaacagctgcgaccggcgttccctcatgtcgtagatggtgcagaagaactccaccgtccgccattgctggccgccgtagccatcggcgccacgatcctgcaagaagaagatgcggtccccaatgttgtgtgccttgccctgatggacgtcggggacgacgtggacagaccgggatcaccagcgcccgacgaacggcacgcggtcgccgccgacgctcctcaccttcctccaccgcgaccccgccatgtccgccgcgaacacctcgaacttggtctgcaactctatctgttcggcggaatacaaagggacgtaggaatcgtcgtcgtcgggatacaaaatgacgttggattgttcgtcgtcggagtatgatccctctctcgtgctgtgattctctttgcggaccatgagcaatgcgccgtcggactccaccaggtagagcggcggctcggtgcggcggccggggcttatccggacgaggcaatcgacgctggacacggtcggctcgccgccggcgtggctgccgtcgtcgtcctcgctgatggagatggagaggaggtctccgctgttgacgagggcgtggagctttccttggtaggagaccatgtcttggatctcgagtgcttgcaatctgtcatgcctgcacgaccacgaggctgaccccggccggcacagcaacagctggctcggcctcttgccgacgacagcagcgacgagggtaggcgaacacacgacgagcttctgcagcggcggcggcgtgtcgtgggtgaccggtgggtcggtgggcatcctggggagcaccatggtgttggccgtggagaacgggctcaccagcgtgtacgcgccgtcgcggcgctggaagacgagccactcgccgcaggagctctgggcgtgcggcagctgctggtggcggtggagatggagcggcagccgccggaaggcggagtttggcaggctgtagaaggtccggtcgggcaacgcgagcatgggaattgccggggcagtgggttccgccgcgcgctgatacgccactggcggcagacggcgccgaagcggacgcggtcgccgtggcacaggatgcgaccgaagatctcaccggcgaggtccgtcgagagctccgaccaagatcgtcgtggcgcgtcctctgtcggcgacatgttcggcgacgccgaagacggcgagatataggtttcccgtttccgtgtgtgtggactgtggatggatcgagcgctgacgagacgcgatacgtgtgccgcgcggatacatcatacaagtcgcagctcatcacgacacgcgaattccgatccgaggtcaaattgggagtgctacgcgggaaagtagtttatacatttaggtactagtcccctcgtctcataaaaaaccaaccagtattggatatgacacgtgctaacacatactacgaatctggatactagtatgtgtcatatccagttctagattcgtttttttcgggacggagggagtacaacactaggccagccataaaaaattgaatattcatgacacgttttttaaactgttaaatgatttgttttcatgcgaaaacattttatatggaagttgtattaaaatatcatataaatatatttttcaattttatagtaattaaaactcaattaatcatatgttaataccaccttattttgcgtaaaacatttaatcttcatctacatgaggttcaaataccatgtatgcatgtgatttaggcagctatataaagatttcataaaatttaaaaagttagattataatgatataatatatatactatacaaatgtataagtctaaattcatatataaagaaataaaaataataaattttacatatattgtataggtactatttattgctttgattttattattttttctctagttcgagactaactttagccttgcatatttgtttatagactcatattatcctaattgatgttattactagtatttcttaattcttttataattatctgaatcgcatataaataacaggttgccatgatatctgggagtgggtgtagaaaaaccttgtccactgctcagcccagcccagcccagccgagatagaaggctagcccaccaacgaaggcctgccactttgagtggagtggtggaaaaggagtttaccgaagggcgaaggggacgaccggaggggggaggcggggagtggggagatcgggatcggcgggggggatggcgtcgccggcgaaggagcgcgacggggatgggaggcgggcgcacgcgacgatggttggggtgcagttcatcaacgccgggtaccacgtcatcgccaagcaggcgctcaacgtcggcgtcaaccgcgtcgtcttctgcgtcttccgcgacgtcctcgccctcgccgtgctcgcgcccctcgccttcctccgccaccgcgggtcgccttcgcaggcccgcacgcctctcacctggcgcctcctcgtctccttcttcatccttgggctcacagggtaaaccccacccactcccaacatctcaggtcactgaggtcaggaactcggtagtggagttctgaagcaatgcagctgctatgctctgaaaaattcgtacttcgatgaatccactatgtttttccctgcagcatcttcgccaaccagcttctcttcttgttcggcctcagctacaccaatcccacatacgccgctgcaattcagccttccattcctgtcttcaccttcatcttggccgccctcatggggtcagtctctttctcactggtttgcgacaatgcatatatgttcatgcttctgtttgtcaaggttaagcattcttgtttgtttcagcactgaaacggtgaacctgagcacacatgagggcagggccaagattggtggaacgatcgtctgcgtgatgggggctgttttcatggtgttgtacaggggtcctgctttgttcggtagtggcgagctcgaacttgatgatgctcatagtcatggtgtcattgctgacatgtcacagcctgagccagtcggacccttgtccattgtgtttgggctccaaaagtggcacattggagtgctgtgtttgacagggaactgtctttgtatggctacttatcttgctttccaggtattactgatttttcagcttgttaaagctcaattttgcttgcactctttgatgttttttttttggggatattgggacgcctggaaactttaatttatgataaaagatatgagtagagctagttctgtaagctaagattactatttaaaaagggtgactttagaaccatgaagtttgtcaagatcattttagctggataaatttcagtgttgacaatttcctcaatcatcatagttttgtccctcttgaaatttaggctatttttattcacttcctaaaagggcacatcctaattagccactagttttaaaaaattcttgtatccctctctttccacacttgccaccaggctctgatgattatgccatacaataatctcttcattttattgtcctgttgctacccaaacatgttctatcaatcacacagggttactgattgtgcgtggtcgaattgtctattttaatagattgacgaaattctgcaaggtgatttgtcatgggctgatcagatcatcagattatacttcaccataaaaacaaagactagtcatttacaggagaccatctatctcactgtactttgaaacttatgtttgtgtggtattcaacttgactttagtatcttactcctgtttgagtactgaaacttttatgcgatcagcgtgctctaacctttcttgtttttatacttatcatattcatctatttctttttcaggcgccaattttgatgaagtatccgtgtagtttgtcattgacagcgtactcgtacttttttggtgctgttttaatggtcatttcaggagtttttgcaacaaattgtaaagaagattggactttgactcgatctgagtttggtgctgttgtatatgctgtaagagttatctcaaatttatttaatgctctgacgtgtatgttcttagtgtgcattttgcatggcttaatatccctttggtacatatatatgttagtgctgatgcagtgcattgggttgctgcatgttccttgaattgagattctgcttctatatgtggtcctattgaagaaaccttgcattagtttttacaggccataaaataatttagttgctgcataccgtgcataatattgtttgaatgaaagtgtgttttatcccttgttgcagggattcatttcttctgctaagtgtgttttatcccttgttgcagggattcatttcttctgctcttaatactggtttactgacatgggccaacaaaattttgggccctgctatggtgtcactttatatgcctcttcagccagtggtttctgctctactgtcgaagttttttctgggaagctcagtttaccttgcaaggtaagaacactgttatcactcactctactttttaatcacagttacaattttttaaaaaaactttctcttgcaatgtgaacaatactgttttggtgcctcatggcctcaccttcctggtgtaaatttgtaatgtatgtttgcatattgatgctgagatattggctatttgatgatagatcaatagttcaagcttctagttaatctatcaattgatcagggtacaaatagttttctatcaatccatttttctcatttctgttgatctaaactctgaagttaagatctttgcttgcttgcagtattattggagggtttctgatcatctctggtttatatcttgtcacctgggcccggcatagagaaaagttgacaattggagtaccatatgaaacatgtgcatctgagttgcttgaaagtacttctcatgtcgtaaagagcagaaacatggcctcggtaccctatatatcgctttctaggccgtcaaacgttccacatgaatcataactcttaagaagttggtcactgctatccccttccttactcagaatatagatagagaaagcatgcattagaaaacatgaagtgccgcaaagaagattcaagtgaacgtagttaagactatatgttaacaatgctgtcatctgtccttggcttagttccccatatggcttctcttcagaaaacagcattcttattcttcatttcctaggagaagttgatttgtgtatgagtaaagagaggttatgctcatttagttttgtgagactaacaactctgaggatgctgcctgaattgactgtcctttcaccaaatgcaaagccagctcagaagctccgtcggcttagtgaatccccaacaaggcaacaatacgtatcctgttaacctcctgcatatgtaattactctgtaaacattatacatgtgcgcaagtcagagcggttaaatgacttaaaaatctatgtatctcctaaatgctagtagtacatttgaccagagtacaccatgtactgtataaattcagtcctggaaatcatgcaagttgcaactcttgaattgatgtttttgtgagattgtccgtgtttgtttggaaatctggaattgcttatttttcgaaattcttagtccacatcatatggtcccctgtaacacatgtttatcagcaattggaaagcttcagatgttattatgttttgtatttcaaatcatcgtatgtatatacataattttctcaactgtgtgtgtacagtatcacactacgtttttttcccactacagtaattcgtgatttcatatggaaatgtgcatcggagtcacttgaaagtacttctcatgtcgtaaagagtggaaacatggccgtgccctatatatctctttctaggctgtggaacgttccatatgaatcataactcttaagaagttggtggtctctgctatcacttcctttgggtatatcctgtcctcccttgctcagaacgtagatacagaaagaagtgctgcaaagaagattcaagcgaaggtaggtaagactatgttaacaatgctgtcattatcctcggcttagagtccctatatggccttctcttcagaaacaacatttagttttgtgagactaacaacacttagaggttattctcatttagttttgtgatagtgagactaacaacactgaggttattctcatttagttttgtgatagtgagactaacaacactgtggatgctgcctgaattgactgccctgttaccaaatgcaaagccctctcggcagctccttcggcttgttgaatccccaacaaggcaacaatacgtatccagttacgcttttgcatatgtaatgtaagtactctgtaaattatatttgtgcacaagtcagggcagttaaatgacttaaaaaaaactgtgcatgtcctaaatgcttgttcatttcaccaagtcatgccagttgcaactcttgaaatcgatgtttttgtgagattgttcttgtttgttgcaactctggagttgcttatttttcgaaattcctagtccacatgatggtcctctgtaacacaagtttatcagcacttggaaaacttcagacgttactatgttttgcatctgtgctcgtgtagttaaaatcattctttcatttcatatgtactctacataattttctcgaagtatgtgtgcacttatactacgtgttccacagtaactcgtaatttcgtatggaaaatgtatacgtgaattctatacattgctacgttggtttgtatcattggtgctgtgactggagctcggcctgcgtgacgaacaggccatggaagccgtaggggacgcgtccgggcagctgcacctccgcgacgatctccaggtccggcgaccgcgcgtccatcaccacgaaccggttctcgccggtggcctcgtcgtggacgtagcacaccaagtacccgtcatcctcgttgccgttgccctcgacgtcgtcggccacgaagaacggttcgccggcgaagcacccgggcccgaagtcgcgctgcgccacggtgcagtcgccctcgccggcgcggtcgaagtcgagcttggccacgccgccgatcttgggcgcggggtcgccgacgccgaagtagccgtacctgttgcggcggccgaggaaagccgggttgatcacggggaagtcgaagttcccggcggcgagcggggtgcgcgtgacgacgccggtgcggaggttgatgcgcaccttctcgacgcaggagtgcactagctccatgtgctccagggcgtgctcgatggagaggacgttgggcgccaccagcaccagctcctcgccgccggcctcctcccacgcgttcaccgagtgcatgatgttgaagcccggcacctcgaaccaccgcatctccgactcgtcggtggcgtagcgcgggatcacgccgaggcggggcaccttgccggggtccgaccccacgggcgagccgccgcccaccaccatgtccatgggcttcatcacgatctggatctccgggaagatggcgtaccgctcggtgatggcgaagtcgtgcaggaacgacggctgctgcacggagaagatgggcacgtcggcgcccttgttgccggccgggtcgaaccggaagtacgtcacgaacggcggcacggggccgtagcggaacgcgaagagctcgccggtgacggggtccttcttggggtgcgcggtcatgcccatgacgaggcggccgccgaagtcgcacctgccgtgcgtggtcacctcgccggtgtccgggtggacgcgcacggcgtaggggaggtcggactcgccgagcgcgtagaggcggccggcgaagtaggcgaggctggtgttggcgagcccgacgccctccaacggattcatctgcccggtcaggaccctggccgccacgacggcgccgcgcgccatcccggccacgccgtggaagccggagaagacgttgggcaggacgggcgcgccggcgtcgcgctccacgaggtacttgtacgtctgcacgtagcgcgagcacaggacggggtcgtcgccggacgacgcgggcgacgggaggaggagggagtgcagcatgccgtcgccgtcgaacaggtggtgcggcccgcgcgggaggtgctgcgggttgggcccgttgcggatgtaggcgccgccggcgaggcagcgcgggatggcgccgcgcacgacggggcagggcgtcggcggcagctcgtccacgggcacgaagttgctggtcagcacgttccgcgggtccaccgccggccgaagcgccggcgggtcgatgaacgtgttgatcacctcctccagcgcgttgcagaacgtcatcggcagcgaagcggccgacgccgcggcggcgggggcaggccggcggcgaggccgagactggctcggcgccgccctgccattcgtcgtagcaataacagttctcgtagtcttggtcttggctaccaactgctcgtcctcttgctcggtctgcttcggagtgcgggtggtggtcaccagcggggaggtgagaacggtggtggaggcggcagccgatggcggagcggcggaggcgttcttcttcctgccatagctggggctctgtggagcagcagaagcagcaggagggatgtaggaaagcctcatggacttcatggtgagtgagtgagtgaccgagcagtgagcagggcaaatcctttgcatgctactactactgcactgagttgtgagattaaccgtgcggctatttataaaggcctctcttgctaagagaggctgtccctttcagattcgtgctagaccgggaagaaagatagtacaagtacctcgtgataaagatactaatcactccgtacccatagaagtcgtttaggataatttttaagtcaaactttaaaaatataaatcataaataactatcaagttgttgagcttgaaaatgtaaaaattatatgaatagatttgtcttgaaaaatactttcataaaagtatacatatatcacttttcaataaatatttttaatgaaacaagaagtcaaagttgtgttttggagaccgtgtcgctgtccaaaataacttcctttacgagtacgaagggagtacactactactgtaccacttcagacaagggaaagatacggcgtaattttgtacagttgtacctgtacagttgtacctatgaactatgaagactatttgactagtaaaacctggacgattggcaagacactctagtaagattctcaaaaaaaaaaaaaatcaagaaatggcattagcaagcgcccaatttcaaaaaaaccatcaacaaatacaagttccataaaatgatatcgtgcgagctactttattccaaaaatatcattgccgttaaggtttcgccagcaaccctccgttaagtgctataggatgaacagtgtatttaactgtgtgggatggacgaaaccctaacgacgatgatatttctgggacaaaattatttgtatgatggtatttatagaacccgcactcatcgatggtattttttggatttggttgtttgtcaacgacatttcttgaattttctcgtgctcaaatggaaatatttttcaaaatattgatccctcttttgatagctagttgttttatttcaggaatgagattttcatgaatatgcgtagagtgaatatttctctcaagcaaatagttgctgattggttacaactattgtaattttaatctggacatccttttcctttaagtcttttaaataacctttttcatacttataaaattatactaccgagcaaatgcctagtagttgttcctaaaaaaattactctagtaagaaacttcctctgttttatattataatataagtagtttttacctttttttctaatcaaaactttttaagtttgattaagtttataaaaaaatgcagcaaaattttcaacacaaaacaaacatcggcctgggagatctgctgtgcaggtccaaagattgttgagatgcgggtgtgccagtcagtttggtcctgcaactgacaagatatgtaaacagtagatcaaacagccgatcggctgacaagccgatgtagtgattccagccgatgccgataccaaccgatagcgatagggtttaagcaatcggctatgtgtctaatgtagataatgatataaaggcaatcggctgatgatgatagaatacaacaacaatataatccaatagaaaccaattggctatcaatatgatagaataagcactggtctgaaggctaaagcatacatcggctggaggtccgatgtcataaaatccacaagattagattaaacgataatatctttgttgcgatcggctaaatccaatatgtatgtatatgcaatccttacaagccgatgcaacgtccagataactcatcggctgaaaccccgataaaacccttattggcagtcaaaaagcaagctagagattatggttctaagcacgacttagtagatcaaactcaactgatgcagcactaagtatgaaaagaaacacaatatctagacaatcaagccgttgactgagttttcagggtggtagatgtctaagctaatctaatctagcaacgcgatttagccgataccgacagaaaccctaaaacgagaagcagccgatagagctaaattgatatgctaagactagattaacatagacatatgataaataggtaggcaagtatatcatccaaaccagaacaatccaagagatcgaatgtcctgatgcagccttaaacgacgccgacgtagacgatataattgtctgggccgacggaacattggacttaccccttagccggagatcgaacaccgatgcagccccgcgtcgggtgccaagttccggcggaacgtagaaacaaaagtaaaagtaaaaatggtggcgatgcgccgaattgtattgatcgtgaggatagattacaatgaccctgggtgtacatatttatacccatgggtagatacaagtccttgtcggacaaaaaagaaactttcctaaagataaaaggaaaagataaagtccttataggacactaaacacactttcttaaagataaaagtaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaagacttcgaagccgatgctgactctaaaccgatgactactccgggcttactaaatttcactgttaacaattatcgaaatatattcaatgttatatttaataaaactaaattggtgttaaaaatgttgctaaatttgaccaaacctaaataaggttgacaaaaaaaaacaaagtgtctataatatgaaactgaaggagtatactataaatctataatcaatctaaaatctggtgtatggatacatgttggatatacccgtgttggtattgcctacctagaataggatatatttgcagtactctacattttcatctccaaaggcaatcagtttttttgagaacaatcatctggttttgcatattttgcgttacaaacagatttcgtatttaatttatggtagcttttaggcagcatgttggatggaggttaactttgcgacaactccatttgccataaggcccataactgggcaagccacacaaagggtgtgttcggcactccatcttctcaacccctctccctcgttttccgcacgcacattttttaaactactaaacggtgcgttttttacaaaaattttctatacgaaagttgcttaataaaatcaaattaatcctttttttaaaaaaagctaatacttaattaatcgtgtgctaatggattgctccgttttccgtgctggatgtttgggttggaaacctgggttgccgaactgagccttaagtgtggccaataatttattggctctaactatgacaaactttgactagaaaaatgagaatatgatgcatgggccaatatgctaatgaagtgtggtttgacttaactgtgacactcaaccaaatattaatctaaaaaattatggcacgcctaaggtttgatgtggcaaaccatggccaccaaccagacagctccgtacctcttctagtatcaaaaaggttattgctaatatttcttttgattctaaataaccattttaaccttctcaactctttcctaaacacaggttattttataacttataagtacctatcataatttctaacacgtttagctcatcaaataaatattgtcaatcttatatataaaaggctcatccttttcagcactgtatgacagtatgaatgaagtataacaaagttcctttagttcctttcttatttcttatgcacaaatctaacacaagttatatctggaattaaggcgagcaaatatgccgacaccaaattaatatgggaaaaactaagaaacgagatgtcagtgagtgcaaataggaaatttttcattgaaatttacgagtttgaagaatgaattaggttaccaagtaaacacaaatagagggagtcgatagtttttaccagaatttttatttctatctaaaagtttcacaaaccatcattttacgaattgggtgtggattggtagggcccacactgtctatatcgactcttctttttactcgtcccctgctaccatacaattttccttggtcgccatcgtccatttccatcttcccttcatataatatctacacagttatgtatgaacatcactagagaaagcacaagtggtatgatggtgaagttgtgggtacataactctactcagcagggtttaaattctggtactcacaaatattacacacatatagatgggctttcaacaagtatttagggagatcagggatgtaacgctggtttatatcacttagagcatgtgttaggggacgcatttgcagatgaaggcgaaataactcatgtaataattagattgataatcaagagattatatatacaggagagagtccaaagccttccatattttaactaccgatttataaaaacaaaaaccagggagagaaggaaagcgactcaaataacccaaaacaacctaagtagtctatcccccctccacacacacacacacacacatacaaatcgtattgggaggacggatgttgagactagaccgatactccgtgaatacggaagtgggtagaccctttgtaaaaacatatacacactgtatagtgtcaggcacatgcagaacgcaaatttcaccaagagctactctcttacgaatgaagtgtaagtcaatctccacatgcttagtccactgatgctaaactggattggaggagagatagacgacagaaatgttatcacagtacaccatggtggcacgctagagtagggatccaagctcagcaagaagctgtcgcaaccaagtagcttcgacaacaccattagcaacggcacggtactcggcttctgcactggagcgagagacaatatgttgacgcttggaagacacgagacaatattatcaccaataaacacaccatagccggaagtggacttgtgtgtatctggacaaccagcccagttagcatcagtgtaaaccaccatctcagctggagaagtttgatggagtaccaagctgtgatcaagaataccatgaagatatcaaataacccgcttaatcaaagcaagatgtggctcccgaggatcatgcatgaaaaggcaaacttcctggacatcgtaagctatatcagggcaagtgaatgtcaaatactatagagcatcaacaacaccataataattagtaggatcagtaacagaggatccatctccagagagtttggagtgcaaaaaaagttcttgatgatatgaggggcaacaatgacgttcttaagaaggaaattacggaagggggtgtctaaagatatagagcaagtgacagtaatagggataacagaaccattgcctacgacaatatgggaaggagtgaccgtacggtgtggagaattagagtgagcaagattaccgacatccaatgtcatgtgatcactagcacaagtgtccatataccagtttgtcgatgatgggggagtcagcgtcatatagttgaatgcactggcgagggtgccctgatcctagtcggcctaaggaggcatggtctggcagtgccagtgtccactgctgagaaggaggcaatccataagtaggtaggccggctgaaaagcccatggcgctagggtgatcgacaacaagagcgtgcagacgaggctgtgatgtgccggggaagaacgagtgcataggtcacaccttggacttagctggcccaaggatgctagaaagtcgacggccagccaggagcagccaacgcgccagtgctaggagagttggtgctgcttgtgttgttgttgtcgccgccattgcttttcttgtgtcgatgattgttcggataattgccgtcagaagt

SEQ ID NO: 69424 - DNA, 34873 bp, Oryza sativa
aagtcggcgccggaggagcagtccttcttcgacgacgtcacccgcaagtgcgccctcaccaccacgcaggcaagctccatccccaccccacccacccagcccggatcgatccgggttcctcgctcagatctggtcgacgcgagtagtgattgttctagcaaatgcggttgactgatcgtgctgaaatcctggtgcttgttttttggaatctcggtgcagaggctgtacggcttcgcgatatgcttggctgccggattgacgtgcaccttcttggtaagtttcacagtttgatgctgtacatatctgtttgtttccacttcagggtgattttttttttggtacaaagtaatgtagggagcaatgagattccatgctttctgacgattgacgatacttcatccttgcagtatgttaatgcagccgtagtttgattcatgttgttcgaattgtcgtaatgccgcgtttttggtcttggactctcagttcaatatatctgattgccgtagacatgcttcacacagttagcagtaaccatcctttttcaatagtaggacagggtgcataattgttccccatgctttttttaacataaagttctcaaaccattttctatggtactgtttttgcctttgggagcgcaaataaatacctcaaatgttggaagctgtgtaatttccgtgcagcgtacaacagttagtagtactaatacttgtatcacatgatatttctgatgatctagctgtggcagaacaagaaaaacacacaataatatatttttagataatgggaaacacacaataatatatacatgattgtacttcacattttacttgggtttcatctctagtctagttcctgcagcctactctagcttgtttgggactaaagggtatccttttttttgggcaactttactaagggctgttcttattatattgttggttattcttcagattttctctgtctaccaatttttgttgtgtttgattttcatttccctccagccactgtgggttatttgatatttttgatctccattgcagtcaatgcttgttttcttcaatcctgtgaaattcggggtaacattcacccttggcaatttgatggcacttggaaggtctgtttcaaagttccatttaatataccatcttactctattttcaagttattttattacttgcctttggacaccagtaaaatcagaatgatgtaaacttcaagaaatatgggtgttgttcacattcgcatatcaatgcaaacatacaaactctattgctcttcatataatcatattctcatcttggatgctcttttttttcttttcttatagatggggtttcaacttgttgaattatgtctacataaatgttaacctgtactttaactttgccatggtatgatattttccgttacaaaaatactatgtgtacatgcttacaagactgtaatattctgccatttctccgctaggtatttatctttgaagccaccaagtctttttttactcatgtcaactaatgatgggatcatttgtttggcagtacagcgtttcttataggtcccaaaaggcaatttgacatgatgcttgattctgtgcggatatatgcaactgctgtatacattgcaagcatcataattgctctgttctgtgctctctttgtaagacaattttaaatttaacaggtgtaaattagttttgtatcatgcttcaatttaattgtataatatgctaaatggctctattttttatttacaggtgcacagcaagctgctgactctacttgccattatcttggaatttggtgctcttgtttggtaagttgaatagcttccactggatggtttttagtcatctgtttaactaggataatggcataacttttgactccagctagccagccgctcaaacatgtttcgtactgtatttctaattttctgtacatgaataggtgatgctgtaaatcgccaaagtaatattgcctcattctttaacatgggctgaaacactttacgggctataaatgggatagcagcatataaacccaatatagggttaattataagtgtcgcacgatcacagggatagaactattctcaagctataaatgttggtatttgcaggtacagtctaagctatataccctttgcacgctcggttgtttcgaaggtgatgacgtcttgcttcgacactgaattctagaatgaccatcctgatctacatgttgttgctggacgcatagatgatatatctgtaatatactgtgtattttgatggagaagtggagtgggggtcatcttctccgattagcctgtgtagtcattctgatgttgtgaagacacacggatttgtgcgtcttatgctcagagatcatgtcatcttttcctcacttcccccccttcttccccacatttgtacatggtaaccacttacactccgcattcgaacgtttactgtgcagtttgtttggattgtcctaggttgctcctggattttcctgcttctcaagttcttccagagtgcaactttggaatttatctcgtttggcttagctctaccaggcagaccttaagcgttggtgataactgataactcttcaatttcttgtgttacgatcttaatgataacttgttagctacggagtatatatgtatgaccatatgcgtcatattgtttagagcaggtacaatagcagactattagccagctataaacatattttaatgagataaaagatgagagagaagagcagcgaactacagatctgtagtcagctgcagcacggactccaagacgcagtgtgtatatggtaagtgggaccatgtattaattgtatagtaagcaaccattgtatgaattagctattaaattagctatagataaattggagctagtagtgagctgtactgttaaacttgctcatagactagtctgtctggatcgagaaattgcagtataaagaactcagtaacatggatcgagaaacatgcaaaatataaaagtcatttccacaagatttgtatttcagtcctgtaaaattccagattttcctctgcctttccaaaatgggctccactatcacgtaaacactgaacaacaccaacattttgacaacagcattattggcatttccttccccctttcaatgcgtttcattgtttctaagttttttttttacatccatcagcagtcatcacaattcttggacattacattttcatgacaaccagggttgtctgtacgacacccataaatatcccctgagctatatactctttccaaaccctgctgcaaattaagtaaagagcgtgggggtgctgaacattgcgctggagcctttttaactagcaatagacactacacacaatattcctttacaaggctaatacttacattattacatctgggattagattttacagggttatacaggagatgtgagaaccaataaatcacatccccatggctcttgaagaggaaagctcggcttctccatccgcttcgcttcccgctgcatcccctgctacctgcagtattttccccaaggaatattatagttgcagattatatgcatatgcatccatcagtttgtagaattaagaatccttacctttatctgggagagataacgttcaaaagcaccatcgccataaaggatcttagctccgcagccaggttggtccactgctccgactgcgtcttcatctacaaccaccgcatcgattcgcttctcaccagattttgcatctggaatctgcaaggcacagcaaaacataaaaagaacggtgtcagcctcattgagtttatgtctacactgtaaagtcaatataaaggaagaaaatttgtcacataacaaacctcgtacatagcatccatgagaatattctcaaggatagtccttaaaccacgtgcacccgtatttttggacattgccttcttggcaattattctaagtgcagcatctgtaaaatgaagcttgacctgaaagccacagttggggttgagatgagataccaaggggacattaatttgcatggttctattacagatatactcacattattcatgctgaataatttcttgaattgtttacccagagcattttttggctccatgagaacctaacagaacatgattgtatcagtgctccatggtaaaatctataaatatcttacagcattctataagctttatcatggtaagatatcataaataaatcacaagatgatgctaggtagaaaaacagtacatgattggattacctgaacaagctggtcctcgtttagagctgccaagctaacaaggataggaaaccgtccaataaattccggaataagtccatatgctattaggtcgccactctcaacctaagaaatgaacagtttaaacacctagatttaaggttttacacagtaatttcactgaattcacacatgcattctccttaaacaaaggagatttccaaaaaatgttaaactcggaattttggtgcttactgattccaacaaggatgatgtcacttgagcacttgagatgccacctgccctcatgttagcacggacaggtgccccaaagccaatagaagaatcttgccgcctgatttttaaaaattaaagcaggtgcaaatacattagatgacgatttgagaaaacattggagacaattgttccaataggtaagtctcaaagatcaatatgcaatacctctctgatatagttttctccaagtcaataaaagcaccaccacaaataaaaagaatgtcctttgtatctatctgtatggcatgaagaccattatacaattgaagttaatccatgtgtgcataccacaagcactgaacgagtagaaaaacaaactcaaggttttactgggcagttggtaatctgaaattgcactagtttagaccaggcatttatggtataaaggaacaatagtatgttcatataaagcagcatttgggatgagacctatccaggggatggatatttcagacaaaggaattgttctctattactattgtcagtcatggaacacccaaaactcttatcttgccgtatttttcttggggctatcattcagcagaagataaaaatgatatggtgtaattattccggcacaaaaaggctaaatattttatttttgaagattgtaatatataaactgtgacagtacctgtatattatcaccgcgaggatgcttccttgctcctttctcagggacattgacaatctaaatatatcaacatttcacaaaagtatcaaaagacgtccatgtaagttctgatttgcttagaagtaaaatatcccagaaagatcatatgatatatatttcagccaaataagcaaaatgatttccctttaaataggtcactagatggattaccataatttttttttaacttgatgacttgtaccatatgtgttcaatatcacaagaaaaagctcaaactgaaatatttccagcataaagcaaaggatcatgcatcagtactactgaacaggcgcgcacactactaatactatgttgtttcatttgccgggggatgctacctatgatgtactaatctgtatccaaagcacagagatcctagaggagtagagggtaagcaatatctgcttattaaggtttcactttatatattgtgattcagtatgccaaaagacacataagctaaccaggccataaggagatcaatgcaaatcacttactgtgccttccagcattttcaacaaagcctgctggacaccttcaccggagacatctctactaatgttaaggctctcagcctgcatgttgaacacgtcagctgattaatgtcaccaaggaagacatactgattcagctaacaaagacaaaccttctttgtgatcttatcaacttcatcgatgtacaccatcccttgttgtgctgcttgcacgttaaaatctgccacctgattgaaaatagagtatccaaaatcactttcaaaggcatggtgtaaagagaataagcaggtccaatttgtaagctaagaaccataccgccagtaacttgtatagtatagattctacatcttctcctacataccctgcctgcaggaaagcgcaggagttaagctttacttttggaactaagatgatattaaaaaaaggggaaaacaaactgatgaagattgcaaatgctagcaaatagaaatgaatgatcattcacaatatcactctgaacttaatccaaatgggctggtggctgtatatgatacttcttgttgctgtttaatgtaagggaaattccattagttttcactgaataactgaatttaatgaactgccattgaataattgtgtgttccttccatggcatcaggattcaatttcttccttctatgaaatctctgtcctctcagtctgattgctctctgttaaggttgcaaggccatttagcacctatgagcatgagactaacagacatgccctgcatgctgttctctcattttctctattgctgccaagccagacctacattagtctggtccaactcccatcatcatgtttcaaagcggcagctcatacttataaaagtgatgtacccaatgcaaaggtaatggaggtggttttattgcagctgtatgcaactaaatgaagtttgggtataaactttgagccaatagttggtcggctgtggaatttgttcactcatgttcttcaccccagtcaagaggtgttcatggaaggaatatgcagtcatccagtgggcaaatgttgaactcacagttacgtggtggcatataatggatctttccatagtttaatggcttcaccattttaacttttgcaagtaatgagctcaaatcataaagatgtgtgcttggacattatgcatttaaaagttagtaaagacttgcctgtgtcaatgttgttgcatcagcaattacaaatggcacattcacaaagcgagctaatgtcttagcaagtagagttttacctgtgaaacaaacaaagtatccaaaaaaacagtgctgagtgccctctctgttatagttgatctagtgttgtagaagaaataattgacagttcccattacatcaacattcaactttgaatttgggggcaaatgcttacctgagccagtaggccccattaatagaacattgcttttctctagttcaacaccatcgtcatcatcagcttctccatcaaaaccacccaaatctgctccagacctaattgttttagcttatataccacataattagtcactgaaagatattcatcgatcctaattgttcttgtgcaagaatagacgagcttcatcattccaagaacaagaagaacaactaaggtggtagaaagaaactgaccctttttgtaatgatttatggtatattcgtttataatgattgtacactgcaacagatagcacctgtagatttaacaggctgtgagagatcagcatatcaaaagtatagaggcgttactgttgattaatgcaacactaagcaaaagacttgaagttgacttatcatctgagtttgatgaacaagaacatatatcgaggtgaagcttttcgcaactcatgacaaatatatattaaattgagaaagaaagtgatatttagaaaataccaacacttgatttatcactctcattaacactatatgtactaaaattatgtacggaatctgaagtgtattaggttggacaatgaagaccaaggataagtgtgtggaaataagggtttatttgaatgcgaacaccatcagcagtccaaatcaatgttctatatacattttgtacaaaactacgtgtttgttatcagctatcaagtagacatgtagaagtgattcatccattgcaaattagaacaaatttgactaaagaaataaatcaagttctgaatcattccttgatagtgtcaaaacagtagaagctcacttgagcccctgatttaaaaaccagtttgcaaagatatcaattttatgagatagcttaacaggccaataagtaaatattgttccttactgaaagcaaagccccaaagcatcatcacaatcaacacagctagctcaataactttgttgctaaatctcgccgccatcgcgactcgtaaacaaccaaatgcggcgtaggagtgtctcaagcgaagaactagatacgatgtaattcaacaaagacctcacgtttttaattacacgaactaaccgattttaatcaggatgtgtaataataaccgagataagtgcactggaacaaattcaacaaaattggaagaaaatttcctcaccttcttggctctgtcctgcccaatcacatacttatcgagcccctgacatatctccttgggcgtaggcaaatccttcccgaggttcgacccgccccacccgtccttccccgcaccctcctcaccaccaccgccaccacctgctcctcctcctcctccgccgccgccaccgccaccgcctccggcgacgcggacgacgttgaggttggggtggaacggcgggccgggcggcacgtgcacggccacgccgccgccgtccccgtcgtcccgcgacgacgagctcccacggatggcctcccagaaggaagcgcccctggccctgacggcgtcgtgggggagcaggtcggcgcggacgcggccgatctcgacgaaggtgccctggagcggcgcgaggaggtgggggcggaagaagtaggcgctgcggcagttggggcagaggttgagcgcctggtacccaccgccgcccgcgcccgcgcccgcggcggcggaggaggacggcggcgcgcggtgggagaagaggatgtccatgtgcttggagcagcgcgggcagtgcgcctccgcgcggatgcgccgcggctcgtgctcgtcggacgacgacgacgaggaggaggtggggccctcccacttgcgccgttcctgcacgcgccggtgcggcggcgccaccaccgccggggagcagcactccggcgcggtcagggtggacgccgcccgcgtggccacggcggcgaggcgcctccaccggaggaggccggacatggcggaggaggaggttgagctcgcgcggattgggggaagtggagtctagagagagagagagagaggagagagagagtgtgtgtgtgagagagtttttcgtggggatctttgtggggtgtggatagtgattttttcgagctgattttttctttttctttttatttttttgctctgtttggttggtttttttgggtgggattttttttttccgtggtgggaagggatacgtgggattccaggacggcgggggcagaggaatctcgggatcagataaggaggggttccgcgcggttggatcatggctccgtgctgcatcgggattcgtgaccttgtcttctcccacaggatttttcgttttcagaatcttgtaaattccatccggattccacaaggtattcagaaatgaagatctcagcatcacctcacaactattcgtcgtctgactaataatcatgtctgattaaacattttttaatactatgattatctctgattaaccaatgcttgaccagcaattccgccaacgtttcagcacttaatagaaaactgactcaaacatgcagaattgcagattaaccagagtatgtactgacaacaactccaacagacataataagacaactaggcactaggcactagaaataattgacataatagacataattgacttaatagagtaggcactaggcagcgacaactgacatagtaagactgtaatctgcacatggagactgtaaatcatgcaagcaatattccattcacaacagcaaaacataattcaggagttcacagaatgcgtcctgttagaagaagagccactcaactcaagacgtcaagaaactcagattctttctggtatttcagaaaagtgagagcttgagaatacagtttcgacttctgtgattgtaccctcaggcccgttctttctccaacaaaagttagatgaaaatttggatatttatgtcacatttttcaaactgctaaacaatatgcttcatgcaaaaaatttctttataaaagcagttgaatatcataaatatatttttcaagtttataataattacaacttaattaatcatacgttaatatcatctcgttttgcgtaaaacacttaacttaatcttcatcttcatctacggcataaaagaaagcctctccaatctcggcatcatgttcatttgactcgtccaattcaacctgcaaacggagaagaaaatggttgcaaatttcgaatttcactagtagcagcttgtatttcacattcactagtaccagagttgctttcagatctgaaagtggagttccaagtcgattatatggcagtccgggatcatcatccttgactctgctaaaaaacattctcctgcagatgcaaaaccgcgttaagagacagttctgtgattacctatggttatgtttagttcagcgtaaagtttagattttggttgaaattaaagatgatgtgactgaaaagttatgtgtgtatgacaggttgatgtgatgaaaaaagaccaaagtttagatccaaaatccaaactttggatctaaacatagccatagtaaaactagtatctatgaagaattcaaactccaaattcctattctgtctgtgattctgcatataactatgtccattgagatgctttattgcctagattacataagctatacatacgagaaatgcaaaattgtttccaaaggggaaattttttctgggtgagtagaaatagcttgtgtcacattaaggctgtgtttgatacttggggttgggaacccaactccaccgcacggaaaacggagcggtccattagcgtgtgattaattaagtattagttaattttttttgtcaaaaatggattaatttgtttttttaaagcaactttcgtatagaaactttttacaaaaaaacataccatttagcagtttgaaaagcgtgcacgtgaaaaacgagggaaaggggttgggaaacttgtggaaagaacagaggcctaagtcactcacattgatagaactaaaagatgggtactacagccaaccaccaccgcaccgcgttcagcgagtcatgatagatgctggaaactctgaagccaatccttcagagttcagaataggctgggtttagatcctaagtttggatccaaacttcattccttttccatcacatcaacatatcatacacacacaacttttcagtcacatcatctccaatttcaaccaaaatctaaattttacgctgaactaaacacagccataattatcagaatttggatggaacaccagcagagcctaacctggcttcaaactgtaaacaaccatacagtttggtggcatataatgattccaacagtaaacaaatgcacagatttatcacaccccagttgtggatcacgtatgcaatacgaacaaacgccaaaaacattactggcactactcaagccaactaacctgcagctaatcatcacagcttcaaaatgattaggttaacttgtactatgctttactcattccaatggtacactcgtacactatcataactaaacataaataggcaattctacaagcaaccattcttgaggagagaaacaaacaagcaccctaattttacaaaatttaagatatgccacccgtatcttaatgacatgtagcactcacatgagtcaatgacatatgggtcagggtggcatatcataaattttgcaaaatttgtatggcatggttcaaattttcccaacaaagacaaagccgaggtccacaagtatcgaattatacagatacgatccattaccaccaaagttctgcacttgctatcacgagagtactaggcagccaagatcaaccatgacggcccgtttagttcgcgaaaagaaaatttttggacatcggacgtttgaccggatgtcggaaggagttttcggacacaaatgaaaaaattaattttataactcgcatggaaaccgcgagacgaatcttttgagcctaattaatccgtcattagcaaatgtgggttactgtagcacttatggctaattatggactaattagactcgaaagattcgtctcgcgatttcccctctaattgtgcaattagttttttaatttatctatatttaatactctatgcatacgttcaaagattcaatgtgatgtttttgggaaaacgttcaaagattcaatgtgatgtttttgggaaaaagtttttggaaactaaacagggcaaaaaaaaaatggaggggaaaagaggctggtttttttttttttggtgagcggaaggctttcacctgctgcttgaggtcgtgacgcgcgcgcgtcagatagcaagcaaaaaaaaaataaaaaaaaatcctcccatttctctccctcctcctcagcctcaggtggtcgagaggactccacctctccgctgccgctatccccgcctcgcgccgcgccaccatgccgctcctcgccgccgccgcggcggtggcgccgccgttgtcttccttccactcgctctccctctcctcacgcggactccgggtcccctccccctgcgaggcccgcccgcgcgcgccgctccggcgcggggacctcgccatccgcatgggcggcggcccgcgcacgttccccggcggcgtctccaagtggcagtggaagcggatgcaggcgaggaaggccaagcagctgctcaaggcgcgcctcgcccgggagcgccagctctacgagatgcgcaagcgcgccgagctccgcgacgccgccgcgcacctcgagcgcccctgggaccccgacgcctccgactccgccgccgccgcggcggcggcgcccaacctgctctccgtcgcggcggacgaccagatgaaggcgctcgccgaccgcttccaccgccccggcggcgtcgacctctggaacgaccgcgacgggccgcgggtcttcgcggccccggacaccggcagggcctccgcgcgcttcttccccaagggatccgtccatagcgttcagccctacggtcttgtcaatggtggccttgagagcacactggctgctcgcggtaacccttccgatgcgacggaccggagtcaccgccaccgcctgcaaggtgttcgtgagaatgcggccaagaaggaaatgcgtggtgttggtggtgatcgtgagcctgcggttgagtacatcgaaaggggtggagtgtgggagccagtgagtaacttggatggtggcgacgacgacgattctagcgacggtggatggaacgatgacattgttacctcggacttggaggacatgggggatgtcgatttgcgacccgagcaaagagcaatggttgggagagatagaaggaaagataatgtggcaaggtgggaagctacaacatctgtagccatcggtagcgatggtgttagggatcagcgtggcaatggcttctctttggaaccagaaggcacaagtgaatatcatcttggtcaaagctggcaagagagaaatagtgggagtagagggaaacgtcccgcagggagaaggaaggccttgaacaccgatggcggtagcgccattgggaaggatcgagtggtgggtggcagttcattctccgactctgaggtaacacgcaatggttttgaaccaaaatggagatccacgactagagggcgcacaacgaatgatgttaggaggtggaatccccccaacgaaggcggtaggaatgttcctagaaagggttggacggatgatgagtttggttcaaattcagacagtggaatggatcacaagttgatgccaaaatggaaaactcagaacaggttgaaccgaagcgaaaatggcagagatagaccggagctgaaatatatggctaataccaacaatggggagaggactaggaggtacatgaggggcagcgatggtgagggaagaagagatcggtttgttaatcgcttcgcctcagatttggaggagccagaatggaagccaagaagaaagagtggagcaggcaacgatggtgatggaagaagagatcggtttgttaatcgcttcgcctcagacttggaggagccaaaatggaagccaggaagaaagagtggagctaggatgaacattggcaacagagagtacatcgatgacatgaatgggagattcaggaggggtagcgatggagatggcatgaatgggagattcaggaggggtagcaatggagccgcgagattgttggatgctatggacagcaacagagaaatcggcagtgaggatgatagctacaggatgagcagaaatggaggacagcgcaggggagacgggtactcgctacgcccaacgtcagaattgcacaactctcggaggctgagggaatcaaatgaaatgtagttctttttttcttcttctgatagaaagatgaaatgtagtactagtattttacaatgatgataaacaaataacacacgccctgtgcagactaacttctaggagtacaacccattcatctgttcaatagcagtgtacagcacacgccacttgcttttgttcagattatgcgacgcaacgcagaaatcatcgccttgctgacttccatataaaaaaggccaaaccaacaaggctgatcaatcaagcgcatcgcggatttggtagtttttatctgaaagttatcttggttgcactgatcaggtagtgcaggtcataattcaaacaagggcatggaagaattcacataacttcagaattataagtgtcacttccaatttccaaatgctggattataagcacagaacattgatataaaagtacatgattcatgtctccctggttgcaaattacatgatggtcatgggcctcatggcagaccttatgaactcaaactggaaaagatcaacaacattggtgcttggtaaagattgctccaaccacttcacctgcagcacataatacacctgttaggcaattaatcacggaaataccagggagtgcaatagacataggacaacaaacagcgcagaactttgctttagctcctccgccgatgtgcttgagcaatgttggagggaactaatcatgcatgcaaaacatataaaaaaaaatacataaaaagcttaatcacaaaagaatacatcttcagaaaaccagattttgaagtgacttccttaattgatataaactatagattccacgatttccattaaggagaggtataaaaaactgctctaaacaaacccaaaacccaactctttgtgaaaaacgggtatagagagactgaatcatatttctatctttcgatcccgttgcaacatgggcatctaactacttatcataaaatgtaactatgcctttgttagaagttgcccctttcaaattaaaacactaatccgtatgaaatgatcaaatgaatctgccagaggataatcgacttatggaagtctgggaagacagtggcgtgtgacagcaaacaatgctaaagttagagtaacttcggcaaggatgttggctctcatttcaccacaatgcacagaaaaaggacacctcctaactatgtaactcaagtatctaacacaatgcaacaaaaatagtggtgcactgacaagttcttaagttcacattagaaggtgaaaaacataagattctgacaatgatcatgcagaaaagggaagaaaaaaaaggtgatactaaattatgtgaaacaagcttatttgcatcttaaagtgaattcaaccaggactgagaaaagaataatgtttgctccaacatagatggcaacatgtcatatagtacagaaacatgcttcacatgatagtctagttagggttatagtaaaacatatctacctagattaaagatgcaattttcaagtatcacagcttaagatgcagctaaaggggaaaggcatccagccatccagtcagttatcttaccaagtgctatccacatgtgttgacttgatgaccaaatcaatatacatttcgttggcacaacatgcctcttcttagggcaggtatatacttatacggcagaacgaatgctaagactagaaccaatgatgttcagacttcattggcacctagtatatacatttctcaagaattttgttctccaccgatcgtacgtgctaaatacattcttagtattcctatggatgaaatatttcaccatgtaattagacacctaatcttttgaaaaaaaaaaaagcaaacatgaattgtcatgggaagcaaacgaacaactagccagtccaaccccgcgccacagtttcaatatgcaaattactaatctgtttcacatgaaaaagctctacataatctccaatagatagatcaaggtgagcacttccgaacaaccctaacgcctccaaatcgatcccaaatctaacgaaacgaacccatttcagccggaggaagagaacaaggggagcttttacaccgggggggcgctcacctcggggaggcggcgcgggtctccgcgcgtggccgccgacgcgatctagtggtggtggtggtcgccggaggggcggtagaggcggttgtaggcggcctcgccgacgaggtagatcccgaaggcgacgatggcgatgccgagccccggcgtggcgtggcgcagctggttccccaccatcgggtgcctcctccagtcgtcccgccgccggaagaactcccccgtcgcgttcaaccccttccccgccatcgccgccgccgctctcctcctcctcctcctctctctctctctctcctcgacgcgcacagccacacacacacaccaacacgaaagcccaagtggtagtagtatgcgatgcgtggttccagcccgttttgaatcgggccttacaaagcccaaggaaataacacacgcagagtcagagaggaacagagagggggaatttttagtattttttgaacctttttttatttttaaattttacaaacataaatattttcaaaacttattttcaaaatatgaatcttttggccacacgtgacaaaataaaattgtcatgccacccacagcgggtgcgatagttttgtcgtcacgtcattcagatgagtgtgactattgttttaccacagttcggctggtgtgatcaacaggttcaattttctaaaaagaatagggttgaaaatgtttgttttaaaaattagaaatataaaagttcataaaataaaaaaaatcaagagatagatagagagagagagctcaagccgcaatggagccaattacatcgcatgtatcgatcaaaacaccgtgccaattacaccctagtatgcaggatcaaatgcatgaatggtatagaatttcaattccttcaattcaaagggggcctaaagcactgatagaaagtaatggtttgtattgtatagtgtatttctttgttgttctgctcacacatataatctatctacaaatatacaatgtttctgcctctctgttttttcttttcctttcgaacctgcttgaagaaagacatgcacttgacgatgggttcctgaacttgtccaagaagctggtgttgtcaagtcttgaactgtcgaacatcagcaaccaaaagtcccacaaaaaaaaaaaacaaataaaggagccaagacagggtagaaacctcatgaaaggggaggcagttatcatagaatcatacacactaacccataacttaatcactactgaacaccgagagtatccaactctctcatagaggttcacatcacactacgaccacagcagttagcctgcctgcctgctaaatacaatagctacttaccatgtcgggtacaacacaatgactgaaactaatacaacaaccggcctgcacgccgggtctgctgctgcacggcagcaggttgcgggtgaagcggttctccgcctcttcaccaattcctaacgattctaaaacatgtcaaccgggagcctcccgtggtcattctcggctcctcttgctgctgcagccagggcacttgtactgcttgatgtgctctgccttcgcaggggtgatccgaacgcacttgccatggaaccacttctcgcagacgtcgcagcagatccagaactcaccgttcgcgtaagtctctccgcaagcgccacacatgtaagcctggtcctcatcctctgtgccttccgggccgctgtcttcctcatcttttggctgaggtggctttgcaggcttgctgttagaattggattgcttcgatggctggaaaagaagggaaacgaaaaggttaaacgttgtgttgatatgggcgctagataatgcatgttagacatgcatatgatcacatgtacatactttagggttggacttgttgcttttgctgctgccgttggagacttttgtttgcttcttggcaattcccgtcacaacttcatatacagtgggaagaccattaatcatggtgaagagccgtctcctgaaattcaaatgccagttatggactattgtcattttctaccaaacaatataatgttgattgttgagtgacaatgcactggataatattactcagataattacacaaaagatgaaaaatcctcttgtaaactttgacaaatggaatcagaatgcctcatcacagttgatttctgtaaataagaaatgcatcgacagctgcaacgaaaactatgcaaacctggcttccttatcaaatccaaagcgagccccaaagtaaaatgctacagacagtagccatgcatcgctatgaactgcaaccagcgacaaccaatctttttcgatcattccatcacgagcaaagtttatgcccagtgctggttctggaagttcaggaggtacttcctcagctggaagggtcacgtcccaggtctcattgggcaatccataaaggcacaggttctctttctctgaaaaaataggagatcactatgtcattactatgacataaacaagggaagataacttcattcaacagactacttgtgatgtaatgtaccattcatcattatttcaatggacagtacagcacaaaatggctacatacagttgaagattaacccacacacgcttgaagcacatactggggctatgcctagggagtcgacaaaccaatttactcaaaacaaattattctcacgtaacccctaaaacattaaacccgtcttcaaacatcaacaggacagtaagttttggagctactgttgtttttcacctttaattgtagtaatgatgcaattacagtatactagcatattgacttacattttgggaataattaattaccacatcttaaaagtggccaaaagttaaatgtcccaggatcatatgattacagtatacaattacaattaacttatattttggatcatgctagcagaagctgcttcaatggttccctagcaatgtaagtatgctgttgggcctgtagaatagggtgctttagtgttttaatgggccttgaaaattgtaatgattaatcagtcctgtatgatgtgggccaagcccatgaatacatgcctctacatgctaacataagttacagataggaccaggcgaccagcagtaactgaatttggatatacctttttgtccacttctgtcttcaattcatgaaatttctttactaaaaatatttacttcgaggaaatttcagaaaaccctgagttttgggtcatgggtctcacaaaacacagtttttaccatggaaaacaacttttgtttgctaataaaatgcagtgaggattacacaaggctggagaaagagtatggccaactagaataactcccatgaagccttttcctaaaaatgtgttaaaatttttcaaccagattcccaatcctacggtccaataaccagatcatagatttacatgatgatcgatctggaaaagagaatagttattagcacgatgtgatcaggatttgatttgcagcctctacactgagctgatacactagcttcaatcaaatgaaaatttaattatttaaagaccacatctgattgattgtggttcatatagagtattttgaatgcaatcatcatttaagcatgctctctgaggtcccagatgctgatagtgcaaaccgcaacaacaattgtactttaatttgctgaaacctgaaactaccccctaacaaactgacttaaatggacccaattacaccggcaagcgactgcaagataccagctaagaagaaaaagctttcaccgataaacactaaaaccgccataactaagacagattagttagggctacaactaaccaattattcgagcttttattcttttccccgaggaatcaattattccagctttaaggaactttaagaaacactggagcaaaccctaaaatcgcaaccatactaagctccgtccatccagaaaaagcaaaagcgactccagagcagccgcaaaaaagaccaaagcctcacatccccaaacacaaaaaatttagctcaaacacatgaacatcggggagctagcctcaccggggtcgcactgccggtagaacttctccacatctgcacaaccacacaaaaaaaagaacagcaaatccatcaaatcaatcaatcaatcaatcagcaaagagcatcccaaacaacaccgaagagagctacccaccggtggtgagcgccttgacgatgcccgcgcggcgcgcgcggaagtcgcggaagacgtcctccgcggaccgcgcgttgtggtgcaccgccgcccccgccgcgttcccggcggcggcagccgcagcaccagcgccgcctccctcgtccatccgccgggagctccttgctagggtttcaggcgagtgggagtggggggagcgagcgagagtggtggtggtggtggcctcgtagtggagagcgagagaggattagagaggaggggcaaaatcgcagccaggtccagacgaggacctaaacgcaaataaacaaaattacagggggctagcacgaaaacgaaatcccagtttccaccctgggtggggtggggcccacctgtcggggcggttgatgggctcttctagagttttgtctcgtggcccacggagaagagtcagagaccactcgtcttcttccttccgctcgctcgctcgctcgctgacgtgtacgcttcgcggcggaggcggcggcggcggcttccgatggcggaggcggcgggggcggcggtggcgccggcgaagctgggtctgtactcgtactggcggagctcgtgctcgcaccgcgtccgcatcgccctcaacctcaaaggtacgttgtgcccgcgccgcgcgattgccttcctctcgtcgtcatcttctatgcgtggttggctcatggccgggcagagtgagtgaacctggtgcgtgcgtgcgtgcgggtgattttgatgtctgtctcctgcaggattggagtacgagtacaaggcggtgaacctgctcaagggggagcactctgatccaggttaggtgctacgccacctgtctgtcaaactgctttcctccccctatctatacttgtgtacggttttgtgctgcgtctagagactgttcgtgcaattaccgccgcaaatttgtgcttggatgttgagaggtaagattctagcaggcgatcggcccgaaatccacaaggctaggctctgtgggggaagatgaataggaaggtgttcgatgaaatgcacaactgagaaaattgagatgaacatgagaggtttcggtgcagcatgtggaagcgcctcttttcgggattttcttgatgcaatataaagcaaagtgatatatgcagatcatggccttagtacccttgtaactggacgcatgatacgcacacgatgcgccatgatgtccacccattcgtggcacgcacccatgcacaactagctcagaatcgtaggggaggaaccaaaaaacaggaaactcaaaccgaaagatagaacacatgtgtggtagcctcaactattttcttttttgtttgtgggtggaagaattcatgaaggttaatcctatgaagttcgtcccggcattggtcgatggagatgctgtaattggtgattcttacgcgatagcattagtaagcattcagaattttgagatgcagtagtttatagcatcaaaattggccgcttcttgacttgtttctatgtgattgcagtatttggaggacaagtaccctgagcaccctcttttacctcaagaccttaaaatgaaggccttgaatctccaggtaatgatagattctgcactgctatgcgcaggatgatgacctcaattaaacattccatttgatatacaagtgctatttgtaatttgttgaggttgagcagcgttgatgttcagttagtgcctatttgagaaggtaagatcacatcagaacaataacaaaaagaggaaaggatcagcccacacatgtttcaggataataggaatactgagcacaaggatataagataggcttaggcataatccagaaaatatagcttactgtatgcactagattttttttcctcttaccgattgatcatgcctagtgtgacctttcatgacataatctaattttatggcagatagcaagcattgtatgctctggaattcaacctcttcacaatcttaccgtactggtaagaactgatttgcattcaatttcttactgccatgtaaggttctctgcctggtatttgattactcagtgcacctgtgttccatgtctatctggctgcattgtgcaaagatgcatttttgtgcctcagattaactctatattaaacagtttgtgcttctgtagtaaaattaatatagtacagctcaattagggaaaaaaatattgtataacagaataatttgcgggccacttgtttctttgcagaggttcattgagaagaaggttggtacaggggagagcatcccatggactcaacaacagatcgacagaggtttcgcaggttctcctcactgacgtatcctttattttattaatcaaatgactatattttgcagctttacttccaccatcaaatctgcttcaaaaaaaatgtgttatgcataactcagttgttttgcatgttgtgagaagctcactcatattcctccccttttcacattcctgcctatttagatttgcttttatgtcacaccatgctcacttcgttccccaatggtgtagctgctgagaacctagtaaaaggctgtgctgggaagtatgcaacaggagatgaagtccgattggtgtgtatgctgccctaacaattttatcctttcttgtatggagatcttctctaaggtttttttttttttcgtgtatcttgcttgcaaattgtgtcactttttccctaaaacagagtgaagttctcccatgtgaaaaaagaaaaaactgaagtgataaaataaaaatgcatcctcatattcactgtactcctcatgagaaccatagattgccatttactaactttccctttgtttatgtaatcatgtttgtgaacactccaaatattaacaagcactgttttggcttcagtaactgttgcatttccgttacacatgcaggcagacgtattcctcgcacctcagatttatgcagcagtgactcgttttcaaattaacatggtactgttcttgtgcttcttactctatccatgcatatgcctttatctattttgttaaatctaatgaaatatgttttcttggcagttaaattatcccactctcgcgaggctccatgaggagtatatgaaacatccagcatttcaagcagcactcccagacagacaaccagatgccccttcctctacctagaaaatacagtgtatgttcatctgaaaaatagattaaaagttgtacccaacttatcattggaagctgtaacaataagcacagaacttgttgcgaaaattgaaaataggtgtatatgtttttcaaagcttctgtccaaataaatgacccttaaaattgctagcctatggacaacttcatgttggcatcaatggtgccaacaacatgatacaacttgagagtgggaatacaagatgcacttgaaacgcattggtttgataatcttacagattatgtgtgatgcagcacgaagagaaagaatctcaataagggctcaacctgatgattatccttaaaaacaagtgtatttgattttttgcatacctgagttaaattatcacaagacactgcccattttagtttctgttgtacaagttaaaattttgaatagttttattgtgatcatagccttttctgacttttgcaacaaatttgagcaatgtccgatgggcaaatggcataaacaacaatgtccaaggtttgagaactaagaaccaattaggaaagacaggagggcttcctctcatgaaaccgccaaacttaatagagctacccaacgataaatagaaaaacaagagtcatcaagaatgttacttttcgagcaattgatagcttgaccacctatttatctttttgagcaccccatcctcgatgacatccaaacaagatgcctaacatatctaaaacctaaaccttttatatctcggctcgaaacataatcgagccaaaataaatatgaaactattgagttaagattgatagatggagtctcgaggtgtgtatttggctatgcttcatggattttcgggcaatgtgtgacgacattcaagaacttaaggctggtattagcaattgatgaaactttcttagtagagcaaggatgctcacttcctactattagccaatcttaatagagcaaagataataatagagctcacttcctactattagcccatcttaaagctaacacatataatagattagctacaaggttggctacaattttcttctcctctctctatctctcacttatacattaattgtatttgtattggagcttgtgttaagctagctcttgcatgagagccaacacccttaactttttattacatctctcctccatataagcttatagtaggcttatagcactattatacttgctcataggcaaattcaaagggtaccttgctcacaacaatagggaatagggattgatgccggattacaacttactcccttggcatttgttctggtagagaaggacaatacatccaagtaggagtagttcatcaatatgattacgttatgtttgattggccctaatagagaaatatgcataatatctgtttacacccaaatttggcacctaggaataaaataggaaaattgccaaagtttggaaatctgccgattttccgctgagaaggctggtctgaccgtcgtatgttggccggtcagaccgccgacagtgggccggtcaaaccggcggtgtgtggccggtctgaccgccaaagtctgaagccgagtctgtttcgtcgggtctcgaggtttccttgctcgggaaggcatgtttcgggtttcctttggattctatcccgagtcgaacgtggaggagggcctgtagagggcaagaccaacccctatataagggacaaggccggtttaattgtaatctatcaatcaactatcaatcaatcgaatcgttcttttacttttgcttctagttttagtttagtttgtccatctttgtcgatttgcgttgtaaatcgtccgccgccgttgcgagaatgcgacacctctttgtaggtttgttctgaaaaccttccgttttgcccacaagacgggtagttatctatcgttctatctatatctgctccgctagccggtttagtttattaaaacccatcttggtttagcttttgcttgattgaggtggttggcgactctagaatcaccgcaaagctttaggtgctgcgatcgtgcttgtcaacttgtcacaaaaagttgccaacacgatttttggcggctccgctggggaaatcagctcaacgtcgtctcaacttcgacgccgccatgacgaaaatgaccaagccagaggtggaaccatccaatatcatgccaatctcattggaggatcttgatggggaagcacacaagatcatggaggagcacatcaaggcggtcacgcaggagatgctgatgagatcgtgcaccaagacctgtggttctcaagcctagaccgttgcctaaatctacttttgattcggtaggtgctgaagaggtaccaattcctatccaaaatctcgtggcaatacaatagattcatccattgttgcttcaaataataaattagatgcatcttttgaatctcgttttgatgcgcgaattgaagattttatgaggaataaattcggttcttttttagccgattttcagactaaagcctctaccagtactagcaaagcccttgttgatcaaatatacaacaaaaccgatgggggcgaatatgcaaacaaccggtgagggataagctgtgcattcagccggtccgaccgggccagatggccggtccgaccgcgcgtttaccgccggtcagaccggccagatggccggttagaccgggttctttcccggtctgaccgcgcctctggatgctggtcagaccgggccttggaccggtcagaccggcgcaattatcccgatacaggggattgatccaatgacaaataatgggcttttataccatattccagcacatgattcccctatatctactgttagtcctcaagttcccccacatatccctaatatttataatgatcttactagaagatatcctcccaatactaggtatggccaatataattatattgtgccgcaaccacaacctcttatgccaccaaacccaccaccaaatcagcataggcctgagaatatagaggaattgattagtggtattattagggataaattcgggattgaagctaggaatcatgctaaggtttaccaaaagccgtaacctgattactatgataacatcccatatcctcatggctatagagttcccgaatttaccaaatttagtggtgatgatagtaggaccacataagagcatgtaggtcaattcttagcgcaatgggatgaggctagtgattctaatgataatggtaatcatgatatgtatgttgctgagtggttatggactaacaaaaataagccttttgtttgttctaatttaatgccgactcctcgtaaagatcggcaaggtgaggttaagtatagttttaatgtagccaaatgtgataagatttttgattatcttttgcaagaaaagcaaataaggttacctaaaggccatgtcatacaatctcaataggaattaaaacgttgagcttattgtaaatgtcatgattctcattctcattctactaatgattgcaatgtgtttcgacgacaagtttaatcggccatagatgaaggacgattgaaatttacgatggttttaagatgaagcttgatcatgatccttttccggtgaatacaattaattttaatgataagaatgtgttgattcggctggagcaagctgaatctactaaggggaaagaagtggtcattggagagcctaggccaaagatgatggtgccaaagaatccggaggttggtgtttggaaggagaataggagtgaagtttcaagttctaaagctccaaagaagactaaggtgaccttcgatatgcttttgaataagtatgagaagcaaggaggtgaggaagttcacaatgaagggaaaagaccaaaatcacctcctagggagcgatttggtcattcaccaagagacggtcagaatcacctacatatcatcgttcacaaatcatgtcatgggggccttatattatgggacagaaggagtaataagtagtcagggcgttaacaattgtccttctgattagaggagtcctataatgccacataggctaaattaagtgactctagcgccgtgtttagttccaaaatttttcttcaaacttctaactttttcatcacatcaaaactttcctacatacacaaactttcaactttttcgtcacattattccaatttcaactaaacttccaattttggtgtgaactaaacacaaccctagggaggtgactacggatcggacgtccgatgttttagctaaaaatcggacgctcacctccacctccgccaacacatgcagacacaccagcaccaggtgcagcccactgcaagcgtaggaagccatgcatctatactagaaaacaaaagttaggttggtttaagttttttttagcaaactttaaactattttttctcttaaattacttctccaattcatgattcgattgcaccactaaattcgttgcaattaaatctttaaaataagaccaaacatgactataatccgatgaaaaaaatatttagctttattcatgaatttttcaaatgttgcacctattatatttaaatgtttcagtcagtattcatatggtgtttcactatttaatttgcaaatgttgcacgtggtgttcctagaatgttttagcaagtattttataatgtttcaataattatagtttagtgttcatatgtgatataaaaatatttcaacaatatcgggtttttacaaatatattgtatctgtgatatgttttatttgtttcactcattaggactcagtgtttcatataagtggttgctagtgttgcagcctgtatttttaaatgttgcatttctctaaaacattttatagagtgaactgaaacaaacttttattatgggtgaaacatcgtttgattttttatcaaaatataatcgtgtgatatcttgttgttaagatttaattgtaaggaatacaatgatgtaatcatattatagattggataattattttaggagaaaaaacatttaaaggcggagaaaagggtggagatgagtaaaaaaaattacgtgtggacatgtatgaatagacatgacatgacatgtgcagcataactgtgaatgagaaaagaaaagatgtatagagaagctattgactggtacactctgtagttcgtataggctgaaatatacaagcaggtgtccgacgcgtccgattgtttatccgttgatcggacgtctgactttaagtattttctcaaccctaggtgtagctttaattttatatttcagtccctgacactttttatttcagttcttttttttttcaatttaggtggaggtccaaagtttccacttaacaccctgtaatccaaaacaaaaaataaaaatcacttttccggccttcctccccccgagttcacatcgtctgcctttggagcaaacggcaaacattgccgttgcactcatccatgccacacatttttgtatcaacggctgtatggagtgaccccaccacagtgattaattaattaggggcatctaatcaatagaattagttgtttctctcctggaaaaaatcaacgatagaattagttatttctctcctggaaaaattcaacgaatacgccgtggctttggaaataactaattaggcattttttgcatggtcaagtacattgttcattgagttattcactttcatgcaatttcgcaggctaattcatgagtttaaccataccattaagcattctctctctatccaatctgttccatttatgttaaccataggaaatccatttcattatttgacattttgactaaatgttttataaaatataacatgtaacaagatgctacacacaccaacagtaaaaattaacccttattgggtggcaggaccagcagctaccttgaataactctattgatacatgcaagaatgtacggtatatttaattaaaagcatgtcatgtccatgacttttgacaaactagagaatgttgtaggaagaatgtatttgttgtgcagtgttacatgaagttaatttgacctttgctattcatctggcataagctgaaagttctcttccgcaagaaataaagcatctaaattgccaatatactccaacgttccatattatgcttcctttggctaccatttagatgacctatcaattttctattgacttataagcgcgtaggttgttctgatggcattgtgcgagtttgctctggtcatgtctgaatacttttatatgattctttattttttttttcaattctcacggggaaaaccatttgttataagagaatttatagaaattgtgttgtttgctgcttggaacaactcccccttagactttgctgcaaagcaaagtgcttttttccactgagattatgtcacaccctaaaaattcaaaatttataaattgttgtttaaatggaatttttagaatttattttacaagtcttgaaaagaagatctaattttaataaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtttcttttggctttgggctgaaagtcggcccaaaaccgctctctctctctcctcggcccaagtcggcccagtccgcagccgcagccgcccgcgcgcgagcgcgttgtcgctgacaggtgggtctcgcctgtcaggcccgtcgtcttcctcgggccgaaaccctagcgcgccgccgccgccgttcccttccaaatccggccgttcctttccttctccggccgaatcaatagaggggaaacgatctccgggatctcctccaccttttctcctttggaatcttcggctaaatcggtttggaaaccgatgggttcgaggtcgactcggatcggctttgagcccgatctttccttctcgtcgccggtcgccgtgggccttcgccgccgcctccgagcccctttaaaaggacccccgagctctcctctacccgtcgctcccttcgccttcgcctttcgtcgtcggaagagtcctagcgccgtgcgccctagctcagccgtcgccgccgtcgctccagccgtgcgccgccgtcgttccagccgtcgccgtcgctcgggaaggccaccgtcgggatcgccaagtcgccgccgtccttgtccgctgcttcgccgtcgtcggagactactggagcatcgtcgccgccgtcaacccgaagagctccgccgtttcttcttcgtcgccgtcaccgtccgttgggtttccgccgtcgttttggtcgccggtgagttcgccgtgtcgtccgcttcgtcctggtgccctccgtttgcgtcctcgtgccgccgttcgctggtgagcttgcgccgcccgagccgtccgagccgccgagccgccgccgccatagatgacgtcatcgctgacgttattggggccgtccgccgtgagccgccgtggacccgattgatctcggccgtccgttttagatggatcgatctcggccgtccgttcgcgtgaaccgccgcccgtgcgcccggtccaccgcaaaccctagccgctgacgcaataaatcctcttttccttttcaaaaacaattcattattgcgtcataattcaattaaaatcagtttaagtgttttaatccgatataatctttaaaaattcataactaattcatcttagctccgatttagttggttcaagtctctaatttttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaatcaacctattctttgttatggccctattgttcttgtttaccttattccttgataccttgggttaatataatttgactggttgaaccttatatattggattggttcaactagatgttagatgtaattgcttagccctgcttagaaacactagttcacttttgggataacttatgaatcattataatttaataatggcttaatgatagttcacgatggttaatcgtgattggttaattaattacttgccaactaaaatttgataatggtgggttgtgagcacatggttttgagagtcgtgctcatgacaattaaggaccggttcacgagtttcggttgtgaaacattaatcgtgccaaccacaagccagcgtgggcaacggctttaccttttgtatagcatggttcattgcggagcaccagactgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtacccgcggttatgggcgggtcgagcaatgtctttcgtgattagtcccacacttctcaccatagtaaatgatgctttaattggtaataatttgtttaattcctggtttggagaatagatctgttcagccgggtgtggttgtcagaatggttgggcctatacaacagggtatgttgtatagtgttggtttaatattgtttaatacttaactgttttattaaattctccaatgtttgctaaatgctgcttttgcaaatgagcctatattatgccatcctttggtatccttgtgcacttgcatatttgctgcgtgacttgctgagtatgtcatatactcaccttgcaatcattcatcagaggaagagttcttcaatgaagctgatggtgtggaggattaggtgtagtcttggtcaagctgcctgtggagtggagccgtctgcgccgtttattttactttccgctgcttagatctttattgattgagaggaactatctacctctgtaataatattttattcgctattagagtaataattgtactctattatcaatttgttattgtgtgcctcggttgattcctggacgagggttcacacacatgtaagcgtttgaaattttggatagaaattccgggcgtgacaagttggtatcagagcctccttgaccctaggttatgccaaatggttacctatagaagccctctaaaaatattggaaaagtagaactgttctcctccctttctcttttaattaaaccaaactaatggcacatgcacttcttaatctcttttaatggttctcattaaaaatttattccagtgttattagtactgtacatctattactgtactaatggctcattttaccagcaaaagttttacaatattgttttatttaatcttgctgcaataaaataaatttagcatgatgattttataactttcttttatttcttttaaaacctgttgttcaaaagtacaaaacttgtggccttgtttccaactgtttcaacttatcttgcaagtttggtttactttatttaattaccttttaccttgatcttctaaactttattcaaattaatcccaaaacttgtgctattaattggataaatgtcttaactccctcctttcacttgtctttagatgccgcgctacaagcctgagtacttgtttggtgttgagggttttgtccaggagttgcgtacaatgtcctttgtcattggattcgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttatagtgatcagttggccgatactgagtatcgctatcatcctcgtcaaccccagggaagtgaccgtggcagttaccttgagactgaaggaattgagaatgatgctaccacaaggcatttggttgagatgctgtgggctatggatgaaagtcgtgcggagattgtgttggcagctcaagatcgtgaagaccggaatcgtggtaagatttgcaagctagaagacaaagtggatcgtttggagaaggaactagccgcattgaagggagaagcgccaccgcagaaggccagaattcgtcttaccgcaaggaagagagctctatttgtccctcgctatcaattggcgccaaaggttcgtgtggtggagaaagaagttgccctaactcaagcagatcctccggtcatcatcataagtgatgatgaagaagaagaatccaaacgcaaccattccaagattgagtgggtagcaactcaagatgatgaagacgagccgaaagaaccttcaatcgacctccgatgctcggaagaattagagtgacttgttaagtcgttgttttagatcgttgtgttagtttgcttactttaagttgcttgtgtgtgtctcgcatgtgatttacatcagtggtgggatgtaagtgcatgattagatgctatagatagagttgagcttagtgtatatcaaagctgtgacaacattgtacatttcatatcgttctctgctttgcattttttttatataaaaagtgtctacaaaagagttattaagatattgcaatttacactacaatatatgtaattcttgaacttagtttgtttgcatgttcagtgtaatatataatgtggaaagatgctataatctttgggtgattgaacatgattagtgtgatatgatgtgggaaacgtgcgttgcacgtgcatgtttactagtgatttattaaagcttttgctaatgttttcacatgcttaaccacggcgtattcgttgaatttttccaggagagaaataactaattctatcggtgatttttttccaggagagaaacaactaattctattgattagatgcccctaattaatcactgtggtggggtcactccatacagccgttgttaaaaaatgtgtggcatggatgagtgcaacggcaggaaccccctc

SEQ ID NO: 69425 - DNA, 1145 bp, Oryza sativa
ggaactccatcagccgtctcctcctgctgatagttaagacagagtgccagccatccgttcagtgccttgatgaagctcctctgctcattcacccaggaggaaaaattgacgatccatttaatcaactctagttcaagcccattgccagatctcgactggttccaccagaaattattgaatccaagttttttgcctctgatattgcttgacactggatgtggtagcagttcagcttatcttgccacattttcacaaacctgtaaaagatggctataagacttttcttttgacacaaactagatttgaagataatatgaaatgcaagaatatctagaaaataaatttggagtgttcagtattccacttgattgttctacaacataggtatcgtcaaatacacttttgccatagagtacccaaaaaaaaaagcaattctagacgtacacatgactgtttgtgatgctttaacttgattaacttaaatgtgcataaatcatttttgttatgaaaatgtgtcaatttctacagagatcaatttagtgcactggtacataattaccttcagaattaaggcagttactttctgatagacatactacacatgtggactgacattacaaaataaaaaaaataatgggtaaagacaaagctaaatcagactatttgaataaatgtcagagggaaagaatagagtgtacccttggattaaggtattaacttgtggccataactcctcgtcccttactctgtttatctttttcgacaccttagcaataactcgcacagctatccgtatttttgttgatagcttcctaaccaaattacgagttgcatcaatcttgggagcttcagcgcctttttgatccaagaatttcagcctcttagagttcttggcaagcaggagccgcattttctcttcagcctggaagaggaaaacagcaccaaaacattcaatacggaatagagactaccaagggtgagctcaagcaaacaacatgatttccccaatgtaagagcagtaattcttcattgatgggttcctcataggattattagtttacacgtagggtgatcatgacatgaaaacaaaatataatattgtcctgttatgctacaagggaacctaaaaaggcatggcagcaaca

SEQ ID NO: 69426 - DNA, 1532 bp, Oryza sativa
tgcagttgtaaaaggatctgtaaaagacgtacccgttttttcttccgttggcttgtgcctgtcatcgctttacagtgatttcgtttgctcgtcttcaaaggctcgtaatttggtctcatgttgtattttcgtattttgatgcccacaatctgaagaaaacgaaaataatgattgcgcctggaataatgaatgcgattatctcggcctagctcggtacagaaaaataggggatcgatacgggaaaatagaaaatagattaaaaaatctaccgagatcagtagtattacaaaaaatagaaaccttgtctccaagtacgtgatcacaggggattagaacggaataatatgggatatattatcttcaagtacgtctttttaaaaattgacccgtcctatataatctaggaacgatcgaccaaaaaccatggtttttaaaaatcgacacggtccagactgtcgtggacttaattttttatttgtccaaaataatccgttccgccatattctatgagcgatcgaccagaaaaccacggttttttaaaatcgacccgattcggccggtcatgcatggacttaattttttatttatccaaaataaaccgttccgctatattctatgagtgatcgaccggaagacaactgttttttaaaatcgacttggtccggacggtcgtggacttaattttttatttgtccaaaataaaccattccgctatattctaggagcgatcgaccggaaaccatggtttttaaaatcgacccgatccggactatcctggattccatatatggatttttttttcctgaaattaacataaaaaagagaaaaatgcatcgctcctagtcgggttgcggctgataggacatgtttctgattcactaaaaagaacatatgttttctttaagatcatatattattttttctctgcgctgtaatattcatgcattgtcaatcacttatctaggctcccaggttcctgtgaaccccctatatcaactaggctccaccactgttaagtacaattgcctttcttcaaaccaagagaagttcagaaagcagtttatactttccaatgcatgtatcgcctattgatttcagtgactgataattggcacaagcagacaactcaccatgtggtttatatgatgatcaagtcacatagggcaacaaagtcgtttttacacacaatattttgtgtgctgcctattaatttcagtttgcatcttgcttcaactagcttgatgatttatcatgtgccaataaaaacatgccagccatgtttaatatgctgaagtagaaaaaaatctgcaaggcttgaaaacctagtgttggatagaaattcatttccccagacggtacataacatatatactttgtcattactagtttatgctggaagggtagaaataactgcgaatgatgggagccatcatattgtaagtgtctcattatttgttctctatttctgttgctgcaaatctgtgtactctatagcttaacttgggcaattatatttgttggtatagacccaa

SEQ ID NO: 69427 - DNA, 1238 bp, Oryza sativa
ttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtgatgcccgtatatacggtcaaatgtattgaatatcagaaagcgaagggtataaagaaatggaggaaaaaagaaggcaagaaagagatgttgcataaacgctctccattaaataattcagctttcatccgtgacgtttcagatgaaagggcagggaaccaaaaggcaggcaaaggtgtgagtgaggctgactagcatttcgcttgctcttatcatcttaagatgatggccggtaaacgttcctgaccagacaaggccccgtgcgaaaattcgatcaatcaatctatgagtggtaacaggaatctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacat

SEQ ID NO: 69428 - DNA, 696 bp, Oryza sativa
cgactcgatctgggggtggcaaattaatcagtgtgatcaacagggataacttatcccgtccgaccaaatccaccaaccaaaccaagacccgatttgttaggctgtgaaagacggatcagtgggaccctgatctacggaccccatatgtcaccgtccaggtctctggatctctcccgtcgtcctaatcagacaccgcgcgcgcggtgccgtcgctctcgagccgtgtcccgctcccaactcgtcacaaaagcgatcacagactcttccttcctctgctgggagagaagaaaaattggccgcgatgatgccgataaagaggaaaaagggatgagaatccgatggaaaaaaactgatgttaatctatcgctactgctgcgcactaagacgaatcgtatccgaacaagaaacgcttacgttactgttcctaaatggatcgctccgctcatcacttaaccaaaaatcgattaggaaattgacggacagcgacgcccgaagccaagtgtctcgtcgcgtaggcgtcgaggcctcgaagcagagggagcggagaggcggacgcgccgcccacgcctcctctccctcggtgacacggccgtctggctccacatggcgccgacctctcccgatgcgtccacccgtcccgaggcaccgccacgtcggaaccagccggccgccccacgcgattgccgacacgcgtcg

SEQ ID NO: 69429 - DNA, 19065 bp, Oryza sativa
cttaaaaaaatgttgtatgagactaaaacaggaaagattcagcttagaattcacactctttcgtaggaattgataatttgcatttgaccaggtggaaacagttttttccagtgatagtctaagccactattaattgtgactaggactttggaacacggcaatgctgtaaggcatcctggaaatttcaatgtgattgtaatgtttaaatgggagcaaaaccaaacaacatacgctgaaaatagttaacctgtaattcagagagtacatctggacggtgagtttgtgaacatgatacaactaagttgaaagcaatgaaaaaactgtgaaaaaacagaaataaaattagctataagtaaaagggactttactaaaatctaacttaatacccactcaattttcacttaacaatttcactaaagaatacatgtaagatgtaacttaaccagaacacaggaagtatctatatatgacaaagtccggacaatgacatactagcatatatctaaaaataacaaatgcggataattgacatttttcatgacctcgtcagtacgcatcaccaaaaccaccatagaaagttcaggcaaatatgttatccacgtttggtgtcctcaatgacctcatctgtcagcatcctttgttgagctacaaccacaaatgtgatttattttcttccattgtactttcctcttcgccgtcggtttccacctcgcccttgacctctagctcgtaaccagttcgtcctactcgttgatgcacccgttggtcggtcattatactgacctttcatgagcaacagcttgtgagcttcagcctctcttaatgtccatagcaggtcatagtacttctcatatcttgcagccctgtattgccgatgtagatgaaggttaattggatgaaatgtagataatgtcttctcaattaactcctcctgcgtgatttctctaccacaaattttgaatcgagagattatgagatggagagctgagtcatattcagacacaagcttgtagtcatggaaacgcaagttcaaccagtcattctgagcttgatataggaccctggccttctgctcttcttcaaatcgatccttcagggattgccataagacaaatggatctctttcagcgcgataatcagtccgaaatcctttgtttaaatggcgccaaagaaaagccaatgcctccctcttttgggtctcggtacactctgaattagagataagtgccgtacagagacctttcatgcctaaatggatttgagcctcaatagcccgttccaagtaattgcttccatcaagagcaagctcatcaaagtcttcgctgttgaaatcgaacatgttttcctacagttaaaagtatttagtctacagatagtcatgaataaaataaagattaaacaaaccatatatatgcgtcagggcttgcaatgatgtcaatgctaatatgcagtacatcctgtccaaactacaatctctgttctataaatgaggctttaaggagaacttatcatattaccaatatttttatgaattttatatgaaacctaactgcatcatccttaatactccctcttgtcataaatatttaacgtgtaggaaaatatttggtccatattgaaaatatactttaaccatagataatttttcaaatgcttagttttaagtaaaaataataatgtgcatagatttatctcgaaaagtactaatcacaatatcataaacacattttaatataaaactgatggccaaagtttcacaattttgacctctaaacatcaagtatttattaccagcatcagtatttaacggctaagcatacagcttagacagatcgtttgtcctgacgccaaatatagtattgtgaaagtgtaatttataaacctgatcaaataccatatctaaaacaattaactaggcttaggtctactcccagtgtcccaaaataaaataattcctcatcccaagaagattttagtaaggagggaaaatgactaagttcctcattaatcggagatggttggtggatagacaagaggtattgaagagtttaggaatacaactttccaaacaaattttgaactctgtgaatcaacttattttgagatggagggagtatattattttttgtgttattgtcttggttgtacttgggtgagttactataagacacgaaatgttcatgtctgtattagggttattatttttcttttctaggcatccctggttgatgtagaggttacgtgtaattcatttttaatgaattttttctcgttatcttaaaaaatgtatatgttatttgtgctactgatcaacaaattaattgttacttatgaactgattcaattgactagccataataaatactagacgaaagtatctggctatgaacaatgaagaacaaagaatctaaaagggacaaggtagccgaatattatcacacagcaacaaacaaggaattaatagtccataacacaatatctcgtcggagaggatgcccctctcgtacggcacggcggaggaaacgggagcaaaatctgggtagaactagagttaatctacatgtatgatgtatctcagcaatttatctttgtagggcaacgtctagagttgaaaatggtcaaaggggaaaatgcggaaatcaaatttcatatattggcgccggggaaggcagggaagaaatcgagaaaatcagtgagatcaaatgttgtgatcttgttgatgagattaataaaggagattttcaattgtgagatcgtggcttccgaacttgaaattggaacagaaaaaaaaaacctttcagtttcacaacactcaccatgatagtgccggacgcgctggccgctgtccgaaactgaccctaggctaaccgcgggcgccgggcggcggcggccgcggcggacggcggtgcagcgcgaccggaacggcgtggttattggattggaaccgacggcgactagcctgagagcgactgttccaatccaacagcggagtagaggcggagagatccatatataggggaggcgaaaaagaaactgacagcccagagaggaacgagtaaacgggccatccgtggacagcccacatggctctagccatccggcccatctagcccacgtcgcgtgtaagttgaaggttcgccgcgccacgcatcaaaccatatctgcatcgacgtgcggcgcacaccgccgcgactaccatttcgactgatagatcacccaccggatcgcacgcactctccatcaacgtgccactccggattcaactaacctcactgcgatgaaacaagccatatgatattatgattgatcaagcgcaatgtgggcagaaaacgcaacaaatcacaccgtcttcggttcggcttcgtgctctggtcttggctccaatggcggcgtttctggtatggattctcctcttgttaccgtacgttgccatttcgtccacggcgagccatggcgttcgtcttgagctcacgcacgccgacgaccgcggcggctatgtgggggctgagcgcgtccgccgcgccgccgaccggagccaccgccgcgtgaacggcttcctcggcgccatcgaggggccgtcgtcaacggcgaggctggggagcgacggtgccggtgctggtggcgcagaggcctccgtgcacgccagcacggcgacgtacctcgtcgacatcgccatcgggacgccgccgctcccgctcaccgcggtgctcgacacgggcagcgacctcatctggacgcagtgcgacgcgccgtgccggaggtgctttccgcagccggcgccgctgtacgcgccggccaggtccgcgacgtacgccaacgtgtcgtgccgctcgccgatgtgccaggcgctccagagcccgtggtcccgctgctcgccgcccgacacgggctgcgcgtactacttctcctacggcgacggcacctccaccgacggcgtcctcgccaccgagacgttcacgctcggctcggacaccgccgtgcgcggcgtcgccttcgggtgcgggacggagaacctcggcagcacggacaactcctccggcctggtcggcatggggagaggcccactgtcgctggtgtctcagctcggcgtcaccaggttctcctactgcttcacgcccttcaacgccaccgcggcgagcccgctcttcctcggctcgtcggcgcgcctctcgtccgccgccaagaccacgccgttcgtgccgagcccgagcggcggcgcgcggaggcggagctcctactactacctctccctggaagggatcaccgtcggcgacaccctcctcccgatcgacccagccgtgttccggctcacgccgatgggcgacggcggggtcatcatcgactccggcacgacgttcaccgcgctggaggagcgcgcgttcgtggcgctggcgcgcgcgctcgcgtcgcgcgtgcggctgcccctggcgagcggcgcgcacctcggcctcagcctctgcttcgccgcggcgtccccggaggccgtggaggtgccgcggctggtgctccacttcgacggcgccgacatggagctgcggcgggagagctacgtggtggaggaccggagcgccggcgtggcgtgcctcgggatggtgagcgcgcgggggatgtcggtgctcggcagcatgcagcagcagaacacgcacatcctgtacgacctcgagcgaggcatcctatccttcgaacctgccaaatgcggcgagctttaggattcgcatgatcaaagagatacatgaccatatgtacataacttgaattttctatcagttgcttttgcaattattctatggaggtgttttcgttcccaaggcgacattccctctgtttattgcatgtcgagaaacacacttttcccttgttctcttgcatatgcttggttgattatgcgtgtgcttggtggtgtgttctgtgttcatgttcttcaaagaagtctgatgttcatctgacttctaaaatgctaaataatttcagctgaatgcagctcaatcactgcagctaaatctgaaatccaaacttaacatacttttatttacaagtgcgtgtatattacacggactgtacattattctccacatccatatctacaagaatacgcgctgacatatgaaaaggtgatcaaagccgaacaacaaatgtatgtaactcgaaattctagccagccaagagaagtacgatcaaataattaaacaacataatatgtacatatgcaaatacgcaatagagatcactcccatcgatcgatcagtacgtgcgtctcggtctcgatcagatcttgccgcaatccgcgggctgcacggacagcacggagttcttgagctcgtacagcacgtggaagtccatctgcaagtagttcccgatgcgcgagccggtgctcgacttgccgatcatcaggcacagcacgtcgccgccgccgccgccgctctgcttaccggtgtaggcgaagtagttaccgaacagcagctccatgtccatgccgtcgaagtgcatcgtcatcgtgggcacggtgacgacgttcttgctcgcgtcgtcgacgaggaagcacaggaggccgctcccgttgacggcctcgtacgtccgagacatccgcgccctgaacgcctccacgacggcggtgtaggccggctcgaccagcagggtcgccggcgcgccgatctggaaggcgacgccgcgcgtcttggccggtgtttgggttgaacgcgaacgtgtcgttgggaatagcgaggcgtgtcccgtcgacggagatgccgagcaggttgacgtagtaattggcgtcgtcgggtaggagaggggtggatgaaacgccattcccgtccatgctggccgtggacccgaacagcacagggctggcaacgttagggttcgacgcgaggcagtaggagaagcggtccaagcccagctggcccaccagcgacagtttgcttctacccagcccaactacacctgtgttcctgtttaatttgatatgaaaaaaagaagagcccacttataccacttaattaatccatcgcccatatatattcttaatttcttattactgtttgtgaagcttgagagggaaatctattcgtgagtacgtttacgtacccgtcaaacaaatcattgcggtagaccgtgttggtgcacccgaaagtgaagctctgcacggtagctgcatcgttgctgccgaacttgatggtctcggtgcccagtatccctttgacgtagttgcggtcggtgtcggtggcgccgtacacgtaccggtacccgcactcggtgtcgctgcacgtcgtgcggacctgctcgatccggcagaaccttgcaggcctggctcgcgcacgccagcggcgagaagctgctcgaattcgcccggtcgtacagccgcgcccccgccggcggcgcggcgttgttgttgcagccgctgcatggggtgcactccacccagcacagatcgctgatgccgaaaagggcctggacggtcaccggcggcgtgccgacggcgagctccatcacgtagtagagaccagcgataacctttgattcaaaagaaattcataggaattttaaaggatttcatttctataggaattttttctatatagccctttgaatctaagaaatgaatcctatgtaatcccataaaattcctatgaaatacctcttctcatgcaagttttgaaggaaatttagcatgaggttctacctcatgttaagaatcttttgagtctttatctctctcaaattcctatgtttttcttgcggctcaatcaaatagtcattactatacttttcctgtgttttacaattctctgttttacacttatattcctatcagaatcctatgttttttctattcctccgttttttcattcctgtgattcaaaggtcctttaatttcatgcatacctccccacttggcaattaggaaaacaataataattgtgtggtgatctttactgatgcaagctagataacattttcatgcacaaagtcagaactatagcggttctcagaatgcgtacatgcgaaggtgtgtgcatgatatgtgctctgcaatttgttactctcctccgtttcaaattactctcaatgatttatcctaagtgaagcatctaaatttagaatccatatagtctaattacacgtggattatatatttatatatgaaaatatttcctaaccttctcgtaaaaaaagacatttaatatgttttgatatatcaaacttttagaaccacaaccagggtaaatttccaaaatttcggaaatttcggtgacacccgatacgatattaattcggccgaaatttgtgaatttttgaatttttttcatgaatttggataatatttgtttaaattcaactaaattttgtttaaaattttggaaatttcagaccgaaatttccgaaatttcgggatttcggtgacacccaatagaaaaccttgaaccgatatagtgaaccctgaccacaaccatcgataatttctcttgtttgttaggccaaaattttaatgcgggtggtccaggtcttggtcatttctaagtccgctcctgcggctgcctaattgtgctaccgagttttatctaccacttgacaagattaagaacatacactagtggagaaatggtttttattcccggttcgtaacctatatagtcctggttttccaaccggtactacgaatccgggactaaagatcgttatttttagtcccgggtgaaataaccgggagtaaaaatctatttttaaatatatagcctctttagtaaagatagagtcagcctaaatccggttgctcctttattcttttcttttcttcattgtttttaatatattgatttcactccatcccgcccccaaaatcccaaatcaatcatccccgaattgtaaaatctcaaattgattattacctccaaatcctcaaatcgatcatctccaaatacatcacaaaatcttaaaaaaaaattacatcacaacttctacaaaattcatcacaaatacatcacatattcacatcacacacaaatcaaatacatctcaatccgaatcacaaatcttaaaaaaaaagagaaaaaaaacctaaatccggcgcctactcccgctgccgcaccgcctgccgcgtaggccgccgcctcggcgtgccgcctgccgccgcgcccccgcgaggccgcctggccctccgcgaggcagcccggtgcgccgccgcacgccgccgctgcagatggggaggaggggggagggagaggaggagaggaagataggagttaaaggagaggagagggagaggagaaggagaggaagagatagtgtgtgaggagaggaggagaggagttaaaaggagaggaggaggagatatgtcgatctgatccgcgcgcacacctctccgtgtatgtcgatctttttttccggttggtgttaccaaccgggactacaaatagatcttttagtcaaccgggagtaaagcgtatgttagatcttttttccctgttgatattaccaaccgggactatagatatatctgtagtcccggttggtgttcaaaaagtacccctgagcttttaaatcgggactaaatatgtttctagtcctgatttttaatccaaccgggacaactgtgaaatctgatcgaccgataaagatggatttctccagtagtgataccgagtgttaccaaaaaggaagtccaaaaaaaattaccatgtgccaagctaataaacttttttttttgggggtggggcaagccaataaacttggttaaccttgggaccaatcgtttctaccatgatttctattggcgcgggcggatggcatatgctctgcatgcagtccccactctcgtcggctcgtcgcctcaattttcccctctccaggcggccactgagcgcgaccgtgtgcctctggcttctttccaccacacgtcccagatgacgtccattgaacgcggcagcatgtcctcggtatcctctcgtctctgattgtgttaaagactaaaactgtaccgagaaagaatccataaaaaaaattaaaaatcacttatgtagaatctatatatttttaatcaaaacaatatgatttctatttaaccatacaaggacgactaaagcaaagaagaggcaccaattcgttttttatatccatgtcgattccccatcaatcaatacctaatatgtggtttgcttgtgtagtggtgcacatatgtgtcctctgtataatagaaaaaaatactagtgcaaattaatacttgaagaagaagctacagtaataaaagtcaagaaacaagaatagatgtcattccaaagaaaagatacacgagacagatacaaaacacacttgaacagtactagatagagttttgcaaattgcaattaaaatcgtacgtgcaaaaataagaggacagtattattttagcaaaacggattgtatatataaacatgtacatctatctcagttgaatgaagtacccatcaatcaattcttaatgtggtttgcttctgtatgaacatatgtgtttctccatataattgaaaatataatacttcgaattaatactttaagaaaaaaagtacaaaaatactcactctatttcatgttacaaattgttttgactttttttctagtcaaacttttctatgtatggctaagtttatagacaaatatagtacattttaaacataaaataaacatattatcaaaatatattcaatgatagatttaataaaactaatttggtgtttaaaatgttgctaattttttataaacttagttaaacttaacaaagtaaaaaagtcgaagcgacttatagtataaaacagaggaagtaaaagttaagaaaagagaacatagttgcagacaaaaacgatttttttatctataataattaattatcccaaaaattaaatatttagtaaatcaggtgcggacgctagagccaacggcgtccagatgtggacgctgtagcgaacggcgtccagcgcaagtccaacccaacatgatcaggctggagcatctagcccaaggtcaggactccacgagtttaggttaactcccccacagatcgaagcaccgaaactagagttcacaagctcgagatcgaggaggaggtccccctttccctccacagtgagcagcgccgacagcgagccggcgagcctcgccgcaacaatcgaggcagcgcatgacggagattgaggagagaaatgagggtggcagctgttggtgcattagtctaatcgagtaaacctagacagttagatttgggttggagcttgggccgcaccactgcgatggacaccgttggctgcagcgtccagagccggacgcgttttgtccgagtgtccacacctggacgctcttgctagcagcgtcctttccatttttctaaataccactactgatttactggttatttaatttcagaaaaaataattattacaataaaaaatggggatacaaacgatagaatttgcaatcaaacaataaaaaaaagagatcgaaatcctgcaaaaatatgacaacactatttagaaaaactgattgtatatatatatataccctctacacctatcttagttttttttttagggagggggggggggaacggagatatattactcattgaatgtgatgtgaaataaaattacaactgtcatccggccagaacacggttaaagattcgcttctgcctttattcgctaaaaaatggctaaatctcgatgaacttttgtgagtatagtctcctttagttgaattgatctatatctagatgaacccgtcaaagaagaaaaaacagaaagaaggaaaactatgcatggaacgagtctgtctttttttgttagaacattaaagcgattcttaatagcaatttgcgaagtttaaatatgcaactaggccggatcatctatgagttgttgaaatggtgtttataagatcaacgaacgctcatcgaatcaacactgcaagattaaacgaaaaaggagatcgagatatatacactcgaaacatggcgtccacagctgctatactagccctcatcctcctcctcctcccgccaatagctctcgccgccggcgacctaaatggcttccgcgcgacccttactcgcatccaccagctctcgccggggaaacattccgaagcggtgcgccgcgacggccaccgcctcgcattcctctcctacgccgccaccgccgcagccggcaaggctaccaccaccggcaccaactcgtcgtcggtgaacgtccaggcgcagctcgagaacggcgcgggagcgtacaacatgaacatctccctcggcacgccgccgctcgacttcccggtcatcgtcgacaccggcagcaacctcatctgggcgcagtgcgctccgtgcaccagatgcttccctcgacccacgccggcgccggttctgcagccggcgaggtcgtccaccttctccaggctcccgtgcaacggctccttctgccagtacctgccgacctcctcccggccgcggacgtgcaacgccacggccgcctgcgcctacaactacacctacggcagcggctacaccgccggctacctcgccaccgagacgctcacagttggggacggcacgttccccaaggtcgcgttcgggtgcagcacggagaacggcgtggacaactcgtcgggcatcgtcggcctcggccgcggcccgctgtccctcgtgtcgcagctcgccgtcggccgcttctcgtactgcctccgctccgacatggccgacggcggcgcgagcccgatactgttcggctcccttgccaagctgaccgaagggagcgtcgtccagtccacgccgctcctcaagaacccttacctgcaacgctccacgcactactacgtcaacctcaccggcatcgccgtcgactcgacggagctcccggtgacgggcagcacgttcgggttcacgcagaccggcctcggcggcggcacgatcgtggactccggcacgacgctcacctacctcgccaaggacggctacgcgatggtgaagcaggccttccagtcgcagatggctaacctcaaccagacgacgccggcgagcggcgcgccctacgacctggacctgtgctacaagcccagcgccggcggcggcggcaaggccgtgcgcgtgccgaggctggcgctgcggttcgccggaggagctaagtacaacgtgccggtgcagaactacttcgccggagttgaggcggactcgcagggccgcgtgaccgtggcgtgcctcctggtgctcccggcgacggacgacctgccgatctccatcataggcaacctgatgcagatggacatgcacctgctctacgatatcgacggtgggatgttctccttcgcgcccgcggattgcgccaaactgtgataataataagctgcatatataattgcgcacgtgtgcggatgtgccgtttgatcttgctgtgtgcatcgaggaggacaaggctctttctcctgttacatcatcctctggaatattatttttcaataatgaaaatggtttgtatatttccgttcatcaccggtctctgcgttggtacagagaaaaaggtcttaaagctagaaaaacaaaaaagaatacggtgatgaggcaaacacccaatttcgctaataagagattaactgatataactttttcaaagtcacataaattatactccctctgttcaggttataagacgttttgactttggtcaaattcaattgactaagcttataaataaatatagtaatatttataataccaaattaggtacattaaatcaataatggaatatattttcataataaatttgtgttgagttgaaaaatattattattattttctaaaaatatggtcaaacttgaagcagtttgactttgactaaagtcaaaacgtattataacctgaaacggaggaagtagcacataattttataggtactgcaccattcaaactagaacaaaagatacatgttccctaccaattgtaatgtgtagtaccattacgtacaatattttgctattactttgatagcatcatgcataaggagtggagccaattaaaacacatagatatagcatgcatcatgttagataactttttgttgttaaaatctacgtcaaattgaccaacataaataatagcccaaaataaaatcatttgcattacgtacaggatcctcataaaacactccttatagccaattaccaaagataacttttctattatagggaagagggatattaaaacagacaacatgataggcaaagaaaaagaaaaagaaaaagaaaaagatgttcaatggtcttttatgcattataaaaacattactatcccccccccccaaaaaaaagcacaatttctctttgccaagtcatcttttgttaggatttcttttttcaaggaatcgtataagacttttattttttagtggtagtaccttttaactccaaaaaaaaaaaatcctcttacaaattcttacattgaagttcatgctcgcattgtacatggatttgataaaaaatattttttttatatagaaactagaaaaacggtctttttatctgtcagggtatgttaactagtcggtaaatcaaatcattccactcaattagcttatgtcctacatttgatcgcccaaaagttatattcatcgctgttgtactcatgcataatctcttccacgtaagaatgttccttttgagtcacatcataaagagaaggtatcgatactgtgtttcaacggtaaagaagaatgtttcaacggtgttgtactcatccactctagaatccagtttgatattctgtcctgatcgatgacgttctaattgccgtgtcccttgattgagattgactatgctctcgattgactttcagctctaagttctaattgaacaagttgtatgaaaagaattaatggaaggagtaagtatcggtctttttcattggcctagctaggaaagaatgagtacacgttcccatctcagggacatatatagcacagaaaatgcatgtcagtttacaacaatcctcttatgacttctccactacatggctacccgtgctggcaaattagttacgccatgcggtgatatatatggcctacatttttatatgaaaatatttcctaaccttctcttaaaaaaagacatttaatacaagttttgatatatcaaacttttagaaccacaaccatcgataatttctcttttttgttaggccaaaattttagtgcaggtggtccaggtcttgaactcttgatccatttctagctaggtccgctcctacgtctgcctaaatgtgctaccgagttttatccaccacttcgcaagattaagaacgtactgagtgttaccaagaaaggaagtccaaaaaattaccatgtgccaagccaataaacttggtaacattgggcccaatcgtttctaccgtgatttttgttggtgcgggcgcggatggcatatgctctgcaatccccactctcaccgcctcacttttcccctctccaggcggccactgagcgcgaccgtgtgtctctggcttcatcccaattcagcacacatcctaggtgacgttcgacgagcgcggctgcaatgtcctcggtttcctcaggactggtctctgattgcgttaaagtgttaaagactaaaactgtacctcgaaagaattcataaaaatcacaacctatgtagaatctatatttttttaatcaaaacaatatacggtgactaaagcaaagaaggggcatccgttacaatttgttttgatatatccatgtcgattccctatcaaccgatacctaatgtgtggtttgcttgtgtagtggtgcacatgtgtcctctatataactaaaaaatactagtgcaaattaatacttaaagaagaagctacagaaataaaagtcaagaaagaagagcagaggtcattccaaagaaaagatacacgagacagatatatacaaacacacttgaacactagatagagtttgcaaattgcaattaaaaaattaaaaaaagatattgaaattgtacgtgcaaaaataagacgtcactattttagcaaaactgatagtatatataaacatctacatctatctcagttgaatggattattacccatcaatcaattctaatgtggttttcttctgtacggtgcatgcacatatttgtttctccatataatcgaaaatatactacttcaaattaatagtttaagaaaaatagtatagaaatactcccttcatttcatattataaatcattttgacttttttctattcaaacctttctgcgtttgactaagtatatagaaaaatatagtagcatttttaatataaaacaaatatattatcaaaatatattcaatgctagatttaatgaaactaatttggtgtttaaaatattgctaatttttttaataaacttagtcaaacttaacaaagtaaaaaagttgaagcgacttataatataaaacaggggagtaaaagtcaagaaaagagaacagagttacagacaaacccgaatttttatctataataattaattatcataaaattaaatatttagtaatcaggtgcggatgctagagcgaacatcgtccagatgtggacgctgcactgaacggcgtccagtgcaagtctggcccaacgtgatcaagctggagcatccagccctagtctggactccatgagtttaggttaacccctccacagatcgaagcactgaaactagagttcacaagctcgggatcgaggaggaggtccccctcccccccccccccgccacacagtgagcagcgccgggagtgagccggccagtctcgccgcaacgatcgaggcagcgtatgatagagattgaggagagaaatgagggtggcggctgctgatgaattagtctgatcgagtaaacctaaacagttagacttggtgggagcttgggccgcaccagtgcgatggatgccgttgtctgtagcgtctatagcccaacgcgtttcgtccgagcgtccacacttggacgctctagctagcagcgtccttcctatttttgtaaataccgctactgatttaatggttatttaatttcagaataattaattatctattatatactaaaagtccattaaactttctataaacgctcccaaaccgtcatgcagcactctacaaacgtcctacgccgccacgtggcgatctaataaatagagaaaatcatataaattctaagaaaaaaaagcaaaacatccaattatcgatttttatttaaaatggtggacccgttaataaaggttttatatttgaaagaaggttttaaatcaaaaccaaatcaagaaactcctaaagatagattgtaaatgaaaatcacaaaagaaattaaacataagagagttttatgggagttaatttttaggggggtccctctaattataatttcctaggtttacgagggttaataagaatataagaaccggcatgatgcaagattagaaaatggttaattttcaggatgttacagagtatctaaattatttaataaggggaagagagcatagtaaggtaaatgttggacagataatccatttatatcgtggttggtagcagtgtacagtctttaatcttgttcagttcggacttgatcaaaattcctgctaagtcctgtcgaaatgtattcatatccctctgcataatgtaaagggagtgcattttaaatggttttcataatgggaagcattggtgcaaaatgttttcatatccctttatttggttgttttgtttcctcttcttttcaccccgtaattcgtctatgtctggcatgataacttctttattcgtttgtgcttgaaaaggaggaaagttagtaccattcacatgagcatatgtcacgatgaattagcatagtacctattgttttttttgttggtgtttgggttctgattatgtcctttttaccccttatttcgtagatgaagtcagtccgatttgttggtttatatgttcttcctgtaggacctgtaagcctcttgttgctttgattgcactggttactgctgtcctgttaggtaataatgttcacgttagtattatgataagttgttgtaacgttagagagagaattaaaattcactttacgttcgtttcacaagtcatgtttacatttgggtttatataggtctctttgtgatgatttgatcatataggctcataggatcaatttgttcttgttcaacatcttgcaatagcgtcaatctttttttagcgatgttacataagtaatattgatttacagtctactttatgatatttacctcaaacacatgcatagtatcttttcaatttgggcattttgaatcattttcatgcaatctagtatcaatgatcgcatacgtggccaaaaatccattgtgaaaccgttgaaattattctctaaagtttggatcctttcttgtagccttccttgtaaagtgatattggctgattgttcagtggatgttatagagtgtacctgaatagcacaagtgagaaaaggatgtcaaacatattttgttaaatacagaagtgcattgaaaatcttgattgctatgtgtatctgagtctttgtcctgctctttttcattgaggatttcattgcaatctatagttcccctaatgttgtcgacaacctatgttttagtcaaaaatgtttattagagattttacagacaattgatataattaatacatagtattgaaaatgagatagttaccttcccttcaccaaaagggtaagaaattcggtcttttttattttttttggtcccagtactgaattagtggcttgacggccagaataatatattgtcgcggccaatttatctaatcgcactttttcccaataccaaatctgcaagcatttgtacatgataatcaataccgtaataaaaaaataacggagttatatgtgcatgccatttttttaaacaaacacaatttgttctatgttttgtaacaaacctataagaggcatacgttcccctcaatgtttgttgtcttctctctaaaacttaatatgcctttgttgtcttctctctaaaacttaatatgcctttcattaactgattgaggattagacttgacccgtttagttcactcattttgtccatgtcgtcaacgagattgagatattctgagcgcacatatctttgagttgtacgacatatgaatgatccaattgagaaaagaataaatcttcgtatgaagtggtcatcatagctagaagagttgaatattgcttcctgtaatgcttgtaaagtaattgttgtttgtccttcctttttgtacaggttgaacaatttaggtttgttgatttttggtgcctcaaatatcttctctccttttgatgtcagtccaagcaaacaatagacatcatcgagtgtcattgttatgaaggtaccatttatattaaaggcttccttctccttgtcgtagcttcttgcaatctcattgcacaagtttcggtcaatatgaattttgttaatctttagcaagttgcctgaatcctcgatagcttgcttttgacgtggacatagttggagtcctagctcatacatggcgtatggggagcatactagagttccctgattaacagagaagaaaataagagtttaggccaatcttcgtacataaccttcacaagaatacccaatcaaatcatatcagtgcatatcaatgcatcatggagttcctttagattcaggctagtattatgctcaacatgttcttatgaaacagtagttgtataattgttttagtgttctagttgtgaaaaattagtaatatgaactgatgtatggttccaaactttcagatccagaactatgattattggattgctagatagatgcagcagcggcacagctttggaaaccaacagtgtggcagactagcagtgaaatgcttgaaggttttagcatggcatgcggtcttgaacattttcatttcaaaagatgggtatgattttgtgtttttgcttcgacacttagctaaccagacattcccacagagcagaacagatttgaacagcagcacagcagagcagaacatagatcaagttttgcatgttttgaggctatata

SEQ ID NO: 69430 - DNA, 663 bp, Oryza sativa
aggatctttcttttggtcttttgttaaggtttttgatgtttgcgtatagtcgcggttatcggattttcgtcgatcgcgggttttctcaaagattcgtaaagcttcgtgaagaccttgagcaaggcaagtcaccctttgatcaattgctcctataattgaaaagtcattattattttgtttgcaacttgcattataagaatcacacacttaacttgctggccctcggtttgcgtgccaaatcgacggacctacccagtagtcgcactaatttccgtaggtcgtactaccctgattccttgtcgctccacccttgtggtacctcggtattcgtgctctctgagcgcgtataccaaatatcccacatacaccgttgtttgttgaaaacttgggaaatgggtttgtgaagccttcaaaacccgacatgtggtgtcggtgtgtttgaaaataaaatgaattatgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggt

SEQ ID NO: 69431 - DNA, 14300 bp, Oryza sativa
ttagaattgttcctctgtacttgcctgtcatgaaaggccatcaacacagagcaaaggaatgcaatttttaaaggcctctatcatgcacccaaatgaccagaaagcccgacgaagaacattctccccatattcattcacctcatcgagaatagcaatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttatgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgctcactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctctggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttctacatattttaacacacaacatatcaataatatgtactaactaagaactaatttaaccgtacaattacttagatacctctaccagcatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgaactggcgactctcggcggcggctggcgatgtggtcctcgaaacaaatcgagctcgcggacgggccttttaaaccggcctgtcgaacgcccattgttcgacagggtcggtggagggccctgtcgaacgcccccggttcgacaggcctcgcggcgccgggtggtgggccctgtcgaactccctccgttcgacagatgaggctgtcgaacgcccccagttcgacaggcctcgcggcgccggtggtgggccctttcgaattccctccgttcgacaggtgagcgtgtcgaacgccagccgttcgacaggtgtatgtcgaactgcacccgttcgacagggacctactttcgcgattttccccggttggccactacttttgcgattttccataaaaataatattaattctcaaaaaaattcagaaaaagtgaggaagtgggtcacttgcgcatgactggaagcaggagagaaagagagagggaatatgatggcgaagaggggagggactcgccggcgtaggcgaggagggcagggtggcggcgaccacgacgccagcgatgaagccactgccacgtccatccttgcgtcgcgccctgacgagccgtcgccactggatctggcgagcttggccaagcactcacgccgtcgtcacgactcgccgccgcaccccgatgagccaccaccaccggatttggcgagcttggccacgccgtcgtcgcgactcgctgcagccgcgcgcccgcgcgtcgtgcctcgacgagacaccgccactggatctggcgacccttgccacaccattgtcgcgactcgttgccatcgcgccatgccccaactcgccgcaatcgtcgcccacagccagatccggtgagccccgacttgcaaagctccagtcagcggcgaccttcgcgaggaagacgcaggtgaggcggcggtggcacgcgagaagaggagaggccaagtccactgccgccgtcgagtgccaagcccgtcaccgccaagctccatatccgccatcgccgaggcgggcaggggagggaggcgccgacgaggtcgctgggaggtgagaggagaggaattagttgaggatgggatgggttgggattttggggaaatgtaaaaaggagagagagagggaagatgaaaagatgtatgttatgggatccattataattagctttgcactgtgagatgagttgctttgtagaagttctatccaatatatgacatcccgggtttggtcttggtgtgcaacgcactgtaaacgctatcaagtccataaaaaacataaatagacaattataggcttatgggtatagttaattaacatacgtataagtaatttaagtcccacggctgcctcggttttatgggtcttagaaaggtatggaaaggtatattttgcttttgatggaacgtccctttttcttcatgtcgttaagaagattatttttaagaaaatattgataagatagccaatatgtgatgtgctgcttcaaagtttaaatttgacctatgtaaattaaaacaataaataataagtatgattgctaataatacgtactattggcaacatatttgttatttttgtttcccatgtatatgttgaatttgagcttgcatcttttacggagtgccttaccaattttttttataactttttaggtgataatggcataaaatgattggacatcctcgagaaaaaaaaagaccattccctgtaaagttattatgttggatatatatccagtagcattacaaatggttaatcgatgggtagcattttcggttaggtagaatcaagatagatgacttgattaaaaaattcaagcgcacgattttctcacttttaatatatactgtttttggctaagatatgcaacctgcatccccagtggtcttttcttaatgccataacaaatttaaaggcctcacctgcacgcttgccaatcgaacagacaacgtagtgatagtcacgggacgaacaattccaattgctaacgcgcactataatacggaagtagttgaagtgttcaaagttctttggctttatatatatacctaaagacttggtcaaaattaaactcagatccgattatattggatatcgaatcaaaatttcactttcgagcttatgtgaataacggaaattatgtttccagtcaagcatgttgtcacgttttacaagggcattaagcatgactataattgactaaggtgaaaaatgcattcacaaacacaccctgataagatatctcaattaagcggtggaggaagctcgatccccggcaggtcggacgaacgcttaggtttcgccgttattgtcttcactactgatagccgtcgacacttataaaaattagttaattatctgaaaacaatgctagtcacctaagcttgatggtgctgctagctcttcatcattgtctcaattagtttattgaaggacacacatcactagtttgtcaatttcaagttctcctttttaaccattcttttttatcgatgggatagtcaacatcttgaataaagttccttttatatagttataataaaggttttagaaaaaaacaaattgcatgatatatatttccaataataaacgactggttatcttcctctcctaatacatcctaattaagtgatgcagcaagatgtgagatatgtactcgaatataatcacatttcccgcgtgagaccacatcacgttttttttcacgcttaattagttttgtacattattatcttatggagtagtaatttaacttaacatatagtcatataccagtaattaactacgtccgcgaactgacctcaaaagtggaatccactgtcaccaaactcaccatgagttcaccacccctctcaagtagctagattagagaaatagtagagttaggttcatgaaaggctagctactaataatcaaacatcggcacagtggattgttcaaacatatatatatatatatagctcttgaaaatgagatgcatggagcttaattattggcattgtttagtgtcgcaacgcgctctatatggcaccgaccacgtgattagtattacatcgtcctgattgatcaagtgctatagacttgttcgatcatcctcatttgcttgattacataaagtattatttctagcaccactatgcaataagaaaaaaaaaagagctcgctgatctctcagccaccatttagttaataagcttgattaggcacagttgttagcttaattagctcggcagcttagctaagctattgtgtgtttcttgctgttaaggatactccgtatgaaatagccagtggccggcctagctatagctatagctattatctaggctgtttggtggttcagtactcctccgtccacacacacacacacacacacaccatgcgtatatattgcctacggcagtacggggtggccaaaaagttgaagcatttctggattattggcacgcgataattaattaaactaaactaaagctgggtgatcttagtttggcctttttttatgagagagagagagagagagagagagagagagagagagagagagagagagagagagagagagagagagagagagagagagagagagagagagagagagagagaggagtttgtttagttaccttcagaaatgtgaagtcaaggcgtctaagcttagtgtgtgacatgtgcaggcacattggtgcagtaagccagtaacacgtgcaagcaaatagccactactctctgagtcacctttttcttaatctaaatttataatctgtcgatcgaacaagtgcgcattgccgcattggtaatttgatatggctcttatatgtccgaagtacgtccattgggcgtgtcccgatccgccgtcaaacaacagagcgtacgcacggacgtaggcaccgtcgcaccgaccaactagctcgccgcaagctgcgttcgatcgttagtactcgctctgttttaaattatggcgtatgtattttttttacataactttcaataacatattttaaatattaatttatttcatattatattctcaactaatatgaaattaacatatcaaatacttcaaatatataaattcagttatataaaatgcataatagttagcatagatatgactagtaaattagaagttattgagtttgaattatatgacgaatgagtaatacgtagtactagttggaaatattttcccttcacacgtaaaatgcgatagtatattgacatatgattaattaaggattaactaaaaaattaaaagattaaaagataggttgatatgattttttcacagtaagggtgtgtttagtttgcaccaaaattgaaagtttggttgaaattggaacgatgtgacgaaaatttggaagtttacgtgtgtagaaaagttttgatgtgatggaaaagttggaagtttggagaaaaaatttggaactaaactccgcctaacttatctacaaaactttttaaaaataattacattatttagcactttagaacgagtggttatggaaaacgagatgaaaaatatagagtttcgaacgagagtgtccacctcgactactccgctcccgtttccgctagccgaccaggggaggaaagttggagtgggctaatcggtttctgaactaggccggcccattcagagcttcttgtaagcccagtaagctttgagagggacgggcccagttagccagtagggctgatttgggaacactaaaattaaagcccgcccctgtcttttatgggccattgttttaggcatgctcttaatgagacaaaatacaccttatttttgtatacgaatggaataggattttcagtgaagaatgatgtttgttgatcagtggatggttttaaaaatatataatacgtaacgtacccacatgtactcttttactaaaaccgtacgttacgtatttgcatgatggcattcgctagattacagctgtttgtataagaatgtttcacataaagctttgacactcatattttactgtcttcttttatttcgttgaagaattcttctccatattctgtaaaaaaactggacattcctttatatatattacgtacgtaaagtacccacatatttggtcagcttacttattctagcttatttgcacgcaatgtcaacactgatcaagacactttgtgggctccagctgtcctagcttatattcatgtttaatttagcgttgattatatccatgtcacagcaaatttacctaattaaaaaaatatcattactatttgtgatatatgttactcctacgtgctattatatttttgtaaaattgggattatgctatcgccatcaaaattcatatcatcttatttcctaaacccattcttcattctctctatattctgttcatctccccctcctctcttggatctggcggccggagctctatccaattacacgtggtgcacattttttttttcaaatcaaaacttatcaccaaaccaaatcagcactgaaatggtcctgcgctatatcgaagcaattaatagcaaacaaggttgaaactcgacaaggaattcattgcatgcatgaacacacatttgataaccgatcgagcgtagcgcaagccccattcaattcacggaagaagctgcagaggattcgtcaaacaagcatagattcgtcgcagaacaaacaaaatccagaaatatcttataaactgaacccccaatctggatcatttcgatgtacaccaaacagaacccaagcgacagcacgtacggcccaaatccagcccacgctatcgctgcgccgttggcgacaaggcactcggcggccctcgcgtcgtgccagccatggacatggagcgcgcgtgcggctggcgtagcttcctcatggcgcaacgatcgacgtcttcagacttcatccagcagcttcctcatggcgccggtgtcgttctggtgcatatgtgccacaggatcaacgacgtccgcgccacgtactattggacggtttcatggagcttacataaatactccatataatgatctcatatggggtcaattcgagatcatactgtttgatatgatctagctaccgttatttgatctataaattctactattctagtgttaacctctccacgaggtaaatactagtacgagatttacactctcgagtaagtgaaaagaggaagcagctgctagctttcaatttgctgagggcactgaaacgcgtggtgttcgtcaacttcgctgccgccgttctggggctcctcgcagccatcctcgggttcgtcgcggaaggcgccaagtccaatgcaagtttcaccttcatctcggtctcacttctcgattagttcttgtgtgtgtgtgtttgaatttgacgtctcgtgtttttttctgcgtggatcgatcgatggagatgcagtcgttcgtgcggttcgacgggaggtactgcgtgtaccgcgccacgccggcgctcggctgcgggatcgccgcggcgatgttcgtgctgtccggccaggccgcggtcaccgcggcgagcggctgcttcggccgctgccgcgcgcgccgcggcgaggagtcgtcggcgcccacgccgggcgagcagcgcaggcgctccgtcgccgcctggctgtccgtcatctcgtggtacgtattaattcttgacttgttgccacagcatccgcacgcgcgcgcgcggcggcgatgaccattgtcgacgtcgctgcagggtgttggtggcgacggcggtggcgatgttcctgtacggcgcgtcgcggaacgcggccgtgaggagggggctcgcggcggccgcgctgggccggcgaggcaggcgaggcaggcgccgcggcggcggccacggccgcaacgtgtacggctgcgccgtcctcgggagcgggctgttctcggcggcgtccgtcgcgtcgctcgccgcctccgcctgcgggatcgccgcctacgtctacgtcgaggcggatggtgaatcattgacactcacgccgacgacgccgccgccgcggcctggtgggttcgccggggcgccgggcgcggcgacgggtggtcagccgtatttccagccgcaggtggcgtacccggccacgggctacgtcgccaaccctgctgcggctcctcccccaccaccgtacggcggcggcggcggcggcgactacgccggctatgtcgccaagtcgcgtgaaggcacagcttgagattgccaaaaaaaaaaaaaaagcgtcgaagtaagatcgcgcgagaggttgccaagaactctgcctttgaacttgtcgaaacatgatttcggcaataataaaagggggtagcgcacgagacctaaaagtggatggatgcggagacaaaggatttagacaggttcaggccctctcgatgagaggtaataccctactcctgtttggggatttgaatccgccgagtgaattatagatctgacgatctagttgtctcatgccccttagagggcctcctgcccaccttatatagggtggggggcaggattacaaaatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaaacaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggactaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtctagtctttgagcatataaaatagacccatgatcatgaattcatgttgcatgtatccggagcaagtccaaattgaagatataatacttgtatttgagctagtaagcccctgagcacgtagtcacaattgttcgttgatggttgctgacgcatttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacaacagagatgtcagggtcgatgaagcagaggtgctagtgatgatgtcagtgacaataatccatcaaattaatgttataactgttgtagatgcttcacttggaggagagttgatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagcaaaacttgtgaagtagcagcaatagagtttgcggtagtgaagacgcgcagttgtgaagataaaagcactagtcggcggcgacataacacgagtcggcggcggaagacgatgatgtccatcagtagtggtagctgtataaaccaaatgtagaggtaagggcactagtcagcaacagacgagacgaccggcgattaagatgtagatgcccaacaacggcggcataataggccagccgtgcaggcggaaacaccagtcggcgaaggacgaggcggccggtcggtgaagacgtagacgcccaacaacggcggcataataggccagccgtgcagacggaaacaccagtcggcggcgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcggcgatggaggcaggccggtggtggagtcgtagacgcccaacaacgacggcataataggccagccgtgcagacggagacaccagtcggcggcggcgaaggcaagccggtcggtgaagacgtagacgcccatcaacggtggcataataggccagcgtgcaggcggaaacaccagtcggcggcggacgaggcggccggtcggtgaatacgtagacgcccaacaacggtggcataataggccagcgtgcaggcggaaacactagtcggcggcagacgaggctgccagtcggtgaagaggtagacgcccaacaacagcggcataataggccagccgtgtaggcggtgacaccagtcggcggcggcgaaagcaaaccggcggtgaaaatgtagacgcctgacaacggtgttgtgaccaaccaaccgtataggcgaagacaccagtcgacggcgacgacggcgagccggtggtgatgttctgactgatccattactggagcgtaagagataagcttaaagccatgaatcccttttatgcatatctggatttggatcctgcagaacaaacatataggatgagtagtatctgatgtaaatataatactcgagaaaaattcaagcagtttataaatacgtatttcttctcttgttaattttgatttccccgagcagatgactcattacgtttaaacactctgcccgactagccatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtggaaccaagccagtggtgtagatgatgaagcccattaacggcggcgaagtccgccaaccgtataggcgaaaacaccagtcggcggcggaagcaagccggtcggtgaaagcgaagacgtccatcaacggcaatgaagaaaccaatcggcggcgacggaggcggtcgacggtgaaagcgatgcccaccaacagcggcataataggccagccgtataggcaaaaacaccagtcggcggcggcaaaggccagccggtcggtgaagacgtggacgcccaacaacggcggcataataggccagccgtgcaggcggtgacaccagtcagcggcggatgcggcggccggtcggtgaagacgtagacgcccaacaacggcggcataaaggccagccgtgcaggcggaaacaccagtcggcggcggtcgaggcggccggtcggtgaagacgtagacgcccaacaacggcggcataataagtcagccgtgcaggcggaaacaccagtcggcggcggcgaaggcaagccggtcggtgaagacgtagacgcccaacaacggcggcataaaggccagccgtgcaggcggaacaccagtcggcggcggctaaggcaagccggtcgatgaagacgtagacgaccaacaacggcggcataataggccagccgtgcaggcggaaacaccagtggcagcggcgaaggcaagccggtcggtgaagacgtagacgcccaacaacggcggcataaaggccagccgtgcaagcggaaacaccagtcggcggcggcgaaggcaagccggtcggtgaagacgtggacgcccaacaacagcggggctgcaggaa

SEQ ID NO: 69432 - DNA, 709 bp, Oryza sativa
ttacttataggttaaatagatgataactaatggatttttgtgtcgtgatccggtttatcgcatctagagatgcaagtgggtcaatttatgaactcatttataggttaagttaataggtaaccagtgagtcaaacccgcgggttacccactaattttgcctataagcggatttgctgataagcccgcttgtaaccctagtgagttaaacccgtgggttacccactaattttacctataaacggattcgcggacaaacccgtttgcatccctagagaggaggggatagggaagaaagtagagagagagaggtgggatggcatatgccccctctctatttttcaattcctatgatgattggactgacggcaatgttaaccaatatccccttaatattattttagaagtcatttttattacttttaatagttaaaagagtcattatatctgattttagtaggtaagatctggcctatatttaagagagttaaagtggattttttttcctaattttgtttcaagtttgtgggcataacaaatccctgggtctttctccaacctacattaaaagctaatgctggaaagtagagtatgatgagaaaaaaaaacaactctaaaattaagttagaaataaaaatttggacagaactaatatgctgccagctttgccataccatgaaataccggtgcttggttggtttgcttaagataa

SEQ ID NO: 69433 - DNA, 782 bp, Oryza sativa
  unsure (1)..(782): unsure at all n locations
acggctttganattgttattctagctcggtacccatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatatatatatatatatatatatatatatatatatatatatatatatatatatatctctcacgcgagaaaaatatgtatatgtatagacatatatggtgctgatctctgaacgctgttataattaatttcagtatatatatgcatgcacaaactacatgcctttttttttgtgctgtaaagaaaaaaataatatgggtgagaataactataccccgatggtttttacgagttaaaatttcaacaaaaaactttgaacgatatatattctgttttcagaaaagcgcccagggtgttgtccacaagatctaatttattaaaatagtgatgtcaaaagctatattgtcacacacggggagagaacgggagtgttaagatattagcagagaagatactcggacgcccactgagcttgtagaaagagatggagaaagatgcttttttatgagaagatccacacacaagcaaaagtgtagatatgggtatctatatgtttaacacccacacatcaaattatgcgaagacggggtagttttcacgagtgtttcacacatgcttgcaaaactgtc

SEQ ID NO: 69434 - DNA, 669 bp, Oryza sativa
  unsure (1)..(669): unsure at all n locations
cgctggttnaatganattgcacttcgtaccccaccgccatcctttccgcgctctcccgccacgggcgcccccgggaggccctctccctcttctccgccgccgcggtcgcccgccccgacgccgagctccttttctgcgtcgtctcctgctgccgccgggcattcgcctccctccccgctcgcgccgggcacgcctacgggtaaagaccgcgccactgctggccttctacgcctcgggcggcccggcgctcgtcgcgctgtattcgatgtgtgggagggtgagcgccgccaaaagaatctttgatcgtatggacggcgaggacgtggtgtcctggaacgcgatgattggggggttcgctggtgccgggatgaatggcaaggcgtgggattgcttccgggagatgcgcgcaagaggtgttcgagggaatgcccgtaccgcggttgctgtgctgggggcttgtaatttggagtctgaaagacaggtccatgggcacatggtaagaacccatggtgatagtggttcaaacgcaattttgtggaatgcgttgatgaacatgtattcacgtgttggatgtgtcgacaatgcagaacatgtgttcttcgagattgaacggaaggatgttgtgtcatggaatgtgatgataggtgctttcgcaaagaatgggcatgg

SEQ ID NO: 69435 - DNA, 709 bp, Oryza sativa
ttgcaagatgctagcgctgctttctcaaaaccagattgtgagctcccatctccatcagctgagccgttgctacctactccagtatcaacactggagtccttgtcatatactagttgcatcataggcaatccatctttctgttgcaagtgattctttggcaccatgacaataccgttcttaggagcatggtagttccctgatgactgagaagtaccctggtcagaagataaacttgtttgttggtacagtattgatgtttgcttcttgtacttatatctggaaaatgcttgacatgagtttagtgcatcattttctttggcatgctccatttcaattctctcgtctggtgaatgctgattacatgcttttctcctctgatttattttcattgaccttgttagattatgttgtgcaaccttgttaatgttttcagtacatccttgttctgaatagctgaatcaaccatacatcctgctctagatgtgttctccacattaagtttttctactttttgccacacagaagttgaactgtattttccactatgcttgttcttattagtgcctattactccattagttgcagtcaaactgtagctagatatttcctttaatcttgttctgctcctcccaggaataactggaagagaagtcttgctgctgcaggcttcactactgcacttgactctttcagtatgattactgctatc

SEQ ID NO: 69436 - DNA, 16403 bp, Oryza sativa
  unsure (1)..(16403): unsure at all n locations
ctaaactcgaaattaagctaccatgaggcagtgttaagaaaggatagatgctctctccctccgttccaaaatatcttattttaagagtaaattgcattggtggtacataaacttgttagttgggtgcaatttagtatataaacttgtaaaatgcttgtttcagtacacgaacttgtctagttcgtgcaaacgaggataaaaataacttggcaatgttaattttacgaagctgatgttgattaggatatgacgtgcatacgtgtagtaagtatacataagacatgcaatatttataaatttggtctctaattttatcttttatcatggaaaagatgaatttggtatatttctaacccttataccattgctcggttttttaatctttttctactatcgctatatcctactctattttttattgaagcttttttattgaagaggtgtatttctaatagcaaccttctcagatatatgtttacatagtatcctaaccagccctaaatcaataagattagccatgttttattgaagaggtatatgtctaatagcaaccttctctcagatatatgtttacatagtatcctaatcagcccctaaatcaataagattagctatgtagtgtctttttcaccttcctccgcacgcacagacaagttcatataccaaagcgagtattttacaagttcgtgtactagattgcacctacctgacaagttcgtgtaccgatgattcaatttactcttattttaatatgggatgtgatataatcgtagtgttaaaatgtgtcacatattttactaggttaatttattttgatatgacacgaggataatatttaattaaggtcttgtttagttctaaactttttcttcaaacttccaactttttcatcacatcaaaactttcctacatatacaaactttcaacttttccatcacatcgttccaatttcaaccaaacttccaattttaacgttaactaaacacaccctaaaacacaccctaagtactgtaaggaattgcattcaccgatgacaggaagtcttgtcgtaggagaagcactaggtccgtctttttgagtgaatatgcgtttctgagtttgagccagccaagaggttcatggtaccaatgctctattattgcacaagagtgcacgtgaacacgtcaccctgaacggcctgcgcagtgcgcacgagagccaatacatttggttttgcacctttgcttatcacgggttaatcacaaattatttgctccacacttttaacaatacaatttcttaaaaaaaaacgttttctagtgtattgattaaactacttattctaagttatttgttaaatttatttattaaaatatttaatttatacctttaataaatatataatgtgcatcaataatacaataaattattaataatttggttcaatcactgccatagatgagcaaatgtagcagttgctagctagctactagctagtagtagtaccacttatatatgttaggttcagctctatgctagttgcagattgcatatgagggccattcctttggatccatatgaagccgtatatgagttataattgcactttcgcgcgcgaaatgattgttcttcatgtatatttttttaaaaaaacgaatgttcttcctatctcagaaaagaaatctatctcctttcaaccgcatataaatagaaatagttggttgtaactaaacaccgcatctacaaaccttaatcttcactaaaccaggatgatctaaaaaacggtgggcgcgacgcataacattgcttataaagcaagcaagaataaaatgatcactctaacgtgtctaaataagtttcagaaccgtcggaccaatcacagccacatctgatgcgatatatagggcccaccttgttagaactcgacgtagatggaccccccgaataacctataatatatataaaatattgttatccgttgtcgtcttgcaacactaaccatataacacaaattgtttgttgtagttttaataacttgggaataaaatgttcagacttcaaaatggttttgaccaatttcctcctatctcaagacatcatttctaataaacttaattaggtgacaaaagaggacatagattagagagtaaataactttgagagatgtggatatatatgcatccctgcgtttgttggtagctcaaatcattcgccacaaaggatcgccgctagcgattcctcgggcaactgctcttgcactgtttcaggctttggtgcagagctcgaaattggccatgtctggccaatggccatacgccaaccgtaatgactgcagccgttgtcatgtgacggccatactgataaatgtcgccatagtacaggacttgcacgttgcagcgtagcaaacgagcataggatgcagccttcccgatgtggcaagcagcagatgcagctagcggcaagccggccggcgacctggcttttaatttccgggcactgttaacttttggccatgctaaagtctcgtggattccaagtgtcaatcatcgtctgcatggcagagggcaaaaaaagcaagatcttgtccaacaaaggtaaccatcggtggttatagctttgaccatgggtgcaaagcacaacgatgagtatcgttggttgaatggttgtccagcgtttggattccgttctcttggtaattggtctagtagagcctaagtaaacatactttagagaattttgtggattaaataagtattaataatttgttgtttttaatagtttgatctggcacaacttaaaataaatcaggtagatgaacaaagccgtgcaagctccgacaaattaaagtaacctagctagctagctagtaagcattgtatgagtttagtagataaaagataagctttgactcttaaccaccattcaacaacatgttaacccatgacatggcgttcgagagaagtttctcgaaatataactgctatgcatgtgcatccaatcaatgagataagagaggatagcataaatattaacacgaatcaggtcaatcacgtgtgggagattcgcattgtcgataccctttatctgtatgaccaattttcaggctataggtttcctacttttgtcgatattgggccactctttgttttattaaaatagatattttaatttgtacaaaaaccaatttttagcacgactatgaactgcatcattatttcggcttgaaatctactatgtaaacattataaactttcaaataaaactatatgcatagtttctatatatatggtgaattccccctttaaagaaatgatgaccagactgggtttatcatgaatgctacaaaggttttaggccatgtcaacttaataattgtcgtgtagtgcttgcaaattcaagtggtatattttttctaatctgcccatgaccgatgctgtgtgcctgtgtggtggactggtggatcatcaaaacacgcgcagagaactggttgcaatggttaagtttccgttaatttgttaccgcaatgacaattaacagcacaataacgtgcatgagtatagtattttctctaaaaaaagattatgtattaaaaccagaaatatggtgcccactagatgagtggaattaatatatcatattaagaaatgtagcaataaccatcattaggcacaggatgttcttatcataaaatatgcattttggtaggacctttgattagaaatttttctgtttataatatatttatttgcaaaactggttataataatatcgaatagattaatcaaagataggaataaaggaaacgccaaatagtcaacattaacaaaccacgaaagattatagcatactactctaaatgaaaaactttaaataccacatggaactgtgctcttaattaattgtgtctttggcaatatataacactaggaacttctgctatatgttggactctgtggttgtgcagaaataatgtggtttttgataaatcaccatctattacatatatgcaggtaatttttagggcaacatactggctccggctctggactcaactacaaaggtctaatgaagatggtgagttcataaaagttgcatgccagaaacttgagacgatggttatgcaactctttaccaattttggatggagattcacaaatagacttcaataaatgtgttctccttatcttagtttggtctctctttaaacattggtgattgttttcgatgtctttgatgttttgttgaactacactcttctagagtgttagattgtaataattggttgtagctctttgagcaaaggccggaatgttattccattatctaaaaaatataaactaggatacgggcgctcgcgcactagtgtacctggtgcgtattatgtagaatctgtttaatatgcagagcataatcttttttgtgttttcaatataagaaaacttactacatttgttaaataggataaatatattcttctatttaaaagtatgtttgataaatttacattcgtaaaataaaatgtgtatatgtgaagttttcatcctacttttgtccttcatatatctatacatttaattatgagtaaagttcatcaccggtccctaaacttgtaccgatgtatcatcctggtccctaaactcgcaaatcaaccgtttaggtcctcaaacttgttcgattgtgttatccaggtccctaaacttgcatatcactcgtttaggttctccaacttgttcagttgtgtcaccccggtccctaaacaggacggtctaaaaactttatatcaaaaaataattcataactttttcatgtgaactctaatgaagacaaactttatatcaaaattgtagccctcgacgcgacctacaactttgtagttgaaaagtttttgaattaaaactgtttagggtcccaaaatattgttgcatgtttatagattttgaaattttaattttaatattacattttgggacaaaaaatgacttataataaaaaaaattcaactacaaaggtgtagatcgcgtcgagggctacaagttcgatataaagtttatcttcattagagttcacatgaaaaagttatgaattatttttaaatataaagtctttagaccgtcctatttgatccagatgatattcaaatccaagtttagggaccggggtgacacaactgaacaagtttgtggacctaaacgagtgatctgcaagtttagggacgggatgacacagtcgaacaagtttgaggacctaaacggtcgatttgcgagtttagggaccgggatgacacagcggtaaaagtttagggaccggtgatggactttactctttataatattgtctcgacagtttggatccagctggcgaatcaagccacagtgcatatttgttttaggtccgcttttctgacctaccaaatgggctgagaggtcgagttcacgtgaatagatgtgcttttattaatggtactcgtgataaccccctttatattgatcacctcaagttgatccgttccactcctatgccgcttgttaatgtacttgcttatttagatgagtgttttttcgttactatctccgcagatgcatcatgattcggtaaatatataaaaccatttctttttacatgactaaagctaaaacccaatatccttccctttgttttaaaataatcaaacacacaattacatagccatgggagagatcgaacaagctgtactgtgaatatgtgagtatcccaaacggttttctttgccaaactcacggcagtgcaggccataagcgtgacacagaggatcgatctaggactaggacagcagcggatccgtacaccggaacttttaatttgatgaagtagtactaaacatggcagctcgaacaaaactaggttttagagatccaattcatggtggaacccatgcatgtgagcaccacggggtgatgcctcaccaaaccgccgtgcttatctgactcagcctccccttaaaaataagagacaaagaccacctgatcatgtcgaaaacgtcctaagagaaaggataataatacagccagctgcttacttatagcctatctatcagctcactcgtataatggttaactcttcactataaatatatggttcacatgtctgtctcacagattttcttggttcctgtgcctaagccggctgtaaacttacagcccgcttctcatctctctcctcttttctcctatccacttcagcattcagctttcttatagctcactattatacttgctctaatctcgatcgatcgatcgcccatggtggcaatagtttaatccccagaggccacaagtgtcaatcatcaggtcgatgggaagaaaagggcaagatgacgagattgacgccgtgcaggggattcccaaatggggctgattcgtccttttcaggtgtacatttcccatttttatactgcctgcctggagctctgcgatgaacttggacaactttatagggaagctacgtatactttgccagcctctctctccggttatcgcaagtaataaagcctaaagcggcacgttactctgtaaggaagttgagtgttaagaaggtaaagatgccatctgagcagtgcattacacaattgagttgattggtcagtctctactatagtagtagtacttacctttttcttatgggaggacagttggtagtgctagctagcttaacaatattctactttgatcatagaaaacagtactagtactaagttagtactacgttgtcgaagaggaaaaaaataagttatctctttgggacttaacaatactctgtttcctttcattagaaaaaaaaaaatcagtactgctaaataagcttatcttctggtacacgcggtacaggttctccattattttttttcctagcgagtccagcttcctgcttccctacctaggaggtccaactccaacccaacgcctccatgtgccttgcccctcctcccccttggccgagatgatgataagctgctacgccttgctagttgctcccatgccttttgaacgcttttgagaccgtgaccaagctggcgcggcgctgcatgcggcgtgagaacgagcgtcgcagcacgacgcgcgggcaccacgacgactccacgagtccacgagcgttttcacgctcgtttcgcacaggctcacgcgttgccgcagcccgttttgcagaggcctacgcgtggacggcctangctcgtggtgcgcggagcgggccgggctttttcagggcatcaccggtgttagttaatcgcagtagaaggggtatatgcccccgtgaccccaaatctcttcgaaagaaaagaaattcccctttttcttcaagttcaaaatatcgagttacatttatttaactggatcatggtatagtagtatcaagaggtattagcaatcttccctgcggatgatggagcccaaatcgtttaccttacagagatcaatcacaattcatttccataaacaaaaccgtatccgaaaacagtttgaatcgatctacagggtcatgtaacaacaaagatccgtgtaaccaaagcaagaaaaaaagaaacaaggttctcaaggatgggagaattgagatatcctcttaggttgacaagctgccaccaccctgttgccaaaggttgatgatatcagtggcctgattcagaaggatgatcatctgtttctgagagatccactctttctcctccagctttgctcttagctcctcccaggcatctttccgtggccagaagtagtatgggcttaacggaatgctgccatagccgggaaccaactggtcgagggctatgccaatgttcttctccatccatatgaacttcagaacaagcattggatcctgcctttcaggcaccttaaccttgtactgcgatacaaaatcaattcgtttcaaatctcataatgctaatactgattttgcatatctgagtaaaataaattgtgcagttttaacacagctcaagtcgtagtaaaataaattgcaacaactactgtacgtgttccattgacaacttcatttctctacaaaaggccccatttttcaactgtgagggtaactcccatataatcaaaactaatccacttttagtgtacatctctgaaatctgatatagtgatgaaaaaggaacttattgtgcctgttaatgttgttacataatcacgtaaatagctgaatgaaaaaaaactcctttcatgaccaaaacctgtcaatgctacagtttgttcaatagttcagttcttgcttacacatacaaccaaaaatggcacacgctcaagtttgtggacatgctttcatgtgctcttcgcctcttcatcactagcatacaccttttatctgcagaagtgcaaaactgcaccaaaaggacagcccgagtgcccaaacatgctcaactagactagaacttctctaatttactctacttgtgacttctcttaagctttcagctgtgcattgtgtctaaagatttactctactcgtgaattcacccaaatgtacacctcgtactgtatttcacctatgagctcaagtaatcagttcggtaaccaaaattgattcaagaaaaatcaaattcatgcgaaaccaaatgtgattgaactccatcctcttcaaaaaacaacacttccttctgaaattgagctcgactcggtaaaaaaaaaaaccccgtaatttcagtcactggcatggtttggagcggctactagcccattacctcctgcgcttcctcgccggcgctcgcatccccacctccgacttgcttctcctcttctccctcctccgcttcgacggcgccagaagcggcggcggcggcgaggccacggagcgagcgaaggggaagcctcctgctgccgaggtggacgaggcgtggagtggaggaggaggaggtggtgcagggggaggcggcggaaagcttgggccgggagatgcgggcgcgcgaggcgagggccggcgtggcggcggggtggacggacatcgccagcatcgtgtccgagtccgaggctcctgtgcggataagaggaggaagacgatggtgcggggctgcctcctcttatctttacccttaataatccccttctcgtcagctattagatgtgggctagaaagttatggtaaagcccaatatggcccagcacaaaacggcccggcccagatccaatctaagtaaaaagctcacagctcaatcgtctcggttattcgagaataaacgaaatggcatatttgtaaataaaaaataatttgtgaataaatcttttatatatatatttttaacgatctaaaagcaaagactgaaaaataaaccttcgataaaaaaaataaaatcaaccccaaatttaaaggtaaaaatttaaattttgactgataaacataagtataagcgaaaagatgaggccgtccgtttgccttcagcagggtttgcaaaaccgtctgtaaccgtgcgattaccgcgcttaccgtggggtacggtaaaagggaaaccgcggtaacccccttaaattcaaataaatttaaaaaataattttaaattttgataaattttacacggttaccgtgtggtaaccccggtccggtggtttgggaaaccctggccttcagtagtgctagtgcccagttgccaaccgcttgggcgtagtaaaaactgatagtggaatgaaatgaaccgggtacaaagtactgaaatgatcgtaagttttgaaaaaaaacaagcaggagtagtaactttgcaagtaaggatgctacattctctgatagtagtttcagtgttttacacattctataagaacaccgaacaaaacaagcatcgaatttcaaatgtcgatacagccttgaacagttgaagttcttgcccacaagtttaatcgaaagcattgtcaggttaacccaagaacgtgattaataattactaacattaatattagtcccatcttattcgacaatcattgctaaactatttactgtgtcatgagatcgaatcaagtttgatgccggcgaggttttctccgctcagaagtccggcgccggcgagtacgcgtgggaggcgggcacaaccacggccgtcgacataggtgccgacgaggagttcaccaggttcagtatgctgttccagtagttcttctcctcctcggtctcctggaactcgccgtcggcttccgcgtctctccccgccggcctcgggatctggttcaaggagccttcgaggagtaggcccgtgaaccccgctccggcgccggggaagcccacgtcggcggcgtcgacgtcgccccagtgctggtccttgcacgcctcgtcgtacgcctgcatgggctgcatggcggcgcgcgcggccgccgcggcggcggcgccgtgcgcctccagcacggtggcgagcaccgcgctctccgagaagctcagcgtggacgtcggcgagtcgaggccgtgagccgccgccgccgccgccgccgacgcggggggtgccgggaggtgcggcgcgcccggggtcgcggaggccgcgagcgcgcgcagcttggcctcccgagccaagcgcgcctccgcctcgagccgcgcgctctcccactgcgccgtgtggctgaggtgcgccgcggccttggcgtgctgcgcgcccgccgcgccgccggccgcacctccgccgccgccgcccgcgccggccacgtcggagcgcggcttgtgcgtgaccgggtcgatccccatcttggccagccgcttctttaggtgcgtgttccagtagttcttgatctcgttgtccgtgcgcttcggcaggtgcgtcgcgatcgccgaccacctgcaaaacaacaacaacgccaacgccggccaagaaaaaagatcaggaaaatcgcacgtcaaaagccctccattcgcagtgacaaaattaaacaaacagcactcttgaaaacgtaaataatcggcggtgtgatttaaggcgtgcgtggcgtagtacagacagagggcagagatgatcggaagctgtgagtcaaaatgggaagaggggcaggtggcaacagtggaccaaaccccagttttggtccacaatgatgggggggctcgcctccttaaatgacgagcttgaatgccgaatcatatgggagaaaagaaaggaaaattctgggccgagcctctcactgcccaaccttttcacactttttcccttgttgatgcatgcattgattggtctgtgctcacagctaatgcgtggttgttcgacgggcaaaagatgagcaatgcagcattacgtgtgaacaaaacgaaaacaagtgatgattctgttctaacgtaagaatttttagcctagcttgtgtgttaatctatggacagtacggtttgttacggacaaaatgctgaagcaggtgtgtacggggacagcaagtaagtagcacggcctgcgaaatttacacatcccctggctaagctccgtgttccaacccttgcattgcataaccctttcataaatgtctgccaagactacggtgcagaatggtggctactggctagtgtgttcttgacctgccggtcagcaacaagtactagcagtcaaaattcgtgcaggagaatcaagggttccatcgcgattacggaattaaatgtgctccgggtgcgaggtgaagaacgagcgagcagctagcaggagggagagttgtgcactacgtatcttgtatgcatgatgcatccatgcgaaaacgaagtaatcgatcacctgttgccgagaagggcgtggagctggatgatggtctgctcctcctgcaggctgaacttgcccctcttgatgtccggccggaggtagttcgtccaccggagtcggcagctcttgccgcaccgctgcagccctgcacacgattgtcacggtttgcatgcacctcagatcagagttcagagagtagccagcctcgaggatcgatcgcctcgaccgaacattgcagctaggattgcagaggttgagaagaaatttaagctagataagcggcgcttaccggccttggagggtagcgagcgccagcagccgtggccgtgctgctcgatgtaggccagcagcttctggtcctcctccggcgtccatggccccttcttgagcccctccttctcgcagcacggcgatcgccccatcgccggagaaaagcaacagcagcagcgagctctaggaaaactcctccccgatgatcttcgacgccctctggttcttcctcctctcctcttctctcgggctcaagtagtaggtctatgtgtagtagtacgtgatcgaggcaattcactacgagagatcttctttgcagggagctgtggctctctgcgagtgactaatgcagcagcagagtcagtgagagtgtgtgtgtgtgtgagagagagagagagagagagagaggccaaaagcgaaagagtgaggcacattgcgctgcgtagaggcataaatagaggagaggagagggggtacggtgtggctggctcggcacgcacgactcgactcggctcgcgcgaacgactcgatatcttcttcgggcgccgcgatctcctgccggcaaagtggcctctcactgtcagtgtacgtaactccaccccgcgagaggagtaggggcaggaccgtgatttcaccccccacggtgtacgtgtgccccaccccgtcgccgcgggaggaacgaacgaaccatcgctgccaatcgcgatcccacttcatccatccacccgatcagagggcgtgcatttaactcggcgcggggctcgtctctgcctctggatccccttggtatatgtggacgctacactacacatgcctacatggtcctttcctcgcgctaccgcgagtggcgtggacggcgtacggcgcctgtgtcgtcttcccccctctatcgcccaatccatccatccatccatctgcgtgcgtgcgtgcagtgcagtgcatgcatgccatgcgctttcatggcgctgccctgaccagcgctgttgctgccgcaggggagggggaatctcgcgcgctacagctcgctgcaccaaagagtggtcaggcgcgcgaacccgatcgatccaacagtgttccagtacaggacgcaaattccaacgcgaatcgttagttcgaagctggcacagcgtgcgggcgcggcggccgatcgaagggagagatcgaattactggctggtcccgcgattgttcatatatcgcgcgatcgatcgagcgagcggaggagtgcgtgctgttccttgtcaatagtagtatacgcttggcccggcccccggcgtgggcaggtgaccagtagctagctaggcttaggctagctcgctcggcttgcccttgcccccatccgtttggacgattgacttgattgcaaatctcgcggcgtttttgggaacaatttgttttactcattcaattcggtgccattgccgcaagtcacgactggcggtgcatggttcatgattgcgtcgcatcgcatcacattgcgtcgcattgcatgcatgccggtttcagttgtttgcttgctagctcggtcgatcggttggagtgtgagatccccgcgccggccgctagctcctggtttctttgcacatttcgcttgccatttcggggcgctagccatggccgatttgtggatctctccccctgcagattgtgcaggcgatcgtcccagatttaatttgctgtttgttgggccctgtatgtgttgctacgagtcgcggctaaagtgatctctgaaattagctggttgctcgtttgtggtaggtactctattcctagcgttcccatttctcagtaaagcttttgctctcctggaaaaatgtttgtcagtttccaaggaggacaaacggaagtctccaatccattttctgaatctctgatctcgccatccttaatcacgtactaatccagtactgtttatcacgccatcaagtcctagtccaacttactacccaccagatcaacagcttactgctgcgaacattgtacgggaggctgagaaaaaggaacagtactggcagtgaagggtgatgatgatgtacggggtagagagactaatggaacactctgtaaaattccgccaacctgcaattgcaaggcctgagcgcagggatggcttttgccatttattccgctgttcccggtgcccaatcgcaacagtagtacagaaggaccaccgctgtgaggtgaggggaatcattcgatcgaaacacagccgcatgtgcgtcttccccaagaattcaccgtgttctttttaccaccatcactgtaaactgtaaagcaaaattagcttcgctacttcggacacggatcctctacggtattatacttacagtagtattggctaacaggtgaacccgatcccacgtgtcagcgatagctaatgtagatacaatatacttcagacgattcccactgtcttcacttgcaccatcacatccttcagactttagaacttgctgtgaatgtcagtatgtcacatcacggcataaaattataggcacctgccagttgcttatttactgtactagcttgatcgatggcatggctctcaacgagacttaatcgatgctttgcttttgtttgatttcgtatttccatggcctacgttgggttgcagatagatgctgctgttactattctacggctagctacgatgggtatatacttagatatgcatgctagtagtatcgatcaaattaagtcctgaacagtggaacgcacagtacgtgctgcggtgatttggcactggcaccggtgtttaattagccatgcatcagtagcagtaggcaaaaaacttcaattgcctactgaagtagatcgacgccattagtacgtagctagtagtatgtagtatgagctaacctgtgtctagtctgcaataggaaggtgagttaagcccatccgctccgctgccattgcaccgtttcggaaagacgatatggcctcgccaccagatcatctgaaagcgaacgttttctcggacggatctggtagaggttttacgtccaagcctgtgtccagaattgctccgtcctaggaactgaaactctgaaaaggcaatgcgcgagaaatgggcacggcattgattgaagaagaggatcgatatgatgatcgtctgtatgcagtggagtgcaaaccagaatgtttgcctctaatgcatggctctagctgggatgcagacttaattcatttagagtcgagtgattgcctggaaaacgcatcatggtttattacaaactctctatcgtttagcgtgcagacagaacagtacaagggggggggggggtgaagtttgagttaattcaactgttgatcgcctgacatggccattgctcatgccggctggaccagctgattgacgtcgagaggggaatctgatcatctttatagcgctgacgatttgcaatagcgcttgtactactgcagcatcagggcagaagtttttcatctaatgtttttgcagacagcagaagttttccatctaatgttttgcagagatgcgatcaagcacatatatttccattaatgttataaaatcttataggactactatgtaataagaacatgcaaggcagaaaaagagcagctcgccatttagcaagtctgcgtgagctttattattgcgcaaaatggtggtcctgatgaacctttttctagggtccttttcttctccggctctgcgtggttttcctggtttttggcagcaacgtagcaccctggcctggtagacaagtatttaaaggtgtgagccctttacattttcgtcctacgagtactactcatcttttcttttttttcttttgaaaagaaaatgatagcagcgtactgaagtccaatccggtacattaatactccgacctctgttctcaggcctggtaggaccgtaggactaaggccgagtttagatacaaagttttttttttcaaactttcaatttttttatcatatcaaaactttcctacacacataaaattttaactttttttgttacatcattccaatttgaaccaaacttttaattttagcgtgaactaaacacaccctcagtatagtacactttttggctgtgtttgcaaaatgggtttggaatatgattttccaccccttcaaagggtaagctttaatcttagccatccattcttctcacccatttcatcatatccctccattcatttctattttttaatcccacctctcctaacccattttccaaacattccaatccaatgggtttcagcatcaacgctgcagcaatattggtctttagacccgaaatttgacctagttcactcagccaagttaaaaaacctactccctctggtcataaatatgtggcatttataacaagatttgatagcactgttgatactttgtattgatacttagactgtaagtaacttttgaaatgcttaggtaaaaacgaataaaatatatagtttgtgtggctttgtctagaaaagtaatattaattataatatcat

SEQ ID NO: 69437 - DNA, 7609 bp, Oryza sativa
  unsure (1)..(7609): unsure at all n locations
tagatctatttagattcgtagtaataagatgtgtcatattccgtatttatgagatggagggagtatagaggaacacgtatttcttttttttaagttgatcacaagggaaatttaaatcctgatccctgaatactataggttacagggaacctgtagtcgagaagagctgaatgctgcgtgagctgtagaactgcagataacagatatggctggagcaaaggagatgcgaagcagagagtgaaagagaaatacggtgattcacaaccgacgcaacctggaatcccagcatcatcctgtaggtgaggtttttgttcgtagttgaacgcgtgcacgcaatgtggtgcacgtccaatcataccacacataccatttcagctggcagaccaatcgtcaagtctgtcttgcattcagacgatggcatgatttttttttttaaaaaaagggtcttgtgagaattttttttctgaattcttacatatagaaaaactgaaatgtttccataaaattcatccgctaaatcctacattacacctaaaactgacatctagtaggaagcaaagaatctgcccgatataaccaacagtatcgcctactaatatctgactccaatatcacccccgcaccagaattaatgcaaataatcaggcactggaattgtagcaccacaagaagactccctgtaaaagacatactccctggagtatatagtacagtagttttgctgtagttggttctttgattgcatgggaagtgagtggcgaggatggctgagcccggcaacatccatgtcatgtcacgtgtgccatcgccgccatctccatcgtaaatttatgatcaaatggaatccagtgaaccctgaaacggttgagccgagccacccgtgcattgccttctcttccactccaaccccaaaccgctgccactaatttcgctcacgaaaagcatagggtaaaaaaaaaaatccatgggtttatcccggtaagcttcggctgcttgtgggctgtggctgtgataaattggcgggatcagagcaaccagtaaactgcagcaagaagccaagaagctaaatcgtttcagtggcggatggccagcaagatattcccatgagtgatgagaaagcaacggcggtgacggcgatgcggcaatatctgggggacattttgtgtaggtgtgcattgtgctatctgaatcattggtggtccctgtgctccaacagtaatgcttcgtgttttgttcacaaaaaaagtgcagctcagatgaacagggagctcagggtccccctagattttttttttgggtgaaatttgatcgtgtaaactgccttctcgagaataaagacgttttacactggctttgttcagttttttatgtgtgcatagagttcgagctattgagtacccattttgtcttaattaatctaacaaattatttatgtaaggagtaaatatgaatcatggaatgccttgtacgtaaccaaccaagattaatttttattggttaaacctatgcatcatttaaagtgtgaactaatttcttttggacacgaagtgtatttgatgagaagatttcagaatgatgtatattttggtattcttggtgttgatgtcctttgtgtaaaggatggtcatattgggatagaaggagtattttctaagataaatgtgatatatttcatcaagaaatgatattatggttgctcttggttagaatttcttttattttttgaaccatctattttttttgttttaaaaccaaacccttttaaaacttactttcaaagctggttgggatggcgtgaccaaaaaattcagataataagtttagggatgatttaattttaaaattaaaatttaaaacgttcaaaaataattaaaaagtcgcttggttaatagtcttaacacagacaaatgatcaacaagaaacaacgctgctcaaccaatataaactattctacacccgggatatagaatagctattctataccccctccctcccaagggccaaacccacctcccctcttttctaagagttcaaaacccacctcccaccttagtcaaaggtcagtcaaagcactctccacatcggtcaaagcctggtcaaaccgcctaccaactcccccaccacccacctcttctcagctctcatcttgcggaacagtgcagtaacgcgacagccatcgtacagtaacgttgtgtcttacgtgcagtaacagcattcgaatttagttgaaatatagtcatgacggatctacttttgataatcactttttttctagcatcatggtgcaaacggttttaaaaaaatcatacatcacatgagaaatattgttattcaaagcttcggttttttggatcttgactctccacaagtagtaatactatagcattattactactcgttactactatgtgttgtgcgttactacaatcccatcgcgacgttattgtaagtgtgcagtaagaccataagttttgtagcaacaatgcgtcttactgcaattcttgaatagtgttactgcataaacatgtggtaacgtgtacctgctatgtagtaacactcccactttgtgcggtaacaagtatatttagcatgtgagacttttaaccctttttttttatttctggtttactacaatttcatcatgatgttactgccaaatatgcagtaacgttctgtatgttctacagtaacaaagtgttttactacagttcttagatagtgttactgcataaacatgcagtaatgtataactgtcaggtggtaacgtgtatatgccgtgcaataacacttttacttttgtgcagtaacaagtatatagttagcatacgagactttgaacccatatatatatattttttgtttcaattcctgatttactgtcaaaagtgcagtaacgtcaataacactatattagagggaggataccgattttcttaagaagagggaggaagaatggtttcttgaggagggtgtatgtagatgcattttgaagttctatcctccacatgcagtaacactatagcatcattgtgaaaacggttttaaaaaataatacatatcttgtgagatattgattttcaaatattggcattttgaactttaacactccatatgcagtaacataatatgtaatttgcagtaatatgggtatatacatgcagtaacatgattttaccaaatgtataaaattgttcaaaacactcctacatcaatcagacctcgctcaaagccacctacagactttacctataggctacctattcgatcttcatctcgtaaaaatgacatagtaaaactacgattatcgtgcagtaacatagctacttggaagtggtaacatgcacctattatgtagtaacacttctacttttgtgcagtaacaagtatatggttagcatgtgaggctttaacccatatatttttgtttcgattcctggtctactacaattttacacgacgttactgccagaagtgcagtaacgtcctatgtgttctatggtaacgtcacatgttaatgtacttttacaacaatgttactactgtagcatagtaacatgttatgagtttgggtagtgaaagatattagaattgataatcatattactttctcacacatctttgaacaaatagcattattagatgaattggntagaggaatgtgcttttgactatgacatcatgggttcaagtctttaatttggcaatttattttttattttccgagaaaatgtgtttcggggagaaaagaatagtcttaacacccctccccccctgtctctctctctctctctctatatatatatatatatatatatatatatatatatatatatatatatatatatatatatatatatatatatatatatatatactagtagtgtgtccgtgctaacgctacggtgacaattaatattgcaaatgaaacaaccaaatgacagtgatacaatatgcttggacaatggtatatatatatagagggacgactcttccgtactcccaggtgaaccggtttgaaaaattcaaaaatcaagtatgcatgtccaacggatggaggaaaatcaaccggtggaaaaataattgttctataataattgatccatgcatgtctgtttataatgctaaatgtgcactgctgcagtatactattattttgggagtaagtatatactatacactcgttagattagtttgtactatcagtagtcagtatatactacaaatctgatttcatactcttttttttccttgacagtatatactgcatttctcgatggagcagtatatactactttttatggtttgtgttttttttcttcaaagaagcagtatatgtatttttttttcttagcatacagttagtactactggtagtactatgtactacttattaaatagcagtagcatatacttgttttgacgttgtagtatcattatatgctacattaattcgtcgataaagcagtatatacaattttttttgggtcagtatgtgtatactacattcctaatcacttaatcaagcagtatgtactacttttttttgttcggtcagtatatactgccaagctagcagtggtatatactgtttttttagatagtagcggtatatactgtttttgttttattagtagtaggtatggggttgcttatacattatgaatcacagagcacaccacatctcaagaaaaatcagaatacattaggacttacgagtagcaacatgaaaagaagtacatatctgcaatgacagattcacaaacaaaatcactagaaaaatacataaagcacaaaagccgccatgaaaaccctctttttatctattgtcttgggataaccatactgcttctttaggattctctctaagagtgatattttgaggtgtgaaaagtttggtatctcaaatatttcacacaatatttgtttcttcccatccaattcatcttgagagcaagggataataggttgacctgagcatggcaagctaaaaactgcattgacatcattagaaccgaatggcagctcctggttgacatctttaacaatagcgcatgatttcggatcaactttgctcagttgccatgccccaaactgcatgtgtaccttagtaaggctgtgtttagttcacccccaacttccaactttccatcatatcacatcacatccaaaactttcctacacacgtaaactcccaacttttttttccaaactaccaactttccctaaactttcaacttttttcaggaactaaacacagcctaagcttgatatccaaaagtccatcaaatccaatttcaccaatcaagtccctcttcctatcatcaaagtctttaatgatattcactacgcatttgggctgacacctgcagttgataccaaaggtagtgttgtctttcttttgtctatttaatactctgctttgccgatacctggataccacccgtgcagccgtcttatttaggctgccccttgtgccagaaaccttcaaagcctgcagataatcatttttcattacataaatagacaatactacatggaccagtttatttaaaaattcaacatatacttctgtttaaaaaaaacagcatacactcatatattcatatatgtatggaaaaatgaagtacataatactgagtagcaaattctgcctatgtgtaccccctaaataaaaaaataatcatgtctattgaaaaaaaaagtaagtatatacaaagtttagagcttactgctgtctaaaaaaatcagcttatacctctctatgtaaaagtgcagtatatagttcttcgtaacaaggtccagtatgtaaaccactatggaagagactcagtatatatgtggaaaaatgcagtatatgctatcttctagaaaagttcagtatgtaccacatagaaaattcaatacatactatatgctgtcgtacaacaaagttcagtacaaagcctcccatagaaaaattcagtatatctgtgaaaaattcagtaaatacttgtgcgtatcaaagttcagtctatgaaccactatggaaagattcagtatacatgtggaaaatgcagtatatgctatcgtctaaaaaagttcagtatataccccatagaaaaattcagtacatactatcattcaacagaattcagaaagaacccctccataaaaaaaagagtatatactatcgtctaacaaagttcagtacaaagctccccatataaaaattcagtatatactatcgtctaccagagagttcaggaagaaccctgccatagaaaaattcagtacataataccgtctaacagagttcagtaagtatccctccaaagaaaaaaaatgagtacatactgtggaaaatttagtacgtactaccatctacattttttttgggagggggggtgggggctaaaacagcatttactttatccacccaaaaaaccatcatatgcactaaaaggggaaaaaatagcatctgaaactgagagcgtacatgaaccgaactacacataattgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggaccgcgcgcgcgctcgagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccgacaattcaagccgccgtggtcgtcgtctcctctcctaacgcctctccatcttctcctagggtgtcgccggcgcccgtccgtgcctccgcgtcgccggtcatcgccgctcgtctcttcccacgccg

SEQ ID NO: 69438 - DNA, 16513 bp, Oryza sativa
gtggtgggaatagcgagggtgttgagagaattgtgaactccctgcacacacagtcgttaacaagtaaagtgaagaggaaggggagattcttttggataggttttcagggtagcaatgctgaatctttttggagaattatagagcctcatgttttgaacaattttgcgagtttagtaacacaggaaggtagcagcataggctctgatggtacccaagataccgacactgattctgacgatgatatgcaaatgtccgatacagaaagagacgagtgaatacaatgttcaggcagtagttattaaaacctgaaggtatatctaaaggggcacaagtctacacatcttatcagagattcagaattttgtaatgcatatttcttgctttgataggcaattacttagtaacatgtagccctggttgatctacctatcttgcaatgccacgatagattagtgcactagacagtcctaggtaagaaagatgggaaagtcatttttgttatccttgctttgtacatgtaaaatgatgtattatacatttgatcagctagctattttcattttcctttgtttttctctgttaaatttaaccttcatgaaattttgcccataccagtatagtccttgaactgtactacttattccatcgtcagcagtattttcagttcattcatttatccgttccatggtttctagcgggtaaaagaatatttagcagaaagaattcaacagggaacaacataagattcacatacacaaatctagaaaaaaagaattcccatctagctatgatcctaagacatggtaaattctctgtttgagttagacatctcacatcatccctacaaatcatcatcctgcaagagcctgttcagcaaggtggtcaggagctcgtccctccgctcagcccttgcctcttccctgaccctcctctgctcctctcgctccatccacgcctgctcgagcatcagcctctcccgctccagcgcctgcatcgactgtctccattgctgctcgatggccgcccgctcctgcgcgtgcctctccagcgcctcctgccgtcgcacgtccagccggtgctgctgctccaggaagtcctgcagtaggccacggatgttgctcgacctcgacgtgccgctgccgccgctcgtcggcttccccgcagccctcatctttcagctccttgccggcagatgcagtaggccgcggtgaacggacgactcggccggccacttgagcttgtgtgcagcagcaggcgtagcagctcgtcccggttcacggccggggagctgtcgctcgatggcgcggtattccctctcgcgtgtggcgcgagggcggtaataaagggggcgcgtcgtacgtgcttacgtgttggcgagtgtggaaggggagaccggcaagggtccgcgtccgtgcaacgcgcacgggacaggagtcagcggccagcaaggcggaacggctacatgcagcagccattggctggattttcatgcgttttccatcgctttctgacgcaatctcaaaactccccgtccagtccgtcgatccgcggccgcggactccgctatcccttcattcacacaccgtcgttacggctggccggtctgaatggcgctggagctcggtcatgtccacacatcggctggcggcgccacgtcatcaatcgaatgggattcctgcgctggacccatccccacattgtcgactcgacgagatctgagaaactctcgacgtatcgaaatctcctggtccttcggctgcacgcgatccgcgacactgaccgctgctcctcggtccgcgtcacgccagcatgaggcgaattgatcacgttcgcgcgcgcgtgcgtgcacgcgaggacgcttgacgtttcacgacgtacatacctccgtgaaaaaacatcgggtgtccggttctcctcgcttgttagaatttgttttggtttagccggcgcgccgtggtgcagctgccggtcagggatggcgaagctcaggggctcagggcctcgggttgcatttgattcgagctgtacttcccctgcacccgcgtcttcccgtggtgacgcgtgctacgggccttgctgtgtgctagtctttgtgtgctaatctccgagttgaacctgtgcaccgcccttgcgtgcagcggtagtcgtcctcggcgtacagatttcagtttctttcgggaaggctggaatgcgtgccgtgcatgcctcccgatctcccgtggtggttgataagcaacattcgtgcagatctcggttttcttttgggaaggctgggatgcgtaccgtgggtgcgtcccatggtggttgatacgcatcattcgtctgccagtctgttcttcatccgatcaacaaaaataccagaaccagtataggcctatatgctagtctcgtcgagtattccacgatttgggagaacagtgggagcacggagaaagccgttcgctcagactcgatggatctcgggattgtgtgtcctaggttgaatctcgatatctaactttctcttggagctagatatttactccatccgttctaacatataagagattttaaacggataggatattttctaatactacgaatctagatatgcttcatgtttagactcatagtattagaaagtgtctcaatcgtccgaaattcattatatttttggatggaggagtatatccctagtcatctcatattccaagggaactcgtaaagctatttttgacattctcagtctaagtcttttagactcagacttagactcatagtattagaaagtgtctcaatcgtccgaaattcattatatttttggacggaggagtatatccctagtcatctcatattccaagggaactcgtaaagctatttttggcattctcagtctgagtctgattaaatctgagtaggtcttcttcaaccatgtcaaatccaatctttctttcctcgccgtgtaggctagggcatgacccctgttgtcgaaacgacaactgcatatgtcgaaagacgtggttactcaatagtggttgaaagtaaagtgtattgattagagaatttttcttggatccccctattacatggccctatgagactatttatagctccttttacaggttcttactactagggttttggttatacaggagaatttacatggttacccttatgaaagggacatttacatgggtacatagtgtaatagaggttcatggactcctaatgggccgttaggcaatcgtcggtccaatggcccctaggcttgttgggccggaaaaggcttcttcggccctcgcggggccaagcttgctttgcgcgcaagttgtcgaaggtctcctgtaggtcggacgtgtggtcgaaagccttgcggctttttacgacgatgtcgtcgacataagcttccacatttcgccccaattgcttgtaaaggaccttgtacatcagcctggcaaaggttgctccggcattcctcagaccgaaaggcatcctgaggtgacaaaaggtgccgaacggtgtgatgaaggctgtcttggggatgtcggccgggttcatgcgaatccgatgatagccggaatatgcatctaggaagctcatgagttcgcagccggctgtcgaatccacgagctggttaatccgtggcaaggggaaatcatccttcggacatgctttgtttaagtatgtgaaatcgacaaaaatgcgccatttgccatttgacttccgcaccagcactagattcgccagccattcaagatgatcgatctcttgaatgacccttgccttgagcaatttttggacttcggcttttgctgcctcctggcgatcaacggacatcttgcgtagcttctgtttccttggcttggcatccggcttgactgccaggtgatgcatgatgagatctgccgaaacacctcccacttcatcagggccccaggcgaagatatcaatgttctttttgagtacctctaggatgttcttagcttcttcttcgcccatgtcgccccccagtgatacgagctttgtggggtcggcatcatcaatctgcatcttgactatcttgtcgtgaggggcgggctttggcgcgtgcttcgcccggtcatgcggttcggcctctacattgtgcactgctctgttgattatggccaaatcaccttttgaagcagccgaaggctgaagccccttaaccacgatcactcctgccgggccgggcatcttgagcttgagataattgtgatgggaaatggctttgaatttgttcaaggttgcacggccgaagatggcgttgtagttgtatgggatgtcgacaacgtcaaacaatacttgctcttcgcgtctgttttcccccgtgccgaaggctactatcaactgtgcttggccaagaacatgaactgcttctccgccgaatcctcggagcgatgtcggtgctggggtaagggcttgggtagtcaaccccatcttggcatatgcttcggcaaagatgacatcagccgaacttcctccgtcgaccaggattcgccggacctcaaaaccagctatctcggctgagatcaccagaggttcttgatgcgggaacattactcctgcggcatcttctgggccaaaaaagatttgctggttcagatactgcggagccccttcgcctgccgaagtgatattgtggaccgttcgcagctgcatcttcttctatcgcttcgacagttggatcggcgggtcggcccttgtaatcacttggatcactctgtgttgcgcatattggcgctgttcggccgggggtgcttgttcttaagctacttcacgagttgcttcagctgctgctccctgctgcgtccttggatcttgcgcgttgccacgttgccgaatgtttcggcattgctctgtggtgtgcgaagagcgtccgtggaaggcgcagtagaggtcttttcggaccttcttgcggacaggctgctgatggttgcttgcttgctgatcgttgaactccttgcggagggcttgcacttcttcgacagccatcacagccttgcccgcacggtcggttctgaacttcctctaggtcatgggggcttgaccttgccttggcggttgtgcttggatctccggctggggctggcgaacaacgagaggagatggtttggcaacttgaacttgttgttgggcttgagcagtggcgacagaagccttatcgtactcagcttgtattgcttgccgtcgcttggaatcctcttcgccccttgcgaacccgtcaatgatgcgaagtaggtgttcaagcgtctgcggctccttgttggcgatttttcttgtgagttcgccctagagtaaaccggccgaagcagcgtttatgacttatgcctcagttatgtcttgaacttggcaccgggcttgcgagaagcgacgcatgtactcccttatcgactcccccggcctctggcgaatgtcgagttgatgctgctgcgtcttcggctcctcataggtgcctcgaaagttaaggacaaagacatcgcgcaattgctcccatgtgtaaatgctattggctggcaaattgaaataccaagagcgggcgatgccgtctagggcgagatgtattacctttgccttggtattttcgtcgccatgagccgcttcgatcgcggattcataaatggagaggaattcctttgggtcagtttcgcctaagtagcgtgggacgggtgggaacttgaactggggtgggattggacgggtcttgattcccccactcagcggtagccccttttcgccccctgcgctgttcacgacaccttgctgcgggtacggcgtggcgaagggcgaaatcacggcttgcgcgtgaggttgggccatggcattcggctgctcggccccgattggtgatgcttgctgagccgccatgaatgggtcgaaagttggctgtgaccatgtcatggtgacctggtttggtgcttggtttgctccgaagcctggcaacattgatagagtcgaactgcggtccttgactccacggcgaagcccctagacctggctgattcgaaggcaagcaactaggcgcaccttgacttgtattcccctccgggcgggccgaaggcgctgtacttgaaatgttgtggggttggctgagctgctgaaggaaagcttggagctgcgcctacagagccgaagccccttctgccattgtttgtggcacttggccaggctgttgaggatgtacttgggcagcgatcggttgagcttgcagttgcacgtgaggggccggatgcgctgctgcggtcgatggctgcccagcgaagtacattggcgcttgcgcgacttgtggcggaaggggctgggtcggcacttgtagatagacttggggtgggacatagcctgccgaatactggaggattggtgccgaagcgaccttggaccgccttgccgcctcgtacgcttgctgctattcttgcatttggcgaagcatgtcttggagtcgtgtcatgttctgtcgcacggcttccatgtcggcttcggtttgtgtctcggggtcagggtagacttgggcttgcacagcggcgagcgcagtttgggccgctgccggctgcgacggagcggcttggggcaccagcagttggcttgtcgaaaggatctccgccctggtctggagtgcccttgccgccgcagccgccttcgccatggcacataggtagcaggggccgaaggcggtagtgatggcgcaggtgcggaagcagatggcgctcccccatcttcggcgataagcgccgaaggctctgctccctcttcggcagccatatccaccccggcgtcgctttcctttcgccttgtaaccttctcctttacgacattcttcggtggcgtttgctctcagtggttttgctcggaggtccccacggtcgacgccaactgttgtcgaaacgacaactgcatacgtcgaaagatgtggttactcaacagtggttgaaagtaaagtgtattgattagagaatttttcttagatccccctattacatggccctatgagactatttatagcccctattacaggttcttactactagggttttggttatacaggggaatttacatggttacccttatgaaagggacatttacatagatacatagtgtaatagaggttcatggactcctgatgggccgttaggcgatcgtcggcccaatggcccctaggcttgatgggccggaaaaggcttcttcggccctcgcgggggcaagcttgctttggcgaagtcgtctcccttcggcatatactcttcgccctacatccttcccccaagaggcctccggcttggcagagtacccgcacgatccttcgcctctcgccgtccttgttccatagtcttcgccattggggggggcttcgccccgactaactttgacgtctcgggcttggatccccactcctcgcatagccttcggcaggttttggtcgaagggcctcatgccataccgccaacaacccctaatctaggtatgtctctagttgtattacccctagcgaaagagggcaatagggatagtggtggcgatgcctggtcagaggtggcggggttttttttcgtcgttgggcccaaggcagtggtcgctttgtttgcaacatccttctcatagagtcgcacatcatcgtgagcagaggccaatgaaagtttgacggcctatgctgaggacgagattaggggtagccagaattcacccaatgattgacctgtgaagccctaaaagtatgaacctccccctccccccccccaaaaaaaaaacttatcataattcacaaatcattagaaaaacatgtgtatgcatttaggcccaattcaacccccattctactcaccgtcggtatgaaacaaaatgcaaccataacctcatgtttccctaattgtcgctgatgggtaccctcaattctccgaccgcatcacacgcacaagacgacctcgtgcatccgcctcccgacacaacttcactatccgctcatgctcacttgcaactctagggcttttgctcccatgcggtggcctccacctccacctcccgagctcccgcaggccgcaacggtgcttcttccattgctacacgcctgctctcatgcatttactttatctttatctcaccatctctcacatggttgcctgtgctacatgtttaggatagaaaaatacgaatataatcctctatgtttagaaagaaaataagcgcgggcgtgccagtgtacctagatacacaatgtaaaataaacacaaaagagacacagaaacacgtgatctttattaattgaattaacaagatacagtttccatgtataatataaaatacgcgcgccattgcctgtcgttggacagatcttgacatcagcggtgtggtcttctggttcctggggtctcgaaagactcccatttaattacctccgcagatctacacctgtaggagaacctccgattaagttgcttgtggtcgtctcgtcgtcttcgcttcacgttctccatgcatgatgaatgttggtgaagatggtggatatatatatgtgggcgccggcaacgcatccacggcctcgtcggtccgtgcgccgatgttggtagcgtagccttccatcggcttcgcccaccctcgtcgctccgcctcatcagtcttgagcgacgtggtggtgtagataggttgatcttcaacatgcatgaaactcgcatagcttggacggtagagacgtcacagtagtagcgtcggaatgatgttaaagggaagaggaattggtgaagtcagttggtgtacacaacagccgaatatacggtggctaggcacctcctggctaggtgagatcaaagtgacgaagagttgacaaagacggttggtgtagacggtagctggattacacatggctgggcacctcttggttcgtcatgtcccttatacaacagggacttgcaatgaagatgttgatgaagaagtcaatgtagacaatagccggatgaacgtggctttagcaccttcggatgatggatctactattgatccagttgatatgatgacgagcccataaaaggggctatataagggcgccggtaacgacggcgaccttggaagaagtaaatgtctcttcggcggaacggccgaggacattgttggtgtagattcagcacgaacggttccctagcatcacagacggcaccattcttgctttatgttgatgaagatgagcaacactccaatacacggacgaacagcgacatcaatctccacgaagaaggagagaatcacgaacgaatgacatcgattcttgacaagagggggaaagcgccacggacggacgacacagatcttgacaaagaggggaaaagcaccatggacggacaacatctcatctcggcataatgaagagaacgcatcacgaacggacgtcacgatatcatgttggtgtggagaggagacgtcacgacgacgccggcttgacgaggtgaagacattgcggacgaacggcgcgatgactgcaaaccatgatgctccggcatgacgaagtgaagggatcatgggccggcggacttgacgacagcgtgcgggcacccagcagtggcactccggcattgcataggttgagtagatgttgatggtgtcgccattctcataggttgcgaccagcaaagtaaggacgctcgacgtcttggcgacgtcgtagcatcaggtagatgcgatcttcggcacgctccggctgggtggcgtcacaacggccttctccggcaggtggcagatgattgttagttgacggagatgagcgctgcttggcagcgcctcagcgactcggcgaagaatagtcatcgcggacggatggcatcacaagtccggcgcgatgaagcagaggtgtagtagccgaacggcacgacgacagtgtgcgggctccgggtagcggcgctccgacaggcgatctcctcgagcggctcaacgacgagtgtaaggaaaatggcaggaccgtcgaagatgattgagtagacatcaatggtgacctaagagaccgcggcgagcgtgaaggcgtcgccggccagtggagtctcggtgagatgtcctcacacagtagagatcacaacgccgacatcctgagagcctggcgtcggtgcgatggtgccggcacaacggcaaactttgacggggtggcactcggcggacagtgtcaccagcagcttgacggggacggcgagcgtctgggcgttgccgataaggtggacgagatgcctcccggttgacgatggggctgctccatcaggatggcgtgggtggctaccggtgtgatgaggatatgttgttcacggacgcgggcagctcagcggagtctgtgtcgttctcgacaagaacttctggatcaacatgacttggcggcgtccgcggctgctccgacgatctccggcgcgccccgacggagtggcgtcacgatggtcttctctggcggacgggtgttggtggtgtcacagcgttgggtacggtagtgacactaccagtggcttgaacgggtgacgtcaatctcgacggaggcttgcgggtgacgtgaatagatcggctggcccagtgaccccgggcgacggcaatacacccgacttctccctggccatgacaacagattggaacgacatcgcctcgctccttcctggcacatgtctcctccttggcgtgcgcgtcctcacgccggacgctggggtgtgctgcagccgtggtaacctggccaccgagcgcacacttcctgtcttagacgccgaggtgcagcagtgaggtcgccggctgccgaggtcaaacgccgttgcttgccgtcggaaggtcgcttcgtgggggccggtagatggatgctggccgtcggcgcgtgcgcgtacgacgtagatggctttctcctcctttggcctcggcctccctgccgggccgagcgccggtgaggctgtgcacgcccgcccgccgcgctggaggcttctctgctatttgatatatgctgtggatgagatgggatcggagtagatgaatatggatgccgatcgcctggcgccgtctcctgggtggctgcatgtaccctcgccgagcgtcagatgctgccggccggcagccaccggtggcgcacacgttggtgtggcgtcgtcggccagcgcgtcctccggccaccggccaactccacatcatggcttcttctcctttgtctgtgctccatgatcaatctgtaaaaagacaataacaaacaaaaggatggagctgtactcgccgacgaatggatgtgtattgatgccgatgttgacgagtagtctacaggctgccggagcaacgcgccgatggttttcccctccgtgatcaatctatggtagtagatcggactgacaccagctcgccggacgccgatgatgtgcgctgatgccgcctctcggcgatctgcccctcccgagggacaccggcgtacgtgatactgcttcgccgccggccggtgtgttgtcgatggatatgagttgaagatggctgggcagagacagatggatgccgatggatagaactgtgtgttgatagattgatctcgatgggagttgattgattgtccatggcctctggctggctggctctcggtggcttttataggcgctaggaaaacctaacggatgggcgcgtatactccagcgccgccggggccacacgcgttggttcgctccgaagcctccggcgacgttgctgcagatcactttcatccgaatcacctggataaggcggagtttgttgcttgggtttatccggcgccagccgcgcacatcagtagcttgcggttgagatatcccgcgtacgcgtgtattctgatatacaatcgcatatatacgatgagaacgaaatgtggccatgggctgccggcccacgggcagcttcacatttccaccgtacgtgtagctagctgttgcttcttaactcagaaatcacgcggtatttctatacgtatacatgcatgtacggtgaatacatatatagcgctcgtgtatgagctgctcacatgtcactcaagtctccttgtgcatgcatgcatacgtacagattagccaagcatgtatatatatggctgaacacacacatggatatagccatatatagatggacatatatatgtagtacgtgcatggctcatgcatcccatgcaattgagcaagctatatacagtctcacatattaacgaatgcgacgatcatagcagctcctttgtttgcttgtcttgataatacaaatactccttggatttataagatcacaaaataccgtcaaacactacaacttattggctcttgtgtaaggtcaaattaagcggtagagaacccgctgggaccaagagtgagggaggcttctctcccaaagaagctagtgctagagttaggggatgaaatcggggaacagatgcagattgccctacccatttcttattgcctaccttataaaggatcccaacatacaatgcggatgcttgagataggatctcgtctcctagcattccgaaacacgtggcgttaagttccaggccaaccaaaacaggccgcgagtggtcgaggtacctcttgagagcgttgtcgaggtgcctcccttccctcttcaaagggatcctctaggtgaaaatcttatccttttgggatgagcgatgacagcatttttaatgttgtgatcttattgaaggcgtcgttttagaggtggctgtgtattcctcagggtgtggtggtgtgtgggcacgtggcgtggtgtgttttctcttttatcgtgagtatagcctcctagtgctataatcttgtattaatttgcttctctcaaagtcttaatacaatgatgcacaactcttttgcgtattcttgggaaaaaaaaacagggcgcgagttgggacctatctcgtctagccagctactccctccgtcccataaaaaatgaatatatgaccagatatgaatattctagtacgatgaatctggaataatgtatgttcagattcgtagtattaggatgtatcacatccgatattaggttggttttttatgagacggaggaagtatacaatacaggacgcccttgcatcataatcctgttccggcctgcccaagtagaaagggcctcacgtagacggtaatcccgttccgtcccaagtatagcaggccgtacatgcgtggcaatcccgttccgttccggcccaacgagaaaatgtggacttaaaccgcagtgccgtaacccgttaaagacacagccagatctctagtcgacacacgccggccgacctccatctctgcagtgccaactgccatgagatgagagtagcaaccgtcttcaagctggacaacacacgaacactaggggggaaatggaaaatggaactcaccttttgaccgaagactagtagacagacatccttcggacattccatttgaaggcaaagacattcggcgagcgatgaattattttacctcgactcgaggtacatgctttcatcaacagttcaaaaagatactactctactccgtagcatcggtttccttctcgagaaacgactcgtcacatgctgacattgccattgggtaccgtggcttttgctggccgcacaacaatgatagttagtactctctccgtcctaaaataagtacagttttacgctatttatgtctaacatttaactatttgtcttatttgaaatttttttatgattactattttatatttttattgttattagataataaaacataaatagtactttatgtgtgactatttttttaaatttttttataaatttttcaaataagacggatggttaaacttttgaggtagtacatgctctcacacagatgcagctgtacctcaagagtcaaggagtcaagacaggattaccattctccatttttacattttcagaaagttacaccaaatgattcgttcgaaaaataaaaaagaaagttacaccaaatgatgaggatggcaatggtttggttcgactccacttgtccattaaactgatatataaatttactctaatgaaattttaggttcactctaaaatttatgtctaaaatgttcaatctaaaacagcttcacatgtataaatggtctaaatttgtgcaaatttgcttctctatataataaatcatttctataaaaatgaactgaatttaataggtttttatattatgaacactgatttaaaatttttggtccaagttttatgcacgtgtagtaaattttctctcggtctattactctgtataataatcatttctatgaaaattaactgaacttgaaaaatttttatagcctgaaaatgagtttaagaatttttgtcccagttttatattgaaaattacttgatctattagtaatatatagttgattcatttggatgtctatgataacctatcaatataatgcatgatctcgtggtggattgatcattatagatcatgaatctagaaaaaatagtttaggctcgatcctactcctccatcctataaaagacgaatctagagctggatataacacctaccctcgtctcaagaaaaaaagtccaattctagctacgaatctggacacatgcgtatccagatttgtagctagaatttatttttttaagatagagtagtatgttcaaatttattatattatgttgtgttacatctcatgttagattgggtttcatgggatgacggagtattaaccattccaatcctgacggaatgaactctgctccattatcctcgcagaaacctttcccgtatttgctctggaggctggacttccactttctgcagagtgcagatgtgcctaacactggcactgtattcaatccccgtgttcactgttcaattcaccaccactgcacgtcttaacgtgcggcatcaatggcaggcgttgcgttgatgacgagatcctggcgtacgcacgcactagatgatacccaaggggaaaaagagaggacacacgagctcacacaagagacgcggcccggcgtggaaaccgaacgggggccgcccactctgcgttttgcatcggcagaggcgcggtggagaaaaaaaaaggccgagcttggatggaaagctccaagcttttgcgctgttcgcttgcctgagccccccgtcccgtcccgtcccctcgcctcggcaagaacaaagagcatgcgagattagatcgagacggcgtatccggtaagcgctgttccatctccggcacaaaagggtgagttcttgggtggttggtttggttatgtgtgttcttctgcagctcgtgtggttttatctgtatctcgttttcgcgctctcgttaggatggcgaatgggggtgtctgcctctcgtgctctgcacttgtctgcgcgctggtgtttctcacggtggatggtgatttcgtggacattacttacgtagcgagcgctgtggccaaaggcgcaggtgtggatgcagctgcttctctgtcattacttgttcattcatactgtattagtatctctttttctctctctctctttcctgaattagtatctcgttgtgctaatgtgcattcgatggtgtgtggtgtgatgtgctagtctgtttggatgggagccccccggcctaccatctcgcccggggttttggctccggcgtgaatagttggctggttcatttcgaggttagttcttgtgaggatagcagtgcaattgtgctactggagcctagaactctactacaaatgtttgcccggctcaattttctgtgtctttcttgcaaatgttagggaggaggatggtgcagcaatgtgacgacctgcctgcaacgcaaacgcactcggttaggatcatcgaagcagatggcaaagcagattgccttctctggaatactgagcaacacccctgattacaacccgggtactgtatttcactagttgtttgaaggaaataatattttgtactatgttgtcctagttctctaccacctcaggaattggactgcctaggctccatgttactacttactttttttttaagataatgttactacttactacttcctccgtttcacaatgtaagactttctagaattgtccacattcatatagatgttaatgaatcacaatgtaagactttctagattcattaacatctatatatgaatgtggacaatgctagaaagtcttataatatgaaacggagggagtagtatagttcacatgcttgatcgattcctgtgcaatcatcaaaaccagatttctacaattggaacaaggtcaaggttcggtactgtgatgggtcatctttcaccggcgatgtggaaaaagtagatcctgtgagtccatagtccattctttcttgattttacagttacaaattgtatgaggattagtgctgctccagtgttaagtttctctttgattttgttccatatggataggcaacaaagcttcactacagaggtgctagggtgtggcaagcagttatggatgatctgcttgcgaaaggaatgaacagtgccaataatgtatgttattcttatgagcataattcttgacaacaagaaggttttcaagactaacgaatttatggcaggctct

SEQ ID NO: 69439 - DNA, 10515 bp, Oryza sativa
tcctgcagcccccacgcgtcaggccgccgtcgtcttcttcctccgcccggccacctctctctctcttcccgtgaaaccctactcccttcctccctcaaatccgtgcgattcgctcatgggattccaaaattaaataggggaaattaaaccccattgaatcctcttcaattcccccttaattcccccttgaacggcgcccccaatcgccgggaacggacgcgccaagtccggccgccttcctttgccgccggccgccattcccgtcgccgttcccgctcctcccgtggccggctctctcccccatcctataaaatgggatcctcatcccccgttctctcgttttagccccctcccgagcctccccgtggtccctatccacctccccgtcgccctcctctctctcccacgctgccggccgcctccagccacctgtgccgcctcacccgcgcaccggccggccgcgccgtcgcctcctccagcgtcgccgccacctcctccaccccggcttgccctccgtttcgcgaggtgacccccggagctgccttcccgccgtcgccctcctcttttctccgcgccggccacctccagccgcacctcccgcctcacccgtgcaccctccggctgcgccgtcttctccctcggcctcgcagccacctccctctccctcggtcaaccctccgtttcgcggggaaagcaccggagacgcgtcctcgccggtgtccagtggcgtcgccaccacttctgcgtctccggccggctgctgttcgtcgccggtgcgccgaccgacgtcgccgtctcctccgttgacgtcgcagtgccgtcctctctcccggccagccacggcgtcgcccgaatttcgccggaacgccgtcgtctccgcgccggcctctccttcctcctcgtcggctcgtcgccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcatcgtcatcgcagcggcgtgttccacgtcgtcctcgtctccgtgcagccgctgccggctgtcctcgtcgcctcctcgccggccccggtcatcgtcgtcgtcgtcctctcgtcgttcccggtcgtcgtggcgttcgtccctccgtcgagccgttctcgtccgtcgtccgcgttcgtcaagcgagccgctgcagccccgtcctcgtctccgtcctcggctccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtctttcccacgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtactcggtctaccgcggtcccttttgttgacacgtggggtccgcatgtcaacggcgcagccttcctgtcttttccaggctagcgcttacacatgttttataattgcaaagcttaaatataataatccgcaaatctccatataacagcattaaacttcggatgatcatatcttggtcatacgaactccgaatcgacccgttcaagtctcttaatgtttgttataacctaaagaaccctgtgctttctttttatgtattgttattgcttctttataggtttgtagctttgcttgtgtgcttcgcgtagtcttcgtcgttccggaggttcccgaagcgtggttcgtggtcgtcgccgaaggttcggaaggccgttctctctgagcaaggcaagtcacatcatccttgagcatattgaatcccagtttataaaattattttaatttaaattaatgcattatcgttttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttacaattttagactttgggtatattcatatcatttggtcactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtccggttataaacaaaagtacacggatggaggtggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgcgtagctctaggatcgtctttataaaatggctttgggcaactaagtagcttttaaatgctgtttactgcaaaacttaacccgtatattattatccccttgtattcccttgcattaattatgcatctccggtgtggcttgctgagtactgtggttgtactcattcttgctcaatctttcccctcgtcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacagcaatcaagataaatattataaaaaatatgatataacatctgtagcccccgactcactactcaatggaagaccaattggtgtagtgaggcagaggaaaaggaaaaatatcatatagagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccgctcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtagacggaggcaccactggtgtgaccaaccgaccgtataggcggggacaccagtcggcggcgacggaggcaggccggtggtgaagtcgtagacgcccaacagcggcggcttaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaacccggtgaagtctgagattaaaaggaaaaaactcgccgagattgatctcttcgactgactccgagacggagaaaattggtcgtcggtgttgcaccgtgtcgctagggctaatcaagcaatcgacactgagatggtgaggcctcccggcggcagtttgatttgtccggcacaaatgcatgtttgcatcggccaggtcattattggcgatgacccagatcgcgtgattcgaaaccggccaggaggacgcgagcgccaagccccagcagggacgagatgtatgtgcggcttggtcgagatcatggcgatgtacagtacggtggccaatcccgtcgatcgtcctggcagcggatagctttccccgacgtgcggcggatagccaaatcgtcgagacatgaaaacaagaaaaataccagggcatcaatctgtgattagatttcaatctaaagacgatagattagaacgacaaacccgatatcttcctgtagattgatttgatcagaagatggcgtcgacggcggaggatctcacgctacataggcgaagacgaagccggcgactcctgaaaattgattccatcgtactttgacggaaaactcgacgcacccctacctggcgcgccaactgtcgaaacatgatttcggcaataataaaagggggtagcgcacgagacctaaaagtggatggatgcggagacaaaggatttagacaggttcaggccctctcgatgagaggtaataccctactcctgtttggggatttgaatccgccgagtgaattatagatctgacgatctagttgtcttatgccccctagagggcctcctgcccaccttatatagggtggggggcaggattacaaaatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccatatgggtatggggtacccataatatccacagaactggtctcgtttaatgctgatcttttcctcgcttgtgtgaaatttcattgtgttgtagaagcaaatcgtgtatgccacacaacatgacgataacaatcttcatgtcttggaataatgaaacttgtaaaaaactgataggtcaaaaatgccaaatgcgttaatgcgttattatgggtaaagagatgagtagtagatgtcgtaatggctttttattggccatgcatagtcaacgttgagtttagtttcggactccctccttttcatattagagtcgcaatcctccaggctcccgagtccgacctggttagggtttgctcgcctacaaatcgagacgccgccgccacctcccatcacgtacgatccccacccgccgtcgacgacctcgaaatcccaatcgctgcgccgcgaattagtcgaagctgcagtactgcatcgccaagctcatggcggctgagggcggcagcgcgttcgctgggcagaaggtgccgctcatcgacgccagcatggctctcaagatggaggagacgtgccccaccccggaggaggtgaagcatctctcgccggccgacgagcgcctcgcggcgaaggagtactccgacggcgagctcaacaagtcccacgccgaggtctgccgtgaagctgacaagaatagcgccgcctacctgctcgccaagcgggccaagctccaggctctgatcaaggaagaatgggctaagattgacttcagccgcgtccatgtcggtgactgggacgaagaagcaggctgctacaagtagctagcccacccagctctgctgctggaacattggacactggccttattctggatggatggatgattcgcctggcccttttttctctaattagctctactagtattagttagtatcagttatgtctagctgttcgatccatcgttcgatttgtgatgtttggtactagttactaatcaatgggtatctatgttatccaaccatccttatttacgtataaaattataagtcgttttgactttagtaaactatttaaactattttaagtttgatgtaaaattttcaatccaagacaaatatattataaaaatatattcaattgttgatccggaaaaattggaagtttgtgtgtgttggaaagtttgttgtgatggaaaagttggaagtttgaagaattattttggaactaaacacggcgataatatgaaacggagatagtatgcatatagggacagagccaagtataggcatagaacagcttaggcttaggctctaggattgtctacataattatgcttaagtactcttaaatcaccacaaaaaatttaaagaaatctattaatgcattagttggttcgctctaggctttaataattttctagctcaaccctacatacaactctaaccatcacggagaaaactcgtcatgttacctttgaggaatgttctctatgtgtgcttagtctttcatcgatctctcaaagtggctcagataggcattaagaaaaagctttcttcatttcataatgcaaatgatgctaaaatggttaaacattgttttaggtacgtacaactgaagtcgtgtattaccgaaagcccatacaagcctattgggtatttctttaacctaatattgtgacaatatcattaaccataaatgagtctataataggaatacttttaggggcgacctatttggcatctagcgaaaaacatctaaaaatcttactatagaccattggatcgcttttgggatatgtgcaacaacccttaacactaaccctcttttcttcctccctcagtcccaccgtcatcatttcgcagactcgatccaccaacctcctccaccaccaccagcctagcgtgtcgttgcttgacctcaccagcaccaacaatgttggcggggtctattagacctccctttccctttcctctccacgcctttcatccttcccggattgagcgatgtcaaggaggccccgcacgcctctcccccatctccgacaactcccttgccactagagacaccactaccgcccaccgccatcctccataatcgtggttccaacggtgctatcaccgtctcgcccttctaccaccgccaatcactaccgggttgtcgccgctctggtatccctttaaacctgaggaatccccccccccctctcctcttcccttcccctacccctttgtacccaccccctaaacctaatacctaattggtcgggggcatcgtcgttgtcaagctcgcaagagtggaaggagaaggtcacggtgcacgaatctcagagccgatcagagcatccaaattttgaaagatggggtttcgattatgtccaatggaggttagaaattctgatactagttttcatgccattgattttttttattgttgatctaccaccaaaaactatcttactttaacgttggtttaaatggatcgggaagaaagatttccaaccatgcttatagagtcgaacagtaacaggaggtcactataggacgggccaaaactttgaatctgtttgaatttaggaaaactagaggatttcccgtgtaattttgcacgaagctagattttaaatgctaaattgggtttgatataaaaaccttaactcatgtttccaaacttatataggtagaattataaaatatattgtgtacacaataggtttgtgaagtaggattatatctgatatatacttcctcagttttttaatgtataacactgttgactttttaagatatatttgatcattcgtcttgtttaaaaaaattatataattattatttttaatttattatgagttgacttatcataaaaaatctttaagcataacttaattttttatattcacataaaaattttaaataagtcaaatggtcaactttttttaaaaaaaaagtcaatgacatcatatatttaaaaaaacagaggtactatagaattctcaaaaagagccgagaaagtggtgaattacaaatatgcccctctttccccttcatctattattcctcccttcctactctactccctcgacttctcgagtctcgattctactctgtctccaatctacgcagcgaaagccggcgccgccgtctcctcgagcgcgccgacggcggagaagaccgcaggcacggcgtcgtctacggcctcctccccttccttccagaccccggccacggccgcgccgcgccccgccctagcctccgccgccgcctccccagtccggccgcctggcctctccacgcgcgcacggccggggcgagcaggtcttttgggggtgggcgacgccgcccgtgccgcggcctcctcccacctgaatccatcccagctcgcgccgaattcggaggtactcgtctcctctctctctcttctctctctctttccctccaggtgtcccgtacaattccttctggatttccatcattccatgatgcctggtggattgtagctgctcgtgtttccacgaaagaaggtttgggggtttatctccgaatccttcttctgggagggatactctaattggtccggtttgctgcggaaatctgtggagctcgggtagatgctccgtgttagtttcgccaccgcgcactgcaaattctagtggagtgaagaggaatatggtagaggggttgccggcggagttgccaatcgtggacgtggccgctcgtttggatggcaagagctcggagctgccagagaatggtgcattgctgaagggtgctgaggaatcccaggtttggaatgttttagcttactcgggaagtgccaaatatatttgcttctattcgaatgatttgtgatgctttgtttgcttgctaggatttgggaggtaatcccgtggcggagttgacgttgcacgaaggcaaagaggtgatcctcgtcgatgacaatgatagtgagcaggaagacggtgggagtggcaaggtggatgagaatgcgccccgggtcggattgagattcaaaacttatgatgacgcgctgaagtactataagcaatatgccgcggattctggcttttcagcaatcattctgaagtcgtcctacttgaagtcaggggtgtgccggaggttggtgcttggatgcagtcgagctggaagagggagggcaaacgcatgctatctgtctagagaatcaacgaagataaattgtccagctaggatttcgttgaagctaaggcaagatagatggcttcacattgatgacgctaagcttgatcacaaccatccaccgaaccaatcctcggtgtcacatatgaactgttataagaaattgacagatgccaagaatgaggaaactgcttcaagatcaaaagggcgtaggaatgttcccataggtgacaaagagcaagggagctttactgagataggaaggcttaaatttggggaaggagatgatgagtacatccacaagttttttgggagcatgcagaacaagaatccaaatttcttctacttagtagatttggacaaacaagggcgcctaaggaacttgttctggagtgatgctaggtcacaggcagcacatgattactatggtcgtgatgttatttactttgacacttcatacttgaccgaaaaatatgatctgccacttgtcttctttactggggtgaataatcatggtcagcctgttttgtttggtactggattactttcagatctaggtgttgacagttatgtgtggttatttagggcattttttgcatgcatgaagggctgctacccagatgcaataatcactgagcattacaatgctattttagatgcagtgagagatgttctcccccaagttaaacaccg

SEQ ID NO: 69440 - DNA, 521 bp, Oryza sativa
ctcggtacccgtatatagaaggagttctggatgaaggaaagcaaatgaagttgtatatggaaacgaaaaggactactcggatcgtatccatgcttatctccctagttctatttggacaagagggcatctatgagtataaatacaagaccccctaggaggagaggggttaagccccaagcccaagatcaacatagatgattacaagccaacacatgccaagacaaaccgccgaatatcgacatcaaagataagtctagacaaacccaatattgtgtctgcgaaagccaacaagagggatctagcgctatctctgatctcgccgagtgcggatttgaggaggaaggctaccctgtcgtcgactacgagttggttatccatgccgccaagtcgacgacagctagataggttatcctaattattgtattggtgtgattatgatgaataagagcaataccggcttcggccaacaggatgtaaggctattacctgtcagataaggggcccgaacctgtataaaaacc

SEQ ID NO: 69441 - DNA, 6832 bp, Oryza sativa
tctccctcatccctctccttgagtggttctgcctcgccgtggggccacgcggttttgaagtcgctgccgcggcctgcttctcccgcccgccgtcgttcctctcgtcctcccgcagccacgagccgccgccgccctcgcccgcttgccctcccgccgccgccgccgcttgctccccgcggacagccgtaggggagagggagaaagaaagagagaagggaggggaggaagaagaaagggagaagatggcatgtggggcccacatgtcagtgggcctcataattgtgtgtgtgaatgacaaacgggtcccacgtatagctttttaattgaaatgccacgtcagcccacagactaggtcaatacctccacgtcagcgaaaccaccctccaaaacggccgagggagtcaaattgcaccggttttcttagtttgggggtcaagatatccggttttgtggtttagggtcacggattagatttcaatcacttttgagggtcaccaagtgaacttattcctattagtttacatggatgagaattacacggtccattgaggcccatgatactgtggattaggttcgatgggccttgaggatcggcgtccctccagtaatccagcgaatggttcaaaattatgtaatgaaatttccgaaatttcgatcatatcggaccccttgatatgatattatttcggccgaagttttaaatttatattatttttgttgtgaatttggtaatattttgttcaaatgtaactaaaatttatttaaaattttggaaattttgaaccaaaattcggtatattgccaccgtccggtagaaactttcaaaccgaaagagtagggcctgtttggttgttgtccccgtgttcctgcagtggcctgacctgatagctagccgctttgattagcctgactcagagcatctccaacagcctctctaaattagactctccaaacacccatatagccaactctctaattgatttgtcaagccaaactcattcctcactccaacagcctctccatctaccctctctattatgagtctatgacattggaacccacacgtcagcctctactacaccttccacctctttctctcccttttcctctttctccccctcttcctcttctattgccattcttgagtgacgccgatgatggaagggctacgggcggccacatcggatgcggccaggcgcggggacggccgcggtggatacggccgggggcgcaggcggcggcgccggatgaggccgggcgcgggggcggccgtggcggatgcggctgggcggcgggggcagaggtggcggcgccagatgtggatgggaggttttcggagcccctcctcccaggcgccgacgagctcctcgtggtggccgacgtcgtccttgcgtcccagcgcctgctcgtggtgtccgataagctcctcgtagaaggagaggagaagcgcgagtagatggagcactgggaaggaggatagccagcctggtaggctagccaaatttggctagtggatgagctcggatggagagacagttcgcttggagagttgaatggagagtctgttggagtagtgtttttagttcatttgctaaatttttagcttggagagctgagtagagaggctgttggagttgctctcaagcgacgaaaatccaacgcccgtctctcatgcaagtgataagctactagtagcaagattaaggtgatgtgaaatctatgggtcccactattaattacattctttttcttgcttttcttttctttcttcccaccgattgatcatgtttgttgagttaatactatctgttaatattgtctattaaaagtaattattacagtatgacattgcattattcttctcaggcacatggttcaaaccaaacaactcatctcacaggctgcttggtcaggcaaatgtcttcaaactttcagcatagcttcatgtatgagttttcatcatgtcaccaaccaaacaggccaaacctggacacctggtccaccgtcttcctctggttccttggcgctgttgtcgggacgagagctacagcctacgccctacagcgccctcctccggttcagccagtacttccaccgcaacagcttcttcttcttcctatggatcatccttgtcaggtggtgacgacctgacagcacactgatcacggctaaacccgcacagcagcgcccgagtaaacgaacccgccaaaccccggcggcacggccacgccgcgccaccgcgccgcgccgccggcgtcctccatcacccacgccgcgtactgcttgccgtcctccaccttgccgaacacgaacacgaacatggcggcgccgtcgccgtcgcccgcgccgaccgccttcacgcacgccttcatgcctggcggcccgtccgccacgtccctccacgcgcccccgtcccactcccgcacgccgcccttcccggcgccgacggcccacaccttgccgccgaccgcggcaaggcacgtctccgcggtgttcggcgccatgtctccctcgctggaccaggcggttgcgtcgccggttgtggtggtggtgtagcgctcggcggtcttcttgaacgcgccctgggcgtcggtcgggtagccgctggcggcgagcacgcggcccgggtttgcgacgagctgcggctcgtcgcgctcctcggacatgtccgggagcgcgcgccatgcgtcggaggcgacgtcgtacgcgtaggcggagcggagcgcgttcttggactcgtcgtggccgccggcgacgtagacgacgccgccgctcccggtgcagccgaagaagccccgggagtccggcatcgccgcgccgcgccgccacacaccggcggggacgtccagcacgcggacgtcgcgtgtcaggcatagcgcggccggctcccacccgccgacgacggcgacgtgccgtccgtccccggccgccgcgcaccgcgcgaagaacggcacgcccccgccccacgcctcctcctccccctcccccgcgccctccacgcgccgccactcgcccgtggtgaggttcgccgcggccagcgcgcactccgtcgccgccgacggccccttcccgtcgtcaccgccgcgcgctggcgtggcctggacgaggaacacgacgtcctcggccgccccggccgccctccggcggcggcggaacgcctccgacgcggccgcgcggcgccacccgcggcacacgcggcgcaccgcccggtgcgaccggctcggcacgcgcgccaggcactccatggccacgtcgtccggcaaccccgggatgagctccgccgcctccggctccaccaacgccgccccgaggagcgcgccgtcgcgctcgatggcgccgcccatggcgagcagagcaagcagcagtgtggcgtgtctttgctttgtgacgtggaaagtggaagagagggtgtttgtgtgtgtggctcagtgaaggaaggagggcttaggagggtttaagtagagggagagtgagtgtgaggacaaatttgagctatgatttctctctctctttttttaaagtgtgctgaaaattagataatatgacgtccgtaaaaagaaattcacttttatatatgaatctggacataaatatggacctcacttttttttaactactttgtctagatttttgtattgaagtgaagtctttttttaagatggaggtagtggtattttagaaggatatagtgaaagcgaaaaaaaatacagttgtacacgtagtggaggaagatattcttgtatatggtggactataaaggtataagtttggtaaatttgatcagtgatattttcatataggagtggggtaatagagaagattattgaagcacagtaagtgaaaaataataatattgcttatcataagtctctccttacatataactgatcttaaactagggaagccaaattatgataatggactccgttccatttatcatcgaatttgatggattctccctcaaggagtgtaatggccgcacctacattatggtcactaacatcttaaccatctgaagttaacctctcttcggtttgtacattaggcatggataaattgtgtgccttatgatagaagctgaaaataaaaaccatttatattatttaaagttgtacattaggggtattgttaatggtttattagtatggcgtatacattagatcatgtttagccaaaaacaaaaattaattttctttgtggagcgtacacatccataaattttctctcgccctacttatagatcaattctatatattgagtgcaaacaaattttagcctttgtatgaacttggtaagcatacaaccgataggaaatataattcaaccactgaattactaaaaaaaaaatcttgaagcctaaatccgacgacacaggtagacttgacaagaatcataaaatatatttacaagagcaatttccagcgatagtgatgatttatcactacatatcgtacatatatatggtaagatttttgacaaataatgcatggagctagcataaagagctgttaattaaagatgtggtatcgatcatgcatgtgcacatagacatgtgtatcgatgtttcatttcgtgtttgaagaaaattaaagccactatagaagtaaatctatttttcacaacaaaaaaaattgttgcattaaaccaaaattcattgcaacggacactaattgcaaacaaaataaaaatgtgttgccaaccgttataacaagtgccatggtaatagtatattgcaacgaattttaaactattacattggtttgtgctattgcaacaatttttttttcatttattgccatagtatgtggctttgatatgtgtaaatattaccacaaaatatctgaataatgtatgaaccgaaagatgcatgtaaaaaaagaaagaaaatgacttgaaatctaccctctaacctttgtaatgccatatgcaaagttggatgctcttctgatccttgatgtgaaaaggatattacatcttgccgatcataatccaatgtatactttgcctgcaaccagtcaagaggttacccacttactctttttctcaatgacgaaaacatgttttaaaatatatagcatggtcttacacagattttgatcgctgctctctatttctgaaatactttcaaatctcaacaaaattacagtattataaaaaaaacatttgagacaaatctacgtgcgtagtacatacttttcatgcatccaatctaaatataacatatattgttgttttgaagcttaaaaagattgacttggaacatatctaatatttctgaacgctagaagttattgtattttaggaatactatatatatcaccttttaattattgccatcaaccctcaatcatagaatcttttggggaaatgaaaagtgattctcctataaacttgaggtcacaccagaaaaactaaagattagactctattattctacaaatgcatatgtaccattgtcccactcccaccactacatagcatgttggtgtgtatgtgattttgtatgtgattacgaaagggaatgtagcctagtggttacagtgacctgagtagtgctccaaggtcctgagttcaaatctcctatggagcgaatttcagattgggttgtttgcggggctaagttccctatcttaatggccgtatatatccggttggatatagaggccgggtagaaaatacccttctctaaaaaaaatgtgattttgtgggcgcgccaatatatatatgccacagagctaagcatgcatgcagcgtgaactgaagagatgcgtttccccgaccaaaaaaggaaaaacagagaggaggagatgattctctagagaggaaaaaaaaaagaatgaccttctagaaggtggtgagttgcaccgagggcccaccagcagaaaggtgcatgcagcttagtgttttcccttttcttttcagttttcactctgctgtgtccctgtgtcttttcgttcttttccccccgaaaggctatcaatgtgtgcttttttttttttttgccttggtcattccaaaaaagtaaaaggaaaaaaaatgatttgccttgataaggactagctaattgggagtatggaaaaatacatactactcatcaagattgctatgatattttcatactctctgtgttctgtgttttgcatacacggttatagtatggcaatgtggcatttggttgaggagaaaagctgtggtagataattaggccctgaaaattacagctgacatcatctaaacggttcaatcttctcaggctcagcagcagctaagcaacacaccgtcatcttgcagatatttctcattctacgtgcctattcactttgataccattttcaaccataccaaattttttttgggtaaagtttcaaaaaaaacatctacgtttagtttgttgtcaatatataaaaagtcccacaaaaatttagcaatattgtcatcctgctaaacttttggtaagatggtaaaacttggtaagatttattttagctataatttgaacaggctttatatatacttgcagatattttcagtgtttaataacgtctacagttataagcacatatattttcttaggcttaaaatttttttgatccgtcactatacttaagtgcaatcttagctagcatcctctctctcaaagctagagagaggtcggcagcagcaacagatctagtacaaaaatatcagcagagcagaggagtacaaaaccaatgtgttgctcgaaagttgttcactttttgatcgcatattatggagtatcgatcaccttttgtgtttgcgcctttttgaaaatacaaaaccgatcgatcgagtattactagtaaggaatcaa

SEQ ID NO: 69442 - DNA, 707 bp, Oryza sativa
catcattccttgcattggtactgcattcgcgcggcctggaatgctggatccaagggctttggggcaggcagtattttctcccgatccgggagcaagcactggtccgatcaaatttgagtttctcccacaccccaccacggagaaacccttgaatcccgttgccaagcaatcaattttgttcggtgattggtagaagttgctcaaacggaaagaaagccctccatatgagcttaatataattgcattgttgccgctcatctggtccacccttgacgaccatcattgtccaaggattccgattggccctgtcaaaagaaaaaagaaggacaaccattttattctttcagagttcaggtattttgtaacaaacgtcagataaaagagggcctgaactagtgaaattcatgtcaaaaatatcagagtagtgttgattgcatggcttaaagttatactccacgagcagagtaattatgtgtcttcactgcaccatgggcggattatattactatttcgacatgacagacatttcttgaacgattgcatgacaaattcagataaacaattaactgtacaagactaaacactttttactaagaaaaagaagctaatggcaataatttcaaggaagcatgcattctgtatgacagaatcatgagcccaacaattgcttcctgaaattaagaacacacacgatggttaaaagaaaa

SEQ ID NO: 69443 - DNA, 691 bp, Oryza sativa
ttcatgacaaaagaagaaaaagaacacctacgggacgggattgtgatatgtccagtctgaggctctgagcttcacactgtgtcactgtcgtagagtaaacggcataaattggctgtacctgctaggcagagagagagagaggcccgtccagcctgcaagaaatgagaaatgcatgtgactttctgaattgcagcgctgatgtgttcgattcagtttaggaccactcccggtgcaggccaatagtaggagtattacctttccttaccaatttgaccgataaatgctggaaagaacggccggtatactcctattgacatttcacatggcatttgcagagcttcagtgatgatgggtgaacagcctacagtttacagcacagagcctgtagtttacagtacagagagtacccaataaaacgagacataaatattgcggcttgcagaaaatgcagtttggaccacctccacaaccttctgatctagatatagctgttgctattactgatactgaatggaaaactgaaaacaaacataggttaagggttggtttagttcacgccaaaattagaagtttgattgacattggaacgatgtgacggaaaatttggaagtttatatgtgtagaaaagttttgatgtgatgtaaaagttggaagtttgaagaaaaagtttggaactaaactcggcctaagg

SEQ ID NO: 69444 - DNA, 10138 bp, Oryza sativa
agcatcctctctctcaaagctagagagaggtcggcagcagcaacagatctagtacaaaaatatcagcagagcagaggagtacaaaaccaatgtgttgctcgaaagttgttcactttttgatcgcatattatggagtatcgatcaccttttgtgtttgcgcctttttgaaaatacaaaaccgatcgatcgagtattactagtaaggaatcaattcatgcaatcaatccgatatttccgatcgagatcgaggagggccggatttggttttggcggctgcgaatttcgagatgatgcggagggggcaaaaggcgtgtctccggtgtctggcacttgaacgtgtctaaccttctagaagctaacccattcatcatttagaaacgggtgcgctcggatttcggaaggagtggtaacttctccttcacatacagaaaacaatattaacatataattaattaagtattagttaaaaaatataaattttaaaaataaattattaaaaatataccagtttgaaaaaatacacgcgaaaaacgtcgagtagaagttagaaaaggataaatattgaacacaccctagcctaacatgagcatgaatcccatccctcttttcgtgtttgcttctcgtagaaaaaaagagtcgcgtcatatatttatcatatatttggttagatggacatcgaaggcccatttcaaattgcataattcatctatttcttgctggcagacccctctaaactttgggtcaagctagatctgacattatctattatcttacacgtgttaaatttaaaggaaaaacaaagatgacatatgtaaactagcatactccatccattaagatataaccccaacggtcagaattacacgtaaggcactaaatatcttacgtctccgctgacatttgctagttgaaaaaaagtggtcaccaccaagaaacgtccttagtcacctagcttgatgatgcccgctggctccgtcactgttatatatgcatggtgtcatttaaaatagacaaattaggtggtcatgcattacatatatatcccaaaagccacgaggtgtcatatgcaattccaatgttaatttgttctagctcgcagggatgagaatactagcgtgtacatgctcagagggctggtcctgatgtttcggtggtcagggcgaactaaacaaatggaggtccttaatattatatcttctactagataataactaaacatttgaaatgcatccaaaagcaaaagcaatatttattatgtaaaacattataaatgttgtcttaagattttcttcagatattcctacaggcaaagtaattgattatagtatcaatattaatctcatctagcaattttattttacaaaaatatctagcaatttcttctcaatacatgaagttgtcctaccgtttatccatttaatttttcgatgaagttgccagtggcagcagaaagtgtagtgtgccggcctcgtcatgatagacgtgtagcatatgagttataacatggttaattatagacaaaattttttttgttagaccttttaatggatggaacaatattttgtacatgtaagaagtttttgtaaacagatcgaattctattggcatagaaaactcacatggaattataaattgcaattctaaagattttctagtcaaataataggtaatgtgatttgacactattttgaataggaaacatggcactgcgaaaaacacactgacagaaagagagcggtcgtcattatattgatttttgtcatatgcagctagtctagaatcaatggagatcgccctcaattttaaacaccctcttatacgatctattttaaacaccctcttacacgtggtgaagacgaaacctatctaaagaaatcacgacttgacaagggtatatatgcattatgcgtacaagtgtatgattttacccactagaattcaaccccaattaatcttcaccggttccaccttttacacataatcttgcaagtagtgtctcagtgactactactccctccttcccaaactgatcatcatataagtttatacaccaagaccaagaataatttaaatcacatcaattaagacatcatatacacattctcccataacgcatatatcgattaaaacaccatgccaattacaccttagcatgcacacattttctcatactgcattaattgtattataaagaaatccgtgtccatacggttatatgatgatcaatttgagaaattttaaattccgttatatgatgattaatttggaaaggatgaagtagcaaaaactacacgcatttaattcttccaaagacaccccacaaaaaaaattcccctaaaaaaaattcttcttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacagtagcccctgagaccttcacagtcgaaaatataatcttctctcgaactagattactccaaagccgagtgcttcaattatcttcgccatggtctcccgagtacttttaccaaatctgaagactgtggagggctgaaaaataaagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatatatagcatatgcggtgtgaatccccgaataatatgatccaagtgatataccgactgcttggcaaaatatgatgcgtacaacctaaagttgacaacatctttgaaagttcacatagcaaaacagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctggaaaaatgaccataatatataatcagcctaagccataatattggtcaataaaaatgcacacttacgtggcaaaaagcaatgatattgtatccaatcaattgcttgataaacccaaacagcacattgactatataaaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaaatgtagctcatatgaagagcttctgatctgagtggttatcccttatgagatactccaaaatagatgtaacaattgaatcccgactggcgcaagtattcagttgataacccttacggggaataataaatagtccagtctttgagcatagaaaatagacccatgatcacgaattcatattgcatatatccagagcaagtccaaattgaaggtatgatacttgtgtttgagctaataagcccctgagcatatagcttgtccttctgtcgtagtcacaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcaacagtcaggtcagccatcaatgaagatgaaggtgcccagcgataaagttatgtagccatggcagcgaaataatcaatcggtgacagacgaggcagatcaaaggcgatgacgaaatccaccaatcatgaagatgaggaagatagtcggcgacgacaaacgtaaccgacagtaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatctgcgtttgcatagtaggtcaaccgtgaaggcggaatagcaagttggcgaagtcttagtcatccattagcaacggcggaatgtcagagccgatgaagcagatgtgctggtgacgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagcagcagcaatagagtttgccggtgccgaagataataaatatgaagtcgctctaccatgatgacaaagttgcatcgccgtgatgaagtgaacacgagtcggcggcaacagaagcaaactggtagtgaagacgcgcagttgtgaagatgaaagcaccagtcggcggcggcataaccagtcggcgacggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggtcagccgtgcaggcggaaacaccagtcggcagcggcgaaggcaagccggtcgatgaagacgtagacgcccaacaacggcggcataaaggccagccgtgcaggcggaaacaccagtcggcagtggcgaaggcaagccggtcggtgaagacgtagacgcccaacaacgacggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgacggcggcataataggccagccgtgcaggcggaaacaccagtcggcggcggcgaaagcaagccggtcggtgaagacgtagacgcccaacaatggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaacaaatgatgacttagctttgtaatattccctcggtgacagcaaaagtagccgatgtgggaacgaagcagtccatcaatggtgacaaaaacatcagtcggcgccagtggaaccaagccagtggtgtagatgatgaagcccattaacagcggcggagtgaccaatcaaccatataggcgaagacaccagtcggcggcgacggaggcaggccggcggtgaagtcgtagacgcccaacagcggcggcataataggccagccgtgtaggcagaaacaccagtcggcggcggcgaaggccagccggtcggcgaagacgtggacacccatgaacggtggtgtgaccaaccaactgtataggcgaggacaccagtcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagatgacgatgcccatcaacggtggtgtgaccaaccgaccgtataggcgggggcaccaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaaacccggcgaagtcggagattaaaaggaaaaaactcgccgagattgatctcttcgactgactccgagacggagcggaggaggcggaggtcgcagtcgcgggcggcgttggtgtccatcagcatgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacctctacctggcgcgccaactgtcgaaacatgaattcggcaataataaaagggggtagcgcacgagacctaaaagtggatggatgcggatacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacacttctaaagaccacatttgaatctgagtgcatatagaaccatagacaatcggttgtgctagctactccctccgtttcaaaatgtttgacaccgttgactttttagcacatgtttaaccgttcgtcttattcaaaaacttttgtgaaatatgtaaagttatatgcctacataaaaatatatttaacaatgaattaaatgataggaaaagaattaataattacttaaattttttgaataagacgaacggtcaaacgtatgctaaaaagtcaacggcgtcaaacatttcgaaacgaagggagtattatctttgtcacaagataaaaactgaatctttttatttcttgcgggcataaaaataaatataaatctgagccttgaaggacgaagagaaacaaatgcatgccttcacgtatggaggcaaagatgcccaattgccccatcattcacggaaacaggtcaatgacagcgaaacggagagtcaagatcctcgagacttcaaagagatgtcttctagtactaatatatcaccatggacttgactcgaagagcatcattgccagcacgcactactgcgttatacatgtatcctgcattctctaacaggtaataagtactacatatatatcgtgcaagggtataatccgtttcaaaatattaaataaattctaaaactgaaaatggacattactaaaaaaaaagaagggagaatagctaatgtggtccctgaagtttcgcttcgggctcagtttagtccttgaggtttcaaaacgtccaaataggtcctccaaattaatcatttgggttaacatagtacttgaaaaaaaaaatgccacataaacatgccaagtcattcttgcatacaacaatgaccattctacccttaccatataaaaaagaaagaaaagaaaaaaaggaaacaacagatagagtaatggtccggcctttttgttcgttcctccctgttgtttccttttttttcctttatttttttcttttcttttttttatatggtaagggtagaatggtcatttcatttgtattgttgcatgcaagaatgagggctgcaggaatt

SEQ ID NO: 69445 - DNA, 8499 bp, Oryza sativa
ttagacaagcagcatctacagcagcttcggccgccattactgtttcatcgagctatactagagtatactaccaagaaggaaggagggagtgggctacttcctgtctctgtcgtcctcgctggtctccgacacggcccgctcggaggacacctcggcctcgccgcacggcatgccgaacctctggatcacccactggagcgactcgatctgctgccggtcgtacatctgcttctgctgcgccatctcccggaactgccgcgcctcgcgctccaccagcgccttctcgttgcggaggcacgcgatcttggccatggcctcgtcggccgcggacgccgccgcgcgcctctccttctccagctcctccagcgcggcctccctccgcctcctctcggccgcgagccggcgcctcagccgctccacgctgccgccctcctccgcaccgctgccgcagccgccgttcgcgtcgccggccgccgcgcactcgtcttcctccgcgttggcctcctgctccagctcggcggccagcgacctcgcgaccggcttgtcggagcagctccccttggagcgggccggggacggggtcggggacgggggcaggccgcctttcttcttcagggccagtatcttcgtcccgcacacggcgcagacgacgccgccgacgcgcaatgcctgcaccgtggcgtccgcgttcccgacgagcccctccacggcctcgcaccgcttgccgaggcgccagacccccgtcgccaggagcaggaggggaattccaacaaacatctggggggcgctcaccgacctcgccagcgcaacccagcgctccgcggaggcccagtcgccgccggcctcgtcggactcggacgagtacaccatcgccaagaacccagcaccgacccaaccaggaagtagaacgcgcccaccccgggcataaacgcgaacgacacgccggcaagcggcttcaagaatccgccgccgccgccaccggagatgcggttcccgccgcccatcacttccccaaattgccacaaataaaacaaaaccaacgaaaatgcgatctcgcggtgcgtcgccggtggaatcgcctgcgaccggaggaaatataggaggagatcgccgtgggtttagggtaggcgtggtgggattggggatgcgaaaagaatttggtttaagcgaaaaaaaaaaaagctcaagggtttcgattcgaagggggatctctgcggataagtcgcgggtggcctcgctgccgtgtgggtctgggagttcggaaccgtcctcgcgtggggcccgcttgtcggttatgggccgccgtgttgtgtgggcccggcgagaaagagtgcgacatggatagagtaaccggatcggagtgaaaagtcgtttttgcttaacggtgacgatgacaggtggggtacaagttatgtgtggcccacatgtctgtgtaagatatgggttatggcgtgtgtgaagttcggagagaatctatgggaacggaaatatggaatacgtgggcttcttttgggagaagaccgacttttattactgcggaaggtgacgctagtccaggatcttttttttccctcgtgatattttcacggaaacgatgaaaaacgactccacatcatcaattggctagtccacgcctgactacccacttgagaatttgtaatttttccagttgcctgtgtatctcgtttgaaaactccaattcaagatctggaactcggcattagtaacaaggacccggtttaaatttgtggctccaaagagacgttggattgctctccaccgctacagaatcgccaaatcgattccgtccgcttatctgattgcgcgcacggttggattgcgcacggtatccgctatgaagaaggcctacgaacaaagcgagcaccaggcagcaacacggtcgccactcggcaggccggcagcccgtacgcgccccgcgtgggccaaaaccacgggagccgcagtggactgaccggacggacgcccatacacgctacagttgctcgctcctctgccgtagtgccgagcctatttagaaagatctagagccacttggattcgtagggtagtaaaaaacataggaatagaaaaaacgtagaaattgaagtagtataattcttcaatcctgtgggaattaaaaacacatgaaaagatgaaatgtgcccttgatagttctataggaaaaaacacaggatttctcttcccaagaggtcagacctctttctttttttcatgtgaaaataaactaaagggatgcaatccttaggaatgtttcctttcatttcctatgaatcaaaggcatccataggaaataatccataggattgtgaatcctacaaaaaatcctataccgatcatttaaatcaaaggagcccttagattctcatcaaaagcatcatctaagacccctttaaatcacaaaaatgaaaaacacagaggaataggaaaaacatagtattctaataagaatgcaaatgtaaaacagaggattgcaaaacgcaggaaaaacatagggatgactgtttaattgggccgcaggaaaaacacaggaatttgaggagagataaaaactcaatagattcttaccatgaggttctacctcatgttatatttcctccaaaaattgcatgggaagaggcattccataggaatttcataggaccattcctttaattcaaaggactatataggaaaaattcctatagaaataaaatcctctaaaattcctatgaattttctttgaatcaaaggggcctaagaatctggccgataaaaatctagagaaattgaaaaaaatcagcttgtcttttagtttactttttagtttttacaactatagcttctcgtaatctagacaggttgtttataagaactcttaattatgaaaaaaaattgtacatgctagaagctcccacaagaaaatcgcatagcatactagaaaaattcctatacactctagtctatagaattattaggctcgcccaacaccacaaccttttggtgcttgggcgcggggcgcctatgagagtggttgatatgccactatgcattttatgactcctctaaactttagtcctacctatgggcagacgttaagatggtttgactcagttgagctcgttaggagtttagtgactgatgagggaggaggtgaggagccaatgttctggcaccggcacaagacggcaatggtgatgtatggtcgtgtggcgccaatgtagcagtaatgatgagtggagaatagggtttggatcaatatgaactttagtgttctttttagacctagtcaatcggtatagcatggacttatttttgtctagtagagaattgtaccgtatgctgccctagtggactattggttcagctcgttaaactcatgaatactccataactcgtaacctagctcactactagaattcaacgggttccctagagttaaaattgttccctagagttgttaaagccatccaagggaaaccaaaagtatccctagggagcaaattgataactctaagggaaagaagtattcctagggaactttggctgaaatgacacgtagctactccacatcagcatggtggtctgattacttccaatattttttttcaatttttttccttgctgcgaccaaggaacgcgccctcgacatacaaaatttctgcccaataaatgttgggcccaccttatcttctccacagctcaagcaaaccacatcctctcgtttttcttcaccccaacggccggccggcgtgcggcggccggccggcacggcggcccctgccctttccttgaccaaacctcgagctctagcaaccggtcgccagcaagcacccgacagctgccgctctcgacaagctcgacggagcctcctctctcaccacacgccgttgtctccgtcttgcataagttgtttcgatccaattttctcagctcctttcctctccttttttttcttcgtagcgtgcagcacaagagcgcactccagcaagcagcgagcaccacaaggttgctgatgctccagcctccatcatgatgctgaccagcaatggaagtacaaatccaagtaagtgttgtttcaactgagctcgaactgaagtttctttcatatgtgtgcccatttgcatattatcttgatctgggctgttgagcatgctatttgggttttcttttcaagaggcaagggctggaagcattggagaacaaacaagattagttccacttcagttctttgcggatgcagtttttcaagtttccactgttgttgcagaagcacgctagtatcaagtggtttagattcgttttcaagaacatgtgttgtcttttatgtttttatcgtttcgatctgagcgatgatagcatcagctcatcagcacatctgaagtgtgtatcatatgtttgtgagaggaattttttgtcaacttttcagctccactttgtactacaaaagtatatgtaaactgaagaatcaatgtaattgagtatttttctattgataatagaatggcatttttatttcaactaatgttttagctttgatgttgaggcaaaggaagacagtaaaataaagaaaccaaaataaaacaatgaaatatgcaattttatttaaatggtaatatttttcctaaatttggctgaaaaccaaaagaaatccactttacacgtcagattcagtttgcgccacatgtacaactatccctatggagtgaaactctagggaacggaatctttccctaggttctccttgaaaaactctagggagctgtgttgttcccgtagaatggatcccagggttcaccctaggggaatctgttcgccagagtttttcccctgatccctagtgtatttggctctagggaagttggtggattctagtagtgcgcttgagttgagccgttaaggtaaacgagctgaaagcttcatgagccacgagtttggcgataattttctccaggtcatcttatagctagtgaaacacactagattagctataatatgatgggtcacacaatactattttattgttttatacccattagttttctctcccgggtacttttcttccttgggtttgatgaggttagcatgcatgtaaagagcttattttggtttctgtgtgtagcccggctacaaattaatcgctcattcaccctctctctctctctccccttctctcttccaacttattttgcagcctgctgatatcttactgtacatgctctaatacgaagtacttcgtctgctccaacagttttcagttaatccctcgtccttttttaatgctcacgcaatcgtttcgagatcccacaccgggcattgatcttagctccagttccatactcctacatccatacttcttgttccatggatcttagacagggacagcactctctacctttccctagcagtaggctagtacagctaggatctcgtttccgcgcgatcaatgcttctcactgattggacaatgattgccacatcacttgatcaacaaagcatgctggctggctggatgcacgaaaccagatccatgctttccatcacgttacacagtgcccctacgtcccaacaaacgcagccaagaacacacacatcaaaaaaagcattaatcgatccatccatccggcaataaactccaagagatcttcgatacggttgcacgcctatatactctataataaaactgtcgtttatcgcacaaaacgacggtggatgtgcacatctaccaccgattcgtaaatcctaaaccgcgttttaggaggatgcagacgacgaagattatcatcggttgttgatcgcactcaacagaatccatttcggttctgcaatacaatatacgcagcggttgaaggagccccaccatgtaaccatgttcatacagaaggtcagcgtctccacggccgtagtgttggcggatgaccaaggtccaaatgacccccaatctttagtcgtttcggattctttttggcagccaatctccggggtctgatctgtattgtatctgtgctttaagccatcctgtattacgcgtcaagaagccagacaaaaagctctcttcctgcccaaaaggtgacacaaaaaatgaaccaactattgtctactgcgggacttccatttgcaagtgaaagttttgatctaaaaaaaagtttggtgcctaggtagtagttagattcacataagggaatatatccagcaatggtgacaacttgtacgtggtgtgtacagctgatcactgcaggagaattgagaccactctgtcgtagctttgcgtttttttgtgcgtgtctgattatcagtcgttgttcccgttggcttaagcgagccttaattctgtggtacagcaaagataggtaagttggtgattcaatattactgataaataaagccttttgcaaccatcgatggttgacacaccgctacgataattacgccatgatggcatctacaggccaccgaatctgtcgacggttacggttccaggacctggtcgtacgtccgttgtttactctgtcgtgtggcatcgcaaaaaagaaaacggaaactctgcatccagctttgtgatgtcaacatgatcctaccttcagctaacctgaattaaagattcttgatcaccgtttacaggtaaggagtagctccagctaacacctgtgttcgtgaaaacgaccggtaatacgcagatggtaaaacacactgttagccttgttgcaaatctaagtcagctacagttctgtgcaaatcttctcaggcactattgttgtacttctggttgttatgctatcaaaatcgcaacatcaacactagtacgtactgtacgtaggagggagggattcaggatcaacgcccggcaaggcaaagctttgtcaacgtgcatctctcgatctgagccgttggaaatgtaatcggacgtacgagatcgcgccgggatctcgtagcgcggttgcgaacttgcgatgtcatttgtggcatcctccgttttttctccttgtccgtaaacaaaagcaatggaaagtctcctttccaaattccaatattctgcttcgcttgtttgtttcttccctcctttcctcttctgcttctcctcctcctcccaccgccgcatggtgtgatcagccaagaaaaaccatccatccacgcagcgatgctgccaccgccggccgccgcggccgccgcgctcctgctgctcctggcgctctccgccggggccaacgacatcgcgtcggacgccgcggcgctgcaggcgttcatcgcgccgttcgggtcggcgaccgtgtcgtggaacacgtcccagccgacgtgctcgtggacgggcgtcgtgtgctccggcggccgcgtcgtggaggtccacctcccgggggttggactccgcggcaacgtccccgtgggcgcgctcgggggcctcgacaagctcgccgtgctgtcgctgcgctacaacgcgctctccggcccgctgccgtccgacctggccaagtgcgcggagctccgggtaattaatctgcagtcgaatcacttctccggcgagctccccccggagattctggctctcccggcgctgacgcagctcaacctcgcggagaaccgcttttccgggaggattccggcgagcattgccaagaacgggaggctacagctgctctacttggacggcaacctcctcaccggcgagctgccgaatgtcaacatgccattgctcacctcgttcaacgtctccttcaacaacctcacaggcgggatacccagcggtctcagcggcatgccggcgacgtctttcctcggcatgtcgctgtgcggcaagcccctcgccgcttgccgaacgccgatttccatcccaccgtcgcaggctccggcgctctcgccagaaggcgcggtctcggcggtcggccgcgggaggggcggacgccgcctagccggaggagccattgccggcattgtgatcggctgcgcgctcggcttccttctcgtcgccggcgttctggtcctcgcgtgtggcgcgctgcagcgcaagccaagaccgcaccacagccgtgacgtcgcggcggagctcgccttgcacagcaaagaggcaatgagcccgagcgtgtacacgccgcgcgtctcggacgcgcggccgccgccgccgccggcggcggtggtccccgcgatacaaccggccgtcgccgccaacgtcgcaggaaagaagaagctcttcttcttcgggagggtgccgcggccgtacgacctcgaggacctgctgcgcgcgtcggccgaggtgctcggcaagggcacgtacgggaccacgtacaaggccgcgctcgagaccgggccggtggtcgccgtgaagcgcctcaaggagacctcattgccggagcgcgagtttcgggacaaggtcgcggcgatcggcgggctggaccaccccaacgtcgtgccactgcaggcctactacttcagcaaggacgagaagctcatggtgtacgagttcgtcgccatgggcagcctctcgtcgatgcttcacggtatgtatgcatg

SEQ ID NO: 69446 - DNA, 1360 bp, Oryza sativa
aggtgataaaatgaagctggctgaagatcctttcacggaagacgagcttgactactacccatttcttgagaacaatcccgttgagtttcagctgagagatgagctaccactcctggagcctggaatgaactgaagaatgctaatctgccccacttgaaaagacctcagaacagtgctattatcatcattatcctctttgcaaactctacttgctcaggagcagtttatttgtagtagtagtagtagtaactagtatcctagatgttctgctgtatgtggttggtgtgataatcattcacactttaggaagaacccaagtagcggaagcaactttagcttcctttatgttctgtgtcttggctgaaatacccatcattaagccattgtgtaaatggtagtagtagtaaactgtagtgtaaggattctgcagaagtacatgcgtgtgccacttcctctattacgaatgcgtgcacatgtgtttgatttcctgtttatattttgttcagagtttcagcttggtcaatacaatgttaggttcatctgaacgcagccatccacttgaccaccttgcatcgattcccagttcggattggatgaatttgccgttccctgttcaaaatttgacgttcgctgttcaaattggatcgtgacgaggaagccttttgccgtcgtgttcttccatcctctgcggctggttctcccgggcccacatgtcatccacccaggggaaggtgggaggaaagaccaaaaaaaataaaaaataaaaaaatgttggatcgtgacgactcaccaaggcctaggattatttatgtattgatcggtcgcaaccgcgagtccgcgacggggcgagacaccggcggccatagctcgagagctcgaggtcaacccgaaagccacgcacgcgccgcgcaatgggttccgacgccagcagcgccgccgacgcgatgggagtgctccgggcggcggtgcccctgcagccggacgccgacctcgtcctggctaccggcggcggcggcgagcgggggcaggtggtggggctcgtcctcgtcgacgtctccaacgggttctgcaccgtcggcgccgggaacctcgtgagctacctccccccctccccacgcctctccctctccctctcttctccttcgcccgtgccttaccgcgcgcgcgacgcggattgatggtggcacgcttggttggttgggctgcgccgctgcttggcgtcgtggccaaaattgcttgtgtgctggggattgggacacgagtgaatagaccactctggattactcgcaggaatatcctcctcctggcttctgccttgttttgaacgaccctgtttgttttgatctttattgtcgtattc

SEQ ID NO: 69447 - DNA, 786 bp, Oryza sativa
tataaatgtgttgaagcttatgctcaaagattaccctgactagcgtgagaagtgtatataatatgaacacttgcatttaatcttaaaatgcaccttctagatttatttcatcaatatcaattgattcagtgagattgtaccatgtcgactattgtgaagtatgttatgtttccacttcttttttcaggtatgaagcactttcagattgttttttcttatattgcaggaacttcaaaaacatggtagtcctgatattatcatggttttggttggtaataaagctgatctacatgaaaatcgacatgtatcttctcaggtcagatcttgtgtgaagttgtagtaaacatagtatcacaatatgctgcaaaattgttttgacgatatggtgcacattctgaaggaagcacaagagtatgcagagaagaataatatggttttcatcgagacatcagcaaagacagctgataatataaaccaagtatttgaggtatgccccctagcatatgaagctatttgctttcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactgcgttaggccatcaatggtcatcatcatactaactcgttatggtatgatatttttccattcacaggtcaccgtttttgcattagggtaccgagctcgaattcgccctatagta

SEQ ID NO: 69448 - DNA, 14675 bp, Oryza sativa
cagatagagtaatggtccggcctttttgttcgttcctccctgttgtttccttttttttcctttatttgtttcttttcttttttttatatggtaagggtagaatggtcatttcatttgtattgttgcatgcaagaatgacttggcatgcttatgtggtattttttgtgggtccaaggactatgttaatccaaataattaatttagaggacttgtttggacgttttgaaacctcaaggactaaacttagcccaaaacgaaacttcaaggacgcattataaaatatgaagaagagattgtaattggttgagaaaaataaaactgatagaaaaattaaatggagaatagatatatgaatggtttgagacgtgggagtaggtgaagaaataattgtattgtaaaataatatttaaataattagaaatagtttatttttagacgaaggggatcgtagatgcctatggtgttggtgccgaggacatggagacacacataaagaaaacgttcagaaaagataggagtagctactaggccgagatggatggcatagcccatcgtacaggacgccccggtagatgggacagtaagacgctttgaaagaaaacctcagctcaggcttgctctttttttaagttactcttttttttttcacagaacaacgcaacagaatgtcatccctataaacgcatgcacgcacgtaaatcgtacccctatgagcatctttaaagactgggctggtaaatccttgagattgacgaagtcaccacaggcgtctcgctgtcgacggttacgtcaactaccactgaaagcataacgccttgctgtcgacagatacgccacctaccactgaaagtataacgcccgaacccaggaccttatatgctacactaggttacaggccctttcgagtaagatatattttttaaaattgctaaatgatatgttctgtataaattaaatttgtgttataaaaactcggacaaccatgtctgagatacccaaccatcttttcagtcgtggaagtctcttttttgaatgaagttcttctgcatctttgcagaataaatgatcactcaagcagtttgtagatgattggttacaaactttatatcttttcttataaccttttataaatatttttcttaataaataaaaattacactgctgggcaaactggcagtaattccaggaaaaaaaaactcggacaattatgtattgattgctattttattttacgtgattttacttaatcgttgtcttcggcctaaattaagctagttgtacgtagtagcagttcgatactccagtttgatacattattcattgacttgactaagaaacatttttttatatatggcgtggcgttaaccgagagagacgcggtcgcgcacgcggtcgccgctgccgtgagcaccggtgccggcggtgcgtcgcatagccatataataagcgtacgtgtcttatgatagtatgacgtagagtaggtctagtttttgcttgactcttttggaagaacggccggagaccgccttgaccaccttgagccttgtggtcgtactattggaccagccactaccacgtcggaccgtcggtacgaccacatcatgtatccaagatttaaatgaagatattatctcttttttttatagcaagattaaattgtcgaccgatatccgagtatccattttaatactctgctttagagcaagattaaattaatacagtttgaattaacttttctttgtcttggtgataaaaaataatacgcgtaagggtgtgtaagagggtgaacttctcgagcaggggactgtgaggcccccctttgttagttcggccggaggccgcgagtgaaagttgaggagttggaaggatggaagtatacggcgatgtcgagggggtcagggccctcgatgaagatgagacaaaaagggtttatacagattcgggccactaaggagcgtaataccctactcctgtgtatgatgatttttctgagcttataaagtctctgaatctctggtgtacaagctagagctaagccttcgactctagatccccccttctcgctagacatgtacctccttttatacctcaaggggttattagatgggcccaaaggtctatttagggaagagggaaaatattctctacattaaatatgtgtcttgtgccttaacccggaagtcatctgcacgtcggctgctgtgcggggcttatcaaatcataccggctgacacgggggatgcccctgccactcaccatttaatggaggaggacttggggggcatgcatgcaccaggaacacaatctcgggcatgtctggagcagtcaagccgactccagactggtcgagaggtccaaagcctctcatcattatgatgggacgggcaataccttccacacgccgcctgacacacgatcagggtgtgagtgcattgccgccgtctcatctgtcatttggccggtcatagaccgatcgcaggcacacagcacgccgcatttaatgtgacgtggtgcgctcgctccgtccgcattaaatgctaacctcatacgcgtggcggccacgtgatgactgtcgctgggggcggcctcttccctctaagctatgtacccccgggcccatatcaccgatagggcacacgatgaaagattttagctaattagctggacggaaaagagaaatatcaagaaatatgattaacatattattagttgagtattaaatatttaaaaaattaaaaaatatttatttgaatttttaaagtaccttatatatatatatatatatatatatatatatatatatatatatatatatatatatatatatatatatatatatatatatatatatatataacaaatcgtttagtagcctgaaaaacatgttaacgaaaaatgagaagtagctaagcttaaatagcacttttggatggaaggaataccatacaatctgcatcggagtgcactagcaattaattaatggcaatcgtcaagctctttttctcttagaccctgtttatatgggactaaaacttttaagtacttgtcacatcggatgtttggacattaattataaatattaaacgtagactattaataaaacccatccataatcttggactaattcatgagacgaatctattgagcctaattaatccatgattagtctatatgatgttacataaacattctctaattatggattaaataagcttaaaaaatttgtctcgcaaattagctttcatttatgtaattagttttgtaagtagtctatatttaatactctaaattagtgtctaaatatagagactaaagttaaatccctagatacaaacaccaccttactatgatggctcgtcacaaacacgcctctcaagctcttaaacgatgcatttttttttataaaagttttctactacctcggttttgaaatatatattcattaatttcacctaattcattaattaatggcaatcgtcaatctacaaattaatttttgtgtgtgttttacaattctgtgatcatatatattcataccaaatatttgtatttttttctgttaatgagtttttgtcaatcctgcgttacgggtggacgtaaacattttactgtgtccgtccttttacttccagcataaaaaaaaacatcaaccttactgcggagcactaaaaaacgtacttaacctgggtgactacacagttgcatcgcataacagagctatatatatctttattattgggatgaagttcacgcaagctgtagtacttaacctgcaactacatcgttcacactggttacccagtagtatcaatacgatgacatatgctgcgtggttcgatgccgatcactgtagcaaacctgcacggcaatgggcagattctgaagaatggattctagcgttcagagtttcacgccttgcctgagccacctgcgcccttcagtacctcgtaaaccgctgagaaatccaggtcccctagtcccaagcttcttgctttcttgaacgcctgcgattcagcaaaccacagtgatgagttcaagcaatcagttgctgtgttttcagctttcacaggttgcggtgaaaagggggaagaaaggcgtcgcacctcgttggaagcagctgccactggcatggagacagcgttctcgtctcctagggcaagtgccaacctcatatccttctgctggtgtttcaggggaaatgcagggttgtagctgccttgcagcatcgagggccctttcagcttgaacattggattcgcgatggcgccaaggtcctgaaagacaatgatttactcggtgttatttgatgctcaattgtgaaggaggtggctccggtagaatgaaattaaccatgtgccataccaggacatcaagaagtgtctgggggctcaaaccactgttatcagccagagagagtccctcagacaaagcattcatcatactgcagtaagaaacaacattacttgtattttatgagaggaaaaaacggcagtaaatgaatgacagtccagaaagatacaggagatatgtgcatgtgctaacaatagggagcttgcattcatcatactgcagcagatgtttataaataattaatagatagtcaccttcccatgatcatgttgaccaccagtttcatctttgctccatttccaatctctcccaaaaagaacgactttttcccaagtacatcaaatgcagggaccatatcatcatacaatacctgtagcagcagtataattacatcaaatgcggaacagatctatgacatagcactaaagcagtagtgatttgtatcttgctggttaaaattgttgaaaactggcatagtcgacacttgacaggtttaagtatcagattcggatcatcaatccatgtcgtgacttattagatgctaacatctaaaccaaatccagcctatataagctgagtatttctttggacttcaggcaaatgctgcaaaacaataataatatacaccgacacattttgtcgtttgcagaaaaaagataaaattgccacagtggtagacccatatataaactaaaagccattatgggcactataaattttgtaaatataatcacaaaaggtttatgatcattaggccataatcatcaaaagaactcaaccggatgcatcacttataccaaaaactaacaagcagaggaccaaaatatggtacaatcatttatacctagaaaaagaaagactgtttttgcgaagtgtcaccgataccactagtttacagtagtaattgcaaacaatcatcatagcatatggaattaccttgtcccctgcagcaagaatgaccaattggccatcttcagctggctttttgcttcctgaaactggagcttcaacaaaagccccacctttttgttttatagcctgcaaacatgtatttaagggaaatcgattataaacataccttggtagttatagagcacactcaattcggtcatgctgatgaaaacaaatataaataaaagacaccaccacagcaatccagtggaattaaaaatgtgctgaacttccatgctatgatgctaatgctttcttttggctgtttgcttgatgttgaaaactcagaaatatgcaaatatgttgacttgatcagttgatactgtcaacagtactgaattagtctcaaacttactgcacaagcacatactagttcaatggtcacatatgtgcggtatgctggagtccttatgtcataatcatgtgaggttctgattgaatggaaatctatgatgaagtggcatatctataaatgtgccgtgttatactcatactaccatgcatgtagtcatcagacaaaacataaaaggcacaatacatgagcggttgaccaccattcagaatgttatgccactattactggtggatttttatacatcggtgaataagattggatcatactgtgaccacaagtgcattaatgcagaaaaaaaaaagcaaatagcatgcataaacaaaatggaattgtgttcataaacaaaatcacctcttatgatatgcggtgatgcattaacgatttccaatatttaaagtagggctttccttactatttaaacaaataaaaaaaatcaaagcgccgaatgtttagcaaattaaattagctgttgagtatgtaaagtttgaactttaatattaacctgacaatctacaatactccttgatagatgttgacccttgttaggttattaattgtgaactacaagtatgcagtctagtactgggttccatgttatcttagtgaggtcaccggtagtattttaaaaatattgccgacagttttgtatgggaatggcttctttgctctaccaagatgagaaggctgaatgttaaaaatggcctcatttgcacatactcaggagcccattattcaccaagtggccatgctgtgttatgattcatgcaatactgttttctggggagcaagaaagtggctcaatttgttcatatttggtgacataaatcaaaccctggtagccaattgcatacagacggccaaagagatagatatgatatttggcttgtcattattcttccttctttctaactgcaaacgattaaaaatatgttctcttcctccatcgtccacttctgttaagtattcacatgttttcatggaatattccctcggattacgatataattcattctgtgcttggcagtgtaactaggatgaggtatacaaaataacttgttgccattcaatcaaggggacaaaatggctctcattaatgagaatggcagcattaaattagtaaggacataagaaaacacgaaaatgcctacaaggctagaagctctgcgcttttgcaatgatttatagtagagaataattgtctgttttagaacaacttacaaaagcaaaacgagtgagcactacagaaggtattgtcgtacatgatgtggcaagatagtgaaaaaaaagggaaatgccaacctcttaggtccatatctacacacaggaatacatggatgcaagacaaattgtcatggtggtgttcagttgaatatctttgcaaaccaggatggaaactgtacactaacagggtcatcgatatcaaggaatatgcttgcgagcaacatatattgcaggatctaataatgtgaaattaggtaaggtactcagacagtcaaacttgcaggattgtgaagatgtaactggccaatcgcactcaagaaattgcacggaggcaacaagaaccaccaaactaattactaatacacgattaataactcatcactcatacatacatgaattgaaataaaaataatgggggcagggcaaggcaaagccatcagggaggagaaatgtgtacctcgcttatcttgcaagaagtggcggcatcaacagtggacatgtccacataacccttcccttccccaatctgctcgagcacgccgtccttgtcgaatacaacctagatgaatttagcccccaaaaaaaaacaaaaaaaaatcagggaggacgccatcttgcaaacactaaggaagcaggggctagggcttaacagatagcgcggcgctggggtcggagagcatggcgatggtgtatctgcacttggcgacgacggccgccggcgtctcccccacggcggcgcccagcgcgacgagctcctggcactgcgcactcaaacacgcgtcagggacatcggattactcgaataaactcatcaccaatctgcggaggaggaaggatggatggaaagaaaaccttggagagagtccggttccagacggtgacgcggaagccgtggcggaggaggttggccgccattgccttccccatgatgcccagccccaggaaccccacctccatcgcccgcgcgcagctacctcctccctcctcgccttcgtcttcctcctctcgcctccacacacgcacgctgcacacttgtgttcttctcccccagtgttcttcctctctccaccaatctctcgattttctttatattttctccatggttttatttattttattgcgttttatttccacctttttgtcgcttctcttttgggtggaccggatgcatggaccaggagatctgggagccgtcggtggaggtgatggatggacaggatgcgtccacgcgtcggcgtcagatgatgggccgacgtgggccggcgcatcgcatccaaattaatcagccggccgcatcggctccggggcggcggaacaccacgcagcggatgaggggagatgtgtggccagtgggggtgtgacacgtgtgcacgctgggtaggttaacctcgtcgtgggctgacctaatatatgtggcccaaatacctcctcttgaactgtggcccatggctcttgtatcaactggaagcaggagaattgaactgcactgcactccatcaaatttgggtttttttttctttcctttttcagaagatcaaattcctgagttctaaaaaagatagttcgtatttcgtaatgggcttttatcagacggcaaccaggatctacattacccctttttagggcatttgaaccacggtaccgtagtaaacgatagaaaaaccagacaaaattttaccaaatttaaaatttttattcagatttatttaagcttggtgaagtttatcaggcccttactattatcgcaccctgatgataagctcaataatcggcagtaggaaaaacccatagttgagagatgcaaatggaatttctctgtttcaagaagaccgcgatacaagaaagataggaaacttattctcatagaagcttctgctatatgttgggctctatggttgagtaggaatgatatgatttttgacaaatcaccatctgtttcatatatgcaggtaactttcagggcaacacattggctcaggtcttggacattgctacaaaagtgtgatgaagagggcgagcgtttaaaagttgcatgtcgtaatcttgaggcaacgattatgcaaatgtttaccaattttggatggggattcacaaacagaattcaataattgtgtactccttatcctcggttggtaggtgtcttttttttgtgtgagaaactttttattttgtgtgctgctctgtaataattggctgtagctcgttgagcaaagatcgggatattctattccattatctaagaaaagaagaccgcgatagttcataccgtgatggttcgtcgtggactttaatcagacagcagccaagtttacgggcatgtttggatctctaccctaccaatttatcaataatactaaaatctaggcaaactttgatactgccaataaatgggtaaagtagagttatttagctcatgtttggattgggaccaatataaagccaaaatttgatattgtagtgaagaaactacttgaatttagccaaataaaacatgggtgctacctattggttggccttaatccaaactagcacatttactatttagattgccaaaaatattggtaagacacattttggtatcaatccaaattccaaaatggtcctagtagttttatgccagtaagcccggtaacaatggttatcacagtaaacagtaggaaaccagataaaatttactaaaattagaattttcgtttagattttattcaaacttagtagttctgaaatttataacaacaccgtgacttcaacactatacaattactaaaatgaaagttttgtgagaagtgcttctatgctccttgaaaaaaacctgcacggaaattaaagcacatcaatggttcggatcaaaaggtgattactagggtaaaccgtcattaccaaggggcaatttcgaccaggaagtgaaagcccacatccagcccaggccgatcgatccatcgatctgggaggtcgacacggcaacagggctagatggtgaagatcaccagatcagccgggcatgtgcgaggaatgggagggcgacgagctgtgagggctattgtcgacttgtcgtcgttgcgctcggcgttgagacagattatacagtatgatgagatataggaccagttctcgaagggcagtgtggtgtggaagcggcagaccagatggagaatggccgcatcctctacggcggcggccatccatgatgactcaaactcctgcatggtagaatacccgcttcttgtacctagtgaaacctagatagaaatcccaacgattctcctgttttttgattcagtgattttcgtcctttacaaaagctaatccttttggccgcttgacatagatgatgcagatcttatctgaatatcattccaggtgcgtcgcgagggaattgccgtcgcgaatcgatcgatgagagacggctgggtacggggtgggtatggatatgaacttttgcttccgggacgaaattgcccctcgctaatgaggtttaccctgttaatcgctttttaatccagaccattgatgtgctttaatttttgtgcaggtttttttattgaggagcatagaagcacttctcaagttttgttcttttgaaagaatagattttcttattgattcctcacttttctgtagtttttcctatacgagtaattccattccaatgatttcaccggtgacctattcagttggggctttatttatctgtgcaacccttcgacaaagaaagatattctgaaattagataactggttgtaagagaaaccctaatgacaactagctcaaaagagctatatgcaacagcaatataggttttgctctacacccaatttacatatgtaacactgcatcaatcaaaaccatgtaaaacgaactgctccgaaagtggagctagcggcgccattgagtcaagactgcaaaaagccctttctagtttccattaactttttactgaaatcatgttcacaataattggcagtaacgtacaccaactagggaacttgagcggaaaaccgaccagctcgggaggtggctctaccactgatctgaactactccgaaaatactcttcttccgcagttcatcaacacgcaataattccgatccgaacggttgatggtttacacgtacatcgaactcttgtagcttggtaccacgtgctagttgatctctaacaacgacgtgcatttctgaatccttgttctgaatttctgatctctgaccccggaagtttggtacccatgcaccttcttgccatgtttccctaatccactatgccaatgttggtgtggcagttagaacttggaagacagcatctcaaccaacccccacattctctccctcatttttggcacaaacagcatgtgcagcccagctctgtttcctctctgaaaaaaaaatggtgaaggggcatgactgaccatactggtcttcagaatactagtgctgattccccatatgaaacaagaacacagtatatatgagactatcatatagcagctggtatggctattatggattcctcctgtttttagtcagtcaagagtcaattttatactgctgcaatatgcaactggcagggcactagaaatgtgttttttttcaggtgttatgggatagatgcaccctcaccgggtagctctgtatagcttaggttgtttgatcccaacaatcgggtagctgccaacctcggtggttgagaccacgaccaattcaacttgactgttcatttgtttggcattctgatccggaaaccttatcgcttaatatatttcatttttaaaaatatttagggcttgttcggttcaaaggatttttcaaatcataggaatatgaaaaagtaaagaattttcaatccataggaattttttcaagaggttttacctcatgctaagaatcgtatgattctaagactacgatccttactaatttggtaggagctattcctatgaaacgaatgatgcttagagaaaaaaatcatatggtttcgatcgattcctacaataatcctttggaaatcctttgaaccgaactaggcattaggattggacatacttttagtgggattaatctagtctctacaaccaagatgtatctggctacttaaggttggacatatagaaaccatgtgaaaatctactatgaacaatactttttataatgttatattcttttctatgttttcaaatcaatggtatatacaataaaaatgtacaaaccattgattttactagggaaatttgcaaaaatcaccccatgaattataatattatgaaaagtagctatgtccagaatatttaaaaactaatggtcaaatatttaaatgccacatcgatgtccagaatatcatgttttttttaaccaaagtaaacaataaattgcaacgtggtcaagtgatgtggtgatgaactgcactaagttaatcagatagtattcagattgttcacatattggttgaatatgcacctggcttatgaaaattaaaccaggatttatttatcctgctggcatgtcactgttaatgacctggtggaaggcatgcatatacactgcatgcatgaggacgacaacattgatttcgcagacgatgctacaccaaaccatttttcttttcctcattattgaagcagttacctctcgatccaacctttacgtcagttaattacttaagccaacagatcactactagggctactaatcagccaactgggctactggagttgatacacacagcgcctcatcgtttggcatattcatatgtttttcagccaaaatttgaatttctaactttaaatttggagctgattttgaggttttttcatcgaagtttatttttagcctttgcttttagattgctaagaatacatatataaaagtttaattcatatattgattttcgtttgtaaatatgtcatttggcatattcagaaaatatgccaaacgatgaggctggcagacacacagccgatgatgtgtggctaagagcaggtacaataaaccagctagcataaacacatttcgaggagataaaagagaagatagaaaagcagcgaatatagatttatagtcaactgcagcacggactccatataatacgtgcatgacaggtaggaccatgtattaatagtgtagtacttcctccgtactcataaaggaagtcgtttaagaaaagcagcggactatggatttatagtcaactgcagcatggacttcatgtaatatgtgcatgacaggtaggaccatgtattaatagtgtagtacttcctccgtactcataaaggaagtcgtttaagacagcgacacggtctccaaaacacaactttgacttcttgtttctataaaaatatttattgaaaagtgatatatgtatacttttataaaagtattttcaagacaaatctattcatataatttttatattttcaaactaaacaacttgagagttatttatgatttatattccaaggtttgacctaaacattgtcctaaacgactttctttacgagtacggagggagtatatatttatggtaactattgtatgaattggctattaaattgattatagatgatttagagttaatagtttgttatgctattaaacttgctctaaataattaagctgatttagcaattgaattgttctgcatgacgagtagcagaggtgtgtttttgtctcgatgtgttcttcgctagtagcacctgggctctgaccgatcgacgacggcgacgcttcgatcgattccataacgaagcaggtaatgtttctttcgtcgagacgcggtgtaggatcgatttgatcgatgctgatctcttaactaataaggagtttagagatggaaaaaacgtgacaatacagatatagaatcggtcgatctctttctagcaatgcaaactttcaagtctgaaaccagttgcctggagaaaggtgtactgattgactgcttcccagtaaaaatgataaggccggaaataatcacaaagtagctagagcgctttaatttgcctgaccaagctcgagcaacttaattatagcggttaatttggtcaaccaatgtgtgtcagtgtgctcatgagattttgctccaattttgttgacctccgcaactttcgtccaacaaagctttttaagtaactctcctttctaaaaggcgcaattactttcttatatttcatagctaaatgctcatgcttttatacggaaggagggagtaatatgttatcatcttttttctacggatattcgtctttctctatcaatttaggattgatatttattaatattaagagattcaaggggtaacttgcaaaatttacgatgaatgtacgtaaagtggtagattcaccgccaccaccacttcatttttttaaatgagtatatatatacaagacacgtatacgagcatgcaattaagcatcacatccttaattttattttaaactatccacctctaagatttctaatctataatattatatttattaggatgatccaaacaagttgatgataataatagtttttggtttttatgttagcggtagttacgcttatattttgaaatgagggagtcgtgaggtagaatacagacataacttaaagtgccaccttaaaaagtacagcatagattcacatggtgatgtgaatgaaggaaggaaaaaagggcgaatgagctacccctcatacaatagataatatttacacaagctctaacaggggaaaagaaagaagccagtagattgagactaaacaaataaagtaaaattgttgtagtatattgaagcaggtgtaacagaagtagcgtgtgaataaaatta

SEQ ID NO: 69449 - DNA, 635 bp, Oryza sativa
gcagttaacttctaaactgtgatggctattcactaggtagcttcacaacagtacttatttagttttataatgccatgaggtcgggaacttgggattctgttttgcattgtatgataattcttgtgtcatcaaggcatattttattatttgctgctgacattttggctcactgcatcacagggtaagaagagaaaagacaccatctgcattgttcttgctgatgacacctgcgaggagccgaagatcagaatgaacaaggttgtcaggaagaacctgagagtacgacttggtgatgtcgtgtctgttcatcaatgcccagatgtcaaatacggcaagcgtgtgcacatacttccaattgatgatactgttgagggcatcaccggaaacttgtttgatgccttcctgaaacgtaagatttctttatcactgaagtattttgatttttctcttatagaaggttctagatagagaattttagagctttgctgccatgttctaaaacagtattagccatttcatttgaacttgcttgtttgatacttaattatgtcgaggaaagtttttgtggctcctaatttccatgaactgtagtacctatattacgatgtacattataacattaactacattgttgc

SEQ ID NO: 69450 - DNA, 8977 bp, Oryza sativa
aaaaaattttcaaataagacggacggtcaaacgttgaacgtgaatagtgtaaaactgcacttattttgggacggagggagtacttttgtgccgtgtggaaggctgggaaacagttcctggcatcctgtcctgattcctgtgccctgttcgaccgggccccacccccgcaaaccaaaccttgtcttgtctgcgtctggttccaccaagcgcgcgcctcgccggtcgcagtgaggtcctgacgataaacgagattactccatccccatctagcattttctttaaaccgttaaacagtagtgtgttttatagaaaaaaaaatttcatgcataaattatcttaaaatattagatagtaataaaactcaattaattataagttattggtttctggcttccttattactcgtagaaatcggatcatgtaatatagagcaatctatgttagacatctccaacgtcgctacgccactcgcattggacaaaagagaacaagcgcaactgatcgatcaattgacgccttcttggtccacaccaacaaattattaacccacgaaaatgtccgtgggctgattttgttggtgtgagtcgagaaggaacacatcggtatgatgtattggttcgcctccgtccgatgccaaacaagtagagtagcaacgctgagcgtccctctgacgatggctagtttggatcatggactaaattttagtccctgtcacaccagagatttagacactaatttagagtataaaacataaactaattacaaaactagctacaaagatgaaggctaatttgcgagacgaatctattaagtctaattagtctatgatttgataatatagtgctacagtaaatatatgttaatcttaaattaattagacttaatagattcgaatcgcaaattagtctccatccgtgtaattagtttgtaagtagtctatgtttaatactctaaattagtgttaaaatatcttatgtgataggtttagtccctgtatcaaaataccaccatagatactcctacagtatacccctctacagtacatgagtacagtacagtatgtaccagttgtacatggctgcacataatcagacttgaacaaatgctattactgagcgttgagagagattttttttttcttctcatcgttgcaactagtgaagtgtatgcattctgtactagtacatcacactattacgattacgaatttttactgatgaaacaaaattaaaattgggcgcattgcgcatcttttttttcttttttcttttttttttttgccgtgtgcgtgtggtacagctgggctgcgcctgcgcgtgacaagcacgcggctcgcagcggcaaatcctcctctgctacagtctacagagagaggctgaaaggcaaagcgaaccacgtactcagggctaattgcaaggacagggacgggcccactgcagtgcaaacggctcggaggtggtagtggaatccacggcaacttctttccccaatactccgtatacgtactcacgtacagtactgtatgcatgtatatacacgcgcggcgcgcctgagggtattagtagtagagtactgtacgtggtagtagtacagtattatacaagtagtgcccagtgcccaccaccagtagtatactgtacacgtagtagtagctggggttgttggagtcgtcgggtccagttgcagtggtactacaagtttcagagtcgggttcgggttgtttcacgcagagcacaacggatcgatcggaggactataaaagcagatattcttcgtcgtcccctctcaccttcatcccaagtccgcccaaccctcccacccatcacaaccattcccctctcctcaagaaaaaccctatcgatgggtacgccacatcatcctacgctttggatgttcatcgacagcgtcatgcagcggcgtggctcgccgtcgccaccacctgccgcgcagctgagcgggggcgtgcgccgcggagggagctcaccgccgtcggcgacggcctccggatgcaaggggtcgggatcccgatccggggcgaggccttcccggctgtcccgtgaggaggtcgccgtcctctcgtcgccgaggccgaggcgatcccgcccgacagctggggatgacgcggacggctccttcgtcgggtcgaagcaccgcgatgtcaggagggcgtaccccgccaaaaggaagcagcgcgccgcgacgtcctcctcgtcgtcctcgtcgtctcctcctacggctacggagcggctccgcaaccgcgggcgtctcgttccctcgaaccgcgtcgacaaaaagatgcgccgcttcgtgggaacggtgaacaagttcgacgcgctccgccacgacaccgactcccacgacggcgacgacggcgacgacgacgtcgcgcttggcgcggggccgctcgaagccggcgacatcgccgcggcgaggactactccaagcccaccaccatctcacgccttctctaaggcgccaggtgcgcgctccctggagactcgcgcccgatcgcccacactgagtccgaccgcatcgccgtacacccctgtctgctccagggtctcgcgctcgcccgtgcgagggccggcgaccgcgcccgccggtgttcgtcaccaggggttcccaacccagtggcccacgccatctgaatcttcacctcgttcgcatagttcgggcggcggccgtggcggagcaggcgcaggggcaggcggcggccgtggcggagcaggcgcaggcggcggccatggcggagcaggagcaggggcaggcggcgcccgtggcggcgcaggcgcaggcggcggccatggcggagcaggcgcaggggcaggcggcaggcggcggccgtggcggcgcaggcgcaggcggcggccatggcggagcaggcgcaggggcaggcggcgcccgtggcggcgcaggcgcaggcggcggccatggcggagcaggcgcaggggcaggcggcggccgtggcggagcaggcgcaggcgcagggggcggcgcacaagaaccaggcggcggcggcgcacgccgtgtcgtgtatccgtggaacgcccctgtgccacaggcattcccactggcgaggtgctctatctgcggcgctgtagcgctccggtattcgttttgttgtagccgcattctttgcgggacatgcggctgcccatgtgacccacccgccgtcgtcgtcctaccgccgcctgagttctttggatcagtttatctcctagtgattcaccagccagtgagtgggttcccatcgcctccgatgatattcacagcagcttggagccaggtggatgtatggactcactggattacttacgcattctgcccggcgtcgaggcttgtggatggatcacatttggtgccggctaaattctactctatgagaatccaaaacagatggatttcttcgatgcatgtctttgatggatatttgcctaggagcatgattaggggttgatggtctgggttcctgacttcctgctggtttactctagtaatagtacttagttttctcttcctgtaatctgtaatatgtaatgtgaaaacttattatctactaattaagagcttgagcacatggaattgcattgtgttggtttctgcacaattgctgtgtcttcttgcacatttgtaatgtgaacacttattatctcaaaaaaaattgcattgtgttagtttctgcatttctgatagtattattctccaccacaatgctagcgtgagatgctgcagaaattgagcgtccgtgtgttgcatgatgaagaccttgcttctcctttttcctccgtgataattaagaaaaaaagaaagctgccgcagcagcagcatggttgcctggatttttttttaagtacctcaaaatgaatgtgagacgtccatttgattcgatctaatggattagattcaatcctactacacctggtagtagatgtagtataattcgtggaggggtaacgttggaaatgtaatagatggcattgtgatgaatttgcaattggcttaggggtaagttcgtaatctagtccaggggtcaatatgcacaatcggttcacagctgcacggaggcgaggcgagatgctgcagacatgcagtgctgctgtgcgcgacggaggccgccgcacttcacgcgtttggcagtgccgtcaatttgatactgatgatgagatcctgtcaaaggactctgctagtactctcgcaaaaaaaaaaaaaggactctgctagtacacctgtttcaaccgtagcgtcaaggtttagcaacacctgcctggaagtccgaggacctttagtaccgtaccgaaccaaaagtgggatgatccatatcagaatctaagacaaggccggaaggtgatcaaaccgatgaagggttcaagaccgtcgtagccatgctgatgttggtcaatttcttgtcaattgttgtttttgtcggtcaaattgcagattgaaatagctgattaagaagacactaacacagttttagctcatatctgattgtagttatttttgtcagtcaaattgtagattcggatagctgattagaatgacgctaatagagtgagagtgtgcttgcaaccgcgagtcgttgagctttcttttttagccttatttcagttcagtctagaactcagtacttagtccgtcaactcagttctgctgcagataaacgagcttcggtattagctcatttgcctgatgctaatgcgaaaatgactaaattatacatcatcagctaaacatcagtgattcagtaattagttttgcagtatagcaattgagtgattcaagaacacatttcgacaaagcgaccttccctagagcaggccggtacaccatcatatcccaagaatgaagcggtgctgcggtgcacagggccacagggggtggagggatggcgccgtcgtacgtggccgtgggttcacgcgactacgcaaggaggggcggcgggtggcggccgcgcattgaggtgaggggcggcgccgccgtggcagtgggttcgcgcgaaaagaacgggaggcctcgcgaaaggcgaaggcagacgtcgggcgcgcgaggacgggctgcggccgtcgtgcgcaacgaacgggaacgagcgaatcactagccttcgtggaagcacctgaaataacgaaaatacccttccacggtgtagaagtaaaattctaaagtacccatcaggatcaatggttagatttggttcctactacactactaccagctcaagtagagggtactgtaaaataaaatgaccccttgtttgggctttgctaaaagaatagtaccacaccctctctacatgccaatgtaggggatgtttggatggtcacatagactaattataaactcattctataatctagactaattcgtaagacaaatctattttgaacctaattaatccatgattaagctatgtgatattacagtaaacatttacaattaattttattgttagactatatttaatattttaaattagtgtctaaacatctgacctgacatttactaaagtttgatccctgtatatccaaacaccaccgcaatgcatgcatgtttgttcagtgttcacaatcccagtagcatttttttttgtcttcttcttgtgtcgttgctaccttcctttttcatctcagagagagagagagagagagagactatttggatgtttgactgcatgtgcatcattatctgctgcacgtaccgtacgcgatgcagccggtgctccaaggcgccctcgacgctctcgtcgaaggttgacgtcgagagggagatggttgccgtcgcatcgatcgtgcgccatgagcacgacgtgcatgtggatcatggctactatatatacaaactttatacgtatcgtatataaagtttgtacatatatacgtacgtatacaaactttgtatgcgtatgtacgcatataaactttgcatacgtgtgtatataatgtttgcatatatacgtatataaaatttgtatacgtgtatatattacgtggagggtcattaaacttctttaagtgtgtcatgtaggtcactctattttcaaaatgaacatttgagttactaatgtgatataagtgagtcatttacccatctaactatccacacgagtgtgtggatactctgtacaaatttcatgccatgtaggattgaaaaaaaatgccctgagtgtgtttgaaaagccattttatactcttctcactcggctatcatgatttggttgtaccaagaccttaggtccagcttggtaaaccattatgatccagctaatttgtccaataatttgtcaatgacaggtatagggtattttgttttgatagtaaacttttaacttttctatcacatcgtttcaattttttcaaacttctaattttaacgtggaactaaacatagcttaatagtagtattgttaaaaataaaataccaatattgtgagggttccactcgatgtcaacaagaacacaaagcaaatcacaagaatacacaaaacctataggtaacttagatattactaggtgctttaagatatttaattaatattacgcttcaatccgaattgagtccccaccgtaacttaccaccgagttgccatatgatgatcagttgcctgagctctcagattctatatcgatgggaaagtatattcatcctggagggaatatcccctcggttcatgcatgtcatctatgttaaatatgtgatctaaattttaggcttacaatatattcgaattagtttcctactacgactctaagtctttatccactaggactcttagatttctaatgtatcctctgcgtttgtatcaactcctttatagtaatcattgccgatcagcgtctgtattttttcccgcaaggatttttcatgtaaaatttatgtctccgttgtgcatctaatcctattttttcccgaaggatttttcatgtaaaatttgtgtctctgttgtgcatctaatttcataacaagtgtatctgagcctttgagatccatctatcaatcccggccaccggcgtgattccacgatcgaagaaatcgatctcatctgatcggcggcagcaggcgcgtgttcgtcgcgccgtctcgtcaattccgaatttccgagtcatcgccgtcctcctgaccgcgcgaccgcgtgagaaaacgctggagcagcagcgcacgtcacgaaggaaaaagcagcagccgatgcacagccatcgcagaaggaggagcgcaagaaaagtaggagaaaagcaggaggccatctatcgcgcacggttcccaggaagattaggtcaggaagcccaccgttcctgccctgttcatgcgaattactacctctgtcaaaaaaaataagtgcagccatagatatacgtgctcagcgttttgaccatccgtcttatttgaaaaatttataaaaaatattaaaaaaattagtcacacataaaatattattcatattttatcatctaataacaataaaaatactaatcataatcctttttcaaataagacgaacggtcaaacgttagacatgaacagtgctaaaactacacttattttgggacggagggagtaaatttcacgttggtttttgcttcgtgcacacgaagttctaccgggaaatcaagtcctgtgcattgcttgctatggttctatttggtgaatcgcccacacgccagtttaccaggagattttatccggagatccaaatacttctttttatgcatctagagtgtttcacgtttctgctagggttccacaatttataccagcagattcaggattttatttccaaggcgagtttaaaggttgatctaccgctcctgaattgagatgcaatatactcattatggcaagtgaagatgcaagttggtgcatatattgaggatgaaaaggaagtgttgtcgtgcactagtctatcagttgcgcatacatatttcaggacacaagcgaagtcatcgagagggagcctgaagggtcctgtccagatcacgtggaggattacataaattcatgccagcagattcaggattttattcccatggcgagtttgaagtttgtgcatcgatttcgcgtctctgctgggttccacaatgtcataccagcagattcaggatttattcccaatggcgagtttgaagtatggtgtacctcttctggatcaagggtgttatggattatagtccaagtgactatttggcgcacatttattttatcattacgaggttgtttggagattgaagatttttatgctataagggaaattcgtctcaagatgaagattgttaaatatgtgatccgaattttgggcccacaatatattcggattagtttcctagtatgactagtctttatccactaggacttctagatttcttatatatatctcttgtaagccgcacggggagggtgcgacagcccaatgtatccactgcgtttgtaatcaactcctctatagtgatcattgccggtcggcgcccgtggtttcgctgacgtggcgctgacgtggtggtattgaccgggtctcctttacacgtggcgtttaggtggcatttagaattaaaaatatatgtgggacccatttgtcattgacaccgaaaatagattgtgggacccacgtatcccttccctctaccctccctctctctcccacggcgggcagagacggcggcgagtggtggagacggtggtgagccgcggaggcgcggcggtggcgcccaggctgagctccactgcggcgaagacggaggagaccacagcggtggcggcgggaggcacacgcggtggggtacggcgagctcggccgccgccgaccaggtctttgacgctgtaaccggcggacaggagggcaggcgggtgagggcagcggctcatggcagtgggaggacgaggggagccggcggcggtgcgagcggcggctgagggacgggggccggcgggcaggagccgccgccggcggcggcttgtggcagtgggaggacgtggggagccggctgcggga

SEQ ID NO: 69451 - DNA, 7653 bp, Oryza sativa
cgcttgcttttctctccattttcagttctgacttgagctggcgattccaggaaaccgtggctccggccggtcgccgctgctctgggagtcgaggaggcgcatcgcgctggcgtcggcgcgcgggctggagtacatccacgcgacgggctccaaggtggtgcacggcaacatcaagtcgtcgaacgtactcctcagccggtcgtcggtggacgcgcgcgtggcggaccacggcctcgcgcacctcgtcggcccggcgggcgcgccgtccagccgggtggcggggtaccgcgcgccggaggtggtggcggacccgtggcggctgtcgcagaaggccgacgtgtacagcttcggcgtgctgctcctggagctgctcaccgggaaggcccccacgcacgccgtgctgcacgacgacgagggcgtggacctgccgcggtgggcgcgctccgtcgtgcgggaggagtggacgtccgaggtgttcgacacggagctcctcaggcaccccggcgccgaggacgagatggtggagatgctgcggctggcgatggactgcaccgtgaccgtgccggaccagcggccggcgatgccggagatcgtcgtgcgcatcgagcagctgggcggcgcgggctccgcgcggaccgcccggagcgtgtcgatggacgacgccgacgaccggccgctcaggcccgccgggtcgacccgcgagagctgaagcgttgatcactcagcatagttgctcgttcggtaactctatgaaaggtcctgaatttttttttccttcatttcattttttttggctgcgtccttgtgtttgtcttaggaaattacttacggtgtgatgttaattctttgaagtttcatgaatttcttgatacttctttcatcggatttcaatcgtccggttagctgcgtgtgtgtgtgtcttgagatgagatgttggtgataggagaagcacactggtgcaatatgtaattaccactacatggttgatgtcactattgacaaatgagaaattactcccccttcgaggttttgactcccgcgcgatttgaacgacatcgtcccagtcgatctcgtttggatcgtgcgggccactcgtgtcgatgtcatcatctagccgctgccgctacatgaaattgccatgcacacacactggagacagtgaaaaaaaaaagctgaaaaaggcgtccttcgcacgcatcctgctcatgctgagctcagtgacagctacagggacacagtacagctctgatctcttttttacacgacttgttccgaacaaccaaaccaataggcgtcgcggtaaaccatgtcgtttaagggcatgtttagatacatttgtaatcgcaaatgacaaaagttttagtgggaaagttttgacattgcaaaagtactagttggtgtttagatgtatgttaaagttttgccattctagcgctaaagtgagagagagaaagagagagggagtggtcccaaagcactttttggcacaatttgctactatggactagcaaatgccaaattgccaacttttgctactagtgtatagatccaaaatggtaaaaatgctataaaatgataaaacttttgccattttgaagtatctaaattgagcctaaatacccctaactaatgtcaatttggtgcgcttccccctttctatattgcaatgtgcgactaggattatagaagagttgtgcgagcaagcaacagcaaagaacatggctacgagttggcagcacatcaagaggcgttgtcccgaagatacgaactgctccaaccaaaacaacgcgttaatgcgccgcgtgccttgctcgtacgtacttgccgagcacaactagtttagccccgagagaatcccaacttttttttaaaagggcaagctagcccgagagaatcctaacctgcccgaacaaaataaagggcgagaagagaggaagatcaatatggttgtggatcatgcaacgccctgcctgtcattagttgtcatcgtgctctttttataaaaggagaggctgatcgatcactcgagccggccggggtcgcttcgcaccgctgcccccactactagagcacgaaggaatgataatcagtgggctattctctgaacaataatgtgtgacgtgaattattggccgccggtccttggaaaacagctcggccagcgatcgagcagcgattcatccatccatccatccaacccatttgcaatccatgtgtgcactgagctgagacacgcctttcggcagcaatagtagctctgctatgagcctgcctgcctcagctctactacactttcatccccacacaaggccccattgttatgtccatttttctgtccggttttgatcgctagatttcaggatttgggcgtgacgctgtaggggtaatggtggtgctaggggaggggatcaggggaggcacatgaagatgaaggcggcgcattgaagagaacactttggttgggagtaaagcaggcaagcgtcgtggtgcgcgttagaattgacgcgatgcgggcctgcccagtgcccacccctgcccgtaccagagagagcagtagagtgcagggcagatcgatcaaccgggcgcttttcgttgcgcccggtccccgggttccggccagttaggtggcccggacgaaaggatcacgtcaggacggacggacggacggacggagaggagaccgctcgatcgtcccgtccggcctcggcagttgcactaattagctcgccgagtgcgtaccaccacatgccgcgccgcgccgcgtcgcctcgctcgcaaccgcttctgcagttgcaacgcgactatgcgagcccccgcatgcgcgttttcgcgttcgctttgcagaatcgcactgcactgcactgcacggtggtgcgcttgcccgcgcttcggccggccaccttgacggcacgcgtgcgagacggcactagctagcgagcgcgtcggtgatccggagaagtagaactgctcccccgatctccatcccacctgcgggaatatgcgccgagttgggtgaaaccgtgaaaggcttgggccttatcagcgagcttgagcccatttataacggccgttctggtccaaatacgagcccattacacggtcttcgaatttcgcacggcccgttctggtcgaaacacaagacggcaagttttctttcttctgctccaaaccaagaaaaagacaatgggccaccacctgtcatacactcggaccggccgcaccttcttctctcccaagaaataaacccctccccacaaaacccactaaaaacacactcctcctcatcagatccacacccatcctccccaccccccaagcggcggcgagaccaaatcccccacttctctctcaatctctctctctgctagggtttatccctccgcgccgccgcccccggaagacgagagagcgccatggccggcggtcccgcggcggtgtcgttcctgaccaacatcgccaaggcggcggcggggctcggcgccgcggcctccctcctgtcggcgtcgctctacaccgtcgacggcggcgagcgcgccgtcatcttcgaccggttccgcggggtgctcccggagaccgtcggcgaggggacccacttcctcgtgccgtggctccagaagcccttcgtcttcgacatccgcacgcgcccccacaacttctcctccaactccggcaccaaggacctgcagatggtcaacctcaccctccgcctcctctcccgccccgacgtcgtgcacctccccaccatcttcacctccctcggcctcgagtacgacgacaaggtgctcccctccatcggcaacgaggtgctcaaggccgtcgtcgcgcagttcaacgccgaccagctcctcaccgagcggccccacgtctcagccctcgtccgcgacgccctcatccgccgcgcccgcgagttcaacatcatcctcgacgacgtcgccatcacccacctctcctacggcatcgagttctcgcaggccgtcgagaagaagcaggtggcgcagcaggaggccgagcgctccaagttcctcgtggccaaggctgagcaggagaggcgcgcggccatcgtgcgcgcggagggagagagtgagtccgcggggctcatttctgagccaccgccgccgctgggacagggctgattgagctgaggaggatcgaggtggccagggagattgctgtcgagctggcccgttctcctaatgttgcatacgttcctgctggggacaatggccggatgctgctcggcctcaacgctgccgggttcggccggtgatccgtcactccaattttacccttttagttgcccaggcatccgctctgtgttacattaaactggaatgatggtatggggaattatgttatctgctacttttggtaatatttagtctggatgtctttgaacggaatgtgctaatctttgtgatccaaataagttctgggtctaagactcatttatgttttatgatttgtctgctgattaagctttatgttgctgttcaatacgcatgctagttatgcttcttcttgtttatggattgttcttatcattgcaggggtgtatctttggttactgatgttgccttgctgaattagcactgccttgacacttgcagggatgattatctagttgccctgtggcatctcgaatagtcatgtaccagttacctgacctttcggtgataatattctttgatttgtggccgcatatgctgttgttcttaagcaaccgtgtcccgtagctcatctaattaacctggagtttgccagtgttacgggagtcaattttggatatggaatggcagtgcatagtcggttgatgctttgatatttgattttagcttcacaatgcgatttaggcatacattgtctaatttggtccattttattgttagagtttatccctaaaatttggtctatatatagctctttgatgcttgtgaagcactgacagattctgatagtatcgatacatgatgaaaatgttggattcatgttgataccatttatattttattatgacatgtaggatcagtgttaagctcttatgtacaatctgattgggattgcgttttgatcttagtattcataagtgttgggtggcgtattatatcactgtagtcccttagtttgtagcctcacgcattatccaggatttttatagttgaagccttgaaggctggtatcctctcaaaaatcttttgctgaatttcatctgcactgctgatgcactttgggattgcttgtctacttggaggccttttagttgaggaatccatgcctgcatttcctgcaatttggtttgtagtttttagttgattttttatttcccctcaagaaaacgtagttgtagccttgaaggcctatcgtggaacttccatcctgaatcttgagatgggttgacagctcttaggcttttgagttgatattaagttcatgtttactctgcatgccccttggtgcaaagttgttcacttgatgagtcccactttgtgattggtggtatgatacatgtgaatttgagctttcttaccatataattgttactgatgcttgtgggagttcttgatctacagtcttacactgctgctggtaatcaaggttttgctctgcctctaggaatcttggttttacccagcttctagaattagtgaattactttgcaaatgcttgttgctgatatatattgctgaaaacctaagcataggttattcatgctctcttggtgccgttgcccggaagttctacgccggtatatgtatctacttctatgtgcctatcttgcttatgctattcgcatgctataagcctatcgtgctctatgctatcctattttgtttgatatgaatggtcttgccttatcatttttttcctttccagcacttgttcttgccaacgccttcctaggggaacttgtatcgcccaaacattttgatacaagtctgttttgtgagtggcatatctgagcaaagtggctgaattctttgccgcaacgctgcgttggatgagtgcttacccggacgcaatgctgcagattacaagagcatgcgtagtctgtagtagtagtagcagctttgacagcaggttgccatgtagaatgaactgtgtggagtttctcctccacccaaccgctgtggtgctttgacaggttgccatggagcgtgaacttctcctgcacccaaccggccaaccgaagccttccatgcatctactgtcggcacggccctcatgtggtaggatgctggacaaaggccggactccgcgcgcgatagtacccatctgaatatctgatgcagctgctgcatgggctatctgaatatctgataaagctagcgcaaccgcggaacgaatagtttgcatccctaagccatagtatcaaaatttttgaaccctaacttgcgaaatcggactaaattagatcctgtggcaatataaatgtgtggtttcattgatctattgcaatataaatgtgtggtcgttctaaacttatacgtggtaaaaacaaaagtgacctcatatgtcctcatcgttctaaacttatactcctacgtggtaaaaacaaaagtgacctcatatgtcctcactctcttcctctattcactctacctctcttccccctttcctcgctctctttcggtatcagtagcatcggttggtgccacggtcgcatttctccatcttttgtgacgactccgccttgcgtcccccgagagtcctatcctggataacaacatcgatcccgacaccgttgtccctgtaaggttgcgatgatgccgcccccatcctcgggagccatatctcgtatggcagtgtcgatccacgacgccgctgtcctagctccgcctcgccgctagtgaggtcgtgacagtgtccctcctggtgaggtcccagctccgcctcgccccttcatccttcttcctatcggcctctccatgtcatcgttgccgttgcagaaagaaaaggggataaagaaagagataagagaggagggcagcacaaccggctcaggatgtgaaattaggacacggtgatggcaccaccacttgagctcgagttccaccattactgccgtggcgcttcgtccccatcccggctgctccatcccttccagcttcccgacacaactaggcggcagtagcgagcccacccctaccaggcacatcctcttcgacctctcctcccccattgccgcatatagccgtggtcccatcctctctagtcgtccactgccaccgcctccttcctgcgaatagctagcgagctcgagctcactgattccctcgccttactcctcttcttcttctccgccgtggaccatcgaagccctcctgttgccaacctcccatcactgctgccgtctcactcggacgagctctctggtgccgcttttccttagcacagcctcgctcccatcgcttgtccttcgcccggcctcgctctcatcaggcatcctcgcgactctcctccacattctgcccgtcctctctactacactcttccccgctgccgctccttgttacccctcttgcgatcaaagctgacagagggagatagagggataagaaggaagatattgtctcactaacatatgtgatatgtatagttttttttccttctggtgccacgtcaaccaaaacctcctacaatatcgtgggatctaat

SEQ ID NO: 69452 - DNA, 21471 bp, Oryza sativa
tcccagattcccacggcggcgaaccacacatctccgtcctctcccacggctgcgaccacccctcctttgctccgacgaccagcggcgcggatctggctgtacagcacgacctcggatcccacggcggcgactccccctcctctctgtcctctccgacgacggcgcaaggcggtgcaccatccctcctctcctcccacccccaccggcacggatcgggaggcggcgtggccggcgagcgccgtccgactcggatcgaggggcgactccctcccccttccggccggtagcgccacccccctccatctatcctcctcgtcggggcggcggctcgacgacggcgaggggagcgttgcttcgcttcggggcacggcctccccaaggcggtttggcccctctcccgcagaagccgagacggaaatagacgcaacagtccgattcggatcggagccggggggaacccggtgctatatatgccccaccaccgtcgaccgccgcagacccagggtcgtcaagtttgaaggcaacatgatgcagcaagacagcaagaggaagaggtccgtgctgccggagacggctacgttggccccgggaagcaagaggaggaggaggaaatctgtaccatcccgtcatgcggccgcgatgctacctgacgagttgctgacggaggtgtgcctgcggttgcccgtcaaatccatccttcgcttccgggctgcctgccgctcctgggacgcaatgctgtcttccgaggaatttggtcaactctacgcagcgagagccgaggagatgtcgtcagctcctaagctgctattcgtctcacctacggcaaatttcaactccaccgcggtgtacaagtgctcaccatcgaagcccaccgatgacctgctgctcacgcttgatgatgttcgcggaaactatgtggaggtgacacccgcaccatgccatggtctctccctcctgtatgatggtattgccccagcttactatgttatgaatgcaaccacacgggcagtcacacggttgccgcctttccgagatgtggcttttgccactgctggtcttgggtgcgatgcccggacgaagaagtacaaggtagtgaggctttttgaagggaacttgcttgagaaggaatttttgaagtgtgagatatacacacttgggggcgatgaaggggatatttggaggcctgccgctggtggagtacctttccggttctacagttttgctcgttctgctatttccaatgcggtgatgaacaaactgcagccacttttcttcaatggatatctgcactggttgatcaacccattgcatcacgttaaactaccaagagcttctattttatcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaaggttgggtcagagttatgaacgagccattgtgtcttttgacattgccgctaagatatttgaagtcatcccttgcccttcaagcattgcaatgtgggaccccagaagtcgctgccatgcatttgtggtggagcttctaggaaagttgtgtgctgttctttcaaattcagttgcagatgagttagatatatggaagtgggatcatggtctatggactagagcatacacaatcaatttaaaattctggccagattactcacttgcaacgaatgttgtagtgcctatggcagttgaccttacagatggaaggattctgctgaatactgggaggaagcttggtttatataatccatttgatcaaacaattgaaaacttgcttgcacttgatcaggtgtcacttgccacacctaaagtgcagcaacagcgcactggaggtcatcttaagtgccacattaccagatgcgaagatgttcctaggaagttttctccgtggaaactatctatggctccatgtgagaactttgctacacctccaagtgcctcatcagggaagaatctgttgtcctccagacaccaatatgtgaaggcactaaatagtgtgagcccaaaggttatgcctgtggttcctatgttgtatgaggagagcctaacttattatccctttgctgcccgagcgagagtgttgtttagttgaagtggtacctttgtcaaatctaccatttcatgtgtcagataggtcctccatgtttggccataccatgtcaccaagtttttataatgtaatattttgatgtttatgtcacgtagctgtcagaattatagttgtgttgcataatttatttgacttgtatttcaagcacaacttcttttgtagctttcagatcttaagcagaagggtgatgggtttgaaagcgcaactacggactcaaatgaatgttctttccttttcttttcccaatttctcacttatgtggcaacttttttctacactgatctagatcctctgactttgggttgtaaagtcacagacgtacagttctgctctatccgccgttcgttatcatccgacgatccaaaatcgtccttccaattcctttcttcttcctctgtttccttggccctgtttctgtgtagcttcacggctggccgccatggctgtcactcttggccaacaaagcacgcaatttctgccgctcaaaaggtgtaggcatgttgaaaattttcttttaaggctacagcttctgtcttaggcagattgctgttgcaacaagaaaaattgtatcccattattgttgaagcttctccctttgcacgatcttacccagggtataagaccaccgaatttgaacatcactttctcccgtatgggcatttattccatttgatggactctcatcggtacttcctccgtttcacaatataagttattctagcatttctcatattcatattgatgttaatgaatctaaataaatatatatgtctagattcattaacatcaatataaatgtgggaaatactagaatgacttagattgtgaaacggtgggaatacttaacaagctgacattttgacgacgcacctggtatcgtctccccatgtcatcagcaaactctactcgcgtggacggctatcgttccgtggatatgagatggatgatctctgttcacgcagtcacaccgctcgattcggaggccaataaggtggaggccggtgtagggacgtgggtcacgaggccgaaagattgccctgcagcgagcccctttccgttttctgcatcggccatgatgcgattgaagtttgctgcaagccgacaatggcagccggccatgaagctatgcaacgaagggagcaaggaacggaggaagaagaaagattttagaagaatgataatggacaacggagaggatccgctttctctctgtttctcctagattcctagttcctcgtttgctactactccctccatttcattatattattaaatcacttttttaagtaaaattttaatttaacttagaaaagtttaactaagtttatagaaaaatatagcaaagtttttaactcaaaagaaatatattattagaatatacttaatgttatatttaatgaaactagtttggtagtgtagatgttgttaaatttttcataaacttatcaaagccaaaagaaatttaattagaaaaaaaattaaaacgacttataatataaaatagagggactagcttttagttgcatgtatattacttttcatgtggtcacaaagttctcaaatttgtttccacgaatttgtgtgattcagtcgctaacgaaataatgtttgcagtagtgaagattaagattcgatacgcctgtctgctcactttatgcgaaaatcagggggatatgaagcaactcaaacgtacgacaatcgatttttaaaattcatatatgaactagtggtgcttcaatatctctactatctttacctatcttatcttaataataataataataataataatatataactaactaaaaaattactattttccaatagtcacatctttgcttcgttcgtcattgctttaggacgtgtcgtcgactcgtcgttcgtatcgctcacggaatccgatgtgctttgtgtatgtgtagcctgattctaccagactagtgtgtctccaagtttccagggtccaaagacttgtgttatctccaagctagtaagaaatatactactccccccgctcataatataaggattttaagtttttatttatattgtttgatcactcgtcttatttaaaatatttgtgtaaatataaaaatgaaaagttgtacttaaagtactttggataataaagtaagtcacaagaaaataaataataactccaaaattttttaaataagatgagtgatcaaacagtgcaagtaaaaactcaaaatcccttatattatgggatggagggagtactaatgtattctaccaaacttccgtacgtgagtatgtctccaaagtccaaagactaccacgtaagaaatctaatgtaatcaatcaaacagaaatattagtaattgatcacggtcttaatccgattttgtttccaagattcctacttttaatttttatatacactactacaaaatcgatttttcatacagccaaactccatttttgcaagcggttgggaagcctgcatgaaagaaaagaaaggtatgcaaaaatcggatttttcatatgagtagagcaatcacatgcgaaaatccgattttcgcatatggacgcttaagttatctgaccatgaaaatgaaaaatcacaaaaataaattctgaaaatcgattccccaaaccctaaacctaaaacactcatcgtcgtcgtcctcatcatcgccgtcgtcgttgtgcgcgtggggagcaacatccgcgctggagagggaggggcaccggatccacccctcccatcgttgccgctgccgccaccgtcgctggagcccgagccctcatccaccgccatccaagtctgagcccttccctgccgtcccccgtcggatcgtccaccaccgaaccccacgttgagctccccatcaatggatccacacccgtcgccctccccaccgccagcctcttccacccttccacccacatgccacagtcatcgtcgttgctaccgttaccgagccccaagccgccagatttgccgttattgagctccctgtcaccagatccgcaccttccggcattcccaccgctggcctctcccacccttccacctgcatgccgccgtttttgtcatcgatgttgtcgtcgagcatcacaccgccgagttccctatcgtaggatccacacctacggccctccctaccacggccattcccacctgtcgctcctgctctcatatactataagatttttagcaacaaaattatatccatatgaaagtaaatttaaatgccaatctaatggtatattttttaacaaataaattttatttcatattgtactaaatgttggttaaatgttgaatcttgaaatacgcgcgcgtcttatattatgggatggagggaatagtagttaacaacacattgaaataaaaaatgttgacaacaaaattagaacaatcgaattaaatatagtgacatcaattcaaaaatcaggcatcatataaataaacaacccccaaaaaaaaccacataagtaagagaaattttttttaaaaaaatacagatccaccgctgacctacgccttctttgagaaaggaggaaatggcacgggcgcctacaaaaggaggaggtagtgcccacgagcatcaggagtggaggctggagtagggaaggagacgacatcattgtcactggcttggagtagtagcggcggctggtggtggacgttgcagccctgttgttggcactggagtagaggaggcatcgagtggcggctggctacgacgcggccccgctgcggcggtgggtattgggcgccaacacgaacgatgacctcaaaaaagcaagacatgggagcgccacatcaaccaagaggtgtggatgggatgagagtggtagctacatgtttgacttgtcacttcgtgtggcctccatggtagtctagggtttacttcgcacccgggcctattgggctagatgaattagggtgtgtttagatcctaaaaacttttagctaaaaatatcacatcaaatatttagacacatgcatggagcattaaatatgaacgagaaaaaccaattatacagtttgcatgtaaattacgagatgaatcttttgagtctaattgcgccatgatttgataatgtgatgctacagtaaacatttgctaataacggattaattatgcttaataaatttgtctcgcagtttacagacagaatctataatttattttgttattagtctacgtttaatatttcaaatatttatccatacatataaaaaaaatttggccaagaactaaacacggccttaatgcttcttgttcttcgttgtgtccagtcatgactgcattaactaccattaattcatctacacaatttaaatatgactattaataaaaatacattgattatcaataataaaaccacttcggtagaaatataagtcggtattgagctcaacgtagctgtcgtgccaattgaaataatatgatatttcttgtatatgtataattaaatttttatttatccgatgcaatgtgcgggaatttagctagtctatttcctttcgtcacatggctctcttcggggctatttggatgacttccatagcttaccacaaaatatttggcaaagtgtggcatgccacacattatatgactaaaaatttgttggccacaattatgacaagctatggcaaaaaaaccacccaatgacaagtgggtcagcttgctaaaaaattatggcataactcacttgtggcatgaactaaatactagacttaattggtcaaacttaattgccacaactttagcaaatgttggtacccaactaaacagccctttcgtccggtgtccgatcgagtgtcccacttgtgcacgcgcccaccgcccacgcgtcagattgggagaacgttatggccgggcgcgcacaggaggccatgtctccagagcacagacccacgtagagcgattcgagattacggcgtacccgtgcagaagtaggaaggaaacgcgggatcgcatctgcgtcagttcagaccggtcacaaaccacagctttgctacccttgaatcaaacacgccaataaaatctccctgccttgcacgtatatctggaaaactcaattggatatcccctcatttttatacgtcgcttaaaaaatcataaaaacaatttgaaaacaattagtatgataaattaatatgtgatatgtcactttacaaacatgcaaattcaaattccacttatataagtagaaacaaaaacaataaattttactttgaatagaacacgtaattcacggtcaaatttgtttttttttcaaattgtgtaagttgaattttaattcgcatgtttgcaaaaaagatatatcatatattgttctattttgatattttttttaattttttttgataactttttgaacaacagagacacagcaacgaggggatgccctcctcgagggaaaaaaaatccacttccgatatatcggcctcctgggacaagattcttggagcatctccaggctcaagtgccaccctcgcagcgcgtacttctctttcccctccggtgctttgatcagcagctgccgtagcgccagtgtgccagcagcaaatcgcggcagcccggcccggtcggtcgtgcctcgtgaagttccctgctcttcaccatgccgccatgccggcagtgtttgagtcgagtcgaacctcggggacggaatactccagctcagagccctgcgtcgccccgcactagccgtcgcctcagcccgtcaacagtttgagctcgagcctcgaggctgtacccatggcgtctccgagactgggttgggggtggtgatcgaggtgagcagcgacgccgacgcaggggatcgggcgtgcaaacatggccgggtcggtggaagcctcggcctgcgatgtgaaggctaacgatgacatggtgtacagtggagggacactggaaggccaatgagcagaagcagaaagacgaggacacgaaagatcagaagcgagcgcatgttcttgaggttactcttgttaggtcagaccgtcagataaaaaatgtgttcttgattgtgtcgtggtttagatcgttgtttggattgtttgatagtacccaaccatagttggtgattcatatatattatatataccataggaaaacaaaacacatgaatgcacaagtataaaacagaagattagaaaatatgggaaactttatgtagatgagttgtttggaatacaagaattttatttaaactaacaagacaataagtttcagtttatggttttataaacttattgacctcattttccctttactttaatttgttttcctttcatttgtttggtactagaatataatagaatacagaaacacaggagttgttttcaaaggaattcgagggtccattcctttcttttgttttgtactagaatactaatagaatacagaaacatagaagttgcttccaaagaaattctagggtccattcctccattccgaacagccttataggaaaaaaaaaatatactatggtcctcagttctattgatttttctttggaaatcctccatcccaaacatgcccttaattattgatctgaaaatgttttgtcattgttttctttcctagctgtttcctcgatcaaattatttgatgtttattttgattttaaattttccccgttgcattgcatggacatcctttctagtatctctatctctatttttttaatctttacctattatataaaatttcaaggtgtttttgcctataaatttcgtacgtcgcccaactcattgcccacatataagcatatttttctgtccgatttcctttttcaccgcgcgtgtgtacgtcgtacctgttattttttcttcgtccgattctcttcccacgatttccaaatcgcgtggcgtctaggcccatgtcggcccttgtccagatccctcacaaaacctacgagtccgccgtctcctcgcttgcccgcctcatcggagcctccgtagaaaacaaattagagacctgttgaaacctctggattgtcgacgtgtggataaataactcttccaacggcttcccgatcggctccaggcgaacgtgttgttccgcttgaaccctgcctccctcgtcttgctcagctcctactctcctagggctcggagaagcgattccactctgcctgcgcttggttcgtcgcgttgcggctgatggagtgatggtgaacgagggttctattcactttgatgtcattttaaacaatactatttttttaagtaaatttgacaagaatatacatatgtttagtttcttaccaaattttggaaaatataccagaaatttggtaactacacagtaatgaccaaaatttagtagcatgtacgttggcaacaaagtaagcacatccaaaatagctatcttaccaaaatttgataatattgccaaccttactaaaattttggtattgccagaaattgataaggtttaaaatgacattaaagtgaacagggccgagaaggcggtgatgaagctcgccacccgccgttttcttcttcccaagactcaccagctgtcgatgctgatctagatactagcttcgtgaggttaattaatccattcaccgtcgtgggccgaccgagtctcccataacacgaattaagtttgcggcagcacccagcattccagcatgcactgcagagaatcagtcttagaggcaaaatgaatggcaaatagaaccaggagcacggcagccgctgataccctcatctctggtcgccatgaagcgtcattgatgctcttagcctcttaccatgcatgctcgtcctcggtggccagccacttgccgagccttccgatctcctccaccctcctccagtactgctctgcggatgttctatttagttcacatcaaaattaaaagtttgattgaaattggaatgttgtgatggaaagattagaaatttgtgtgtatagtaaagtttcgatgtgatgaaaaagttgtaagtttgaaaaaaaagttaggaactaaggatacattagtcccaggactaggactaaagtttagccccaagactaaaacattagtcctttttagtcatagcctgtttggttgaagggactaaatagtactaaaatggtagcccgcaccagatcctccatggcctgaggcagctagcgtggggtagcggcgtgagcttgcgcacggcggcggaggcggcggctgcgggagctcgcgcgcgacggcgtcggtgggagctcgagcgcgacggaggcggcaggccgcgtgagctcgcggcttaggtggcaggccgcgtgagctcgcggcgtcggcggcggccgcgggagctcgcgcgcggcggcgttggcagcggcgtgagcttgcgccttgcgccggatggggagagcggagtagtcgagtagtacaggagagagaatgaagtgagagagagagagagtgaagtgagagcgagagcaacaggatagggttgggatcgcttttctataggtttttagcctatgctgttttagtctgtttaagtccctcccgtttggtagtttagaggctaaaagggacttatcataagtccctccaaccaaacaccacctgatccaggcctagttgccgctgccgcatcctcctgtcccggccaccacaggtgcgtcatccacctttccgggcgcagctagcgaaggtgcgcgtggtggggtagagggagaggtaataggttatgagagagcgaagtatttggtagtggggcggcgctggctgcttgtcataatgtcatggcctgacactaggatcttgtcgatcggtgtggttcagtttgctgtaagagcaggtacaatagcgctattagccagctataaacatattttaataagataaatgataaaagcaagtataatagtaggttataagtcagctataaatatatttaatgagataaatgataagagcaagtataatagtaggctataagcttacgtggaggaaagagaatttgaaaaatgaagagggttgactctcatgcaagagctatctattcacatacttcaagataaatacattaaatgtatatgtgagagatagagagaggaggagaaaaaaaagataaccttacagctcatttactatacatgttaactctaatataagctataagctcatagttggctctattattaaacttactctaagagcacccgcaatgataaagtaaggtgctctctataaaacatgtacatctcagcaatagactagattaatagtaaaccacctcaatagtatgtctacatgggtatctatagctctctaatgcattgcctcgtttttctctatagactatctccaggttagtagatagctttgtgctctctctctctctctctcttcatttaatctcttccaagtaggaaaatatgctgacatggatatcttgtagagagcctatagataaccattgcgggtgccctaagagagaagagcagcgggctacagatctgtagccagctgcagcacggactctaagacacactgtgtgtatgataggtgggaccatatattaatagtttagtaagcaaccattgtatgatttggctattaaagcaagtttaatagtatagccaactactagctccaattcatatatagccaatctagtagctcatttatacaatagttacatactccctccatttcataatataaggcacgaccactttttttcagatattccataatataaggcatgcatgcatataggccattaactatgaccctttcttcattaaattattacttttttaaatcctccactcttatgttctctaattctattggatgcatgcattgtatttattaggatgattaactacaagatgataataattattttcttggtctttgggttagagttggttatgccttatattttggaatggagggagtactaaactattaatacctggtaccacatgtcatacacacactgcgtcttggagtccgtgctacagcttgtaaatctgtaggccgctgctcttctctctcctcatttatctccttaaaatatatttgcagttgacttgtctgctattgtatctgctcttagattttctatgatgacgctctctctcgtggcccgatcttctggtgaggggataactcttgctttgatcgagtgtgacgtttgcgacgtggctaccaaccagaacaagtccaggatgccgtgcaatcgctacaccacaaacgatgtcgtaccaaccgtgacgcgcggttgatgatccctgcaatgcaaacgagagaacactgcaagaacaagataagatgcaatctaaatattgcgaataggtaattaagcacaaaggaatagttgcgattgaggtggctctgaatcaacacaccaactattgggggctctgaatctatagtcgtcgactaatcgagcgaggactagagacaaggtgaatggcacttggcaaaattcaactaaacaaaacccaattgtttttgacgatgtacaaagctatttataggggaaaataaagctagggttaagtgctaattcatggaggtggagggagacacttccgagatgggcctagtctattacaaggcccaaggcctaagttcggtttcaacaacagcactgtcttattttggcaattcccgttgactcgagatgaatttggacatgacaccggatgcatttgaaaggtagcgagataaactttctatgaagtccaagaccacctaaatcggagttggcatgaaggcgctaggtccgtttgaagtaagtgctgtctccggaggatttgtttaatctgtttgtgcataatttttgttagttacagaccggtaggtgctatatgtatgtgtggatggatggatccaagctagcaagcaagccatttgacggaattgttgtgaaaaatactttcaccggtggacatctgattctggaacatcagaaaggcattattcccagtgtttagagtttagacctggtaattcgtttgagctgaattttcattttttttccctatacaaacattagtattgtacccgtgctttgctttgcaatctcaaaactcaaatatataatatatacaactattctgagttaaaaaaataactataatctactctaaattaggtcagaaggtattagtttgtgactagggttgtgtttagttccacaccaaaattaaaagtttgaagaagttgaaacgatgtggtggaaaagctggaagtttgtgtgtgtaggaaagttcgatgtgacggaaaagttagaagtttaaagaaaaaagatggaatctaaacagggcctaaattatagtgactgcaaacacacgcatggcctaaaatttgtgacgccatggtgatgcctgtttctggacgtgatgcaagaatgcgtggaaatcgaagttgatgaaaaaaccattgttgtggaagacggaatatgcttttcggacgaaaagggtaccgttcactgattaatcataatacaagattaataagaactatgtggaaattttatgttggcaaatatgacgttgccaagtacgtactttggacatttaaatggttacaacaatataaattgaatatattaatgttatcttttaattgaatacttataattaacatcaacttaaaatatagtttccaacagtcaattcaaacagcaaacaatggtatgtttggttatattcaataagtaaaacataacagaatataagaaatactaaacaaagtccaaaaacaactttggatcgtcatcaaatacacatgccacgaacaattaaacggaagatggtggattaattgctaaaattaaaattttaatgttcatgaaaaataaatgttgagcgtaccacgataataaacggttttgttactgcggacatatatatgtacatccgtttaatcggtcagtacgactgttctccacaaccctgccaaaaatatgtgctattcttcctaagattcgcatggactcgtaccactcttttaagttcctatcacatcgaatgtttggacactaattataaatattaaacatagagtattaataaaacccatctataattttagactgattcgcgagacgaatctatcgagcctaattaagccatgattagcctatgtgatgctacagtaaacattctctaattttggattaattaggcttaaaaaatttgtttcgcaaattagtttttatttatgtaattagttttgtaagtagtttatatttaatattctaaattagtgtctaaatacagagattaaaggtaagtccatagatccaaacaccacctcacactgtcacacaactactcaattaattttaacagctgcagctagaggcgacaagtgagggccctggcaggattcggtagaagtctgccaaagagaaatcagtggctcatgaaaagagagattgaagcagagctaagctagggcagttggtgtgaagtgagataaattaatccaatcatccctttaagatcaaaaggaacacgcgatttctcattgttcggcgaattattgttgggaaatggttatcagcggttttcaacctctctttctcacagcatgaacaaaacaacttaatagagcagaaaacccatacacaaatctatattcattttaaagactataattatgatggtgaatctaccatcacccgccacagatatagtatcatcgtccttcattcactttcacactgaccaatcaattgccacacctagctctttcacctagctcccgacgccctgatccgtgcagcttggaagatccaccgcgatgctgggaacataccaggacttgtcattgtcgatctgcgccattgcttgctactccatcaccatgggaaaatccacccatcaccctaggcagatctgccatcgaggctgcgctagagagcttgtcgatgtgccgcctcgatctacaccatgttgtctcaatgtgcacctatgctgccttgatccacaccatttggaggtccaccggtctacggtgccctgattctcactacccatagctctgtcggcccctatcacgctgatcagtgaggaggggagctcgagaccaccaccgtgaatgtctccgagtatgagcgccccacacgactagctagagtagcttctcttgctcgttcttggtggcgccgccagagagagggtgtttggagagaatttaaattcaaatctctccgcccagggaagtaaaataaaataatatgtgcggacgtgccagtgtactaagtaaaaaaaataaaatggacgaaggaaaatgcattttattataattctcaaagaattacaaaaaatacaaaatccttagtcaaatgcgctccatagcctataggcaaggtggatctgacttggcgattatgtggtcctagttttcggggtctcggaaaacacccggttagttactctcacgggttgaacccgcgagacacctccgattaagctgtgctagtcgtcgtcatcgatattagcttcatgttctcccatgcaaggtgcggatgtggtgagggtgtaagtgggcgccggcagtgttcgcggccttgtcggtccacgcgccattgtcggtgacgtcgtctcgatgtaaactccgcccacccatccatccaaccttgtcggtcatgatggcgttaacaccggtgatgccgccgaacacgtcagtggcagccgtgaaaagactatcggtaatgatgccggtggtagtgccgaactcgagagcatgaagaagtcatcagtatgtgtatgaatattgctaggagcaacaaagacaccagtggagatgccaagcttgtggtcactggcagttggggtagcatcgcccttctagtttccacggcaatggccgaccatcgtcatggtacaatggtcagtcgtctgatcactgcagtaaacacttagtattgagtagttttaggggatgttaggggcgtagcctagcctggaaacgatgagatgcgttccaggagtggggtggccctcttgtatatgcgccgacaatcggggccggactcaaatgatgttgagccacctccgatcgtaacggcttgactcgggagtgagccgatggttgccacaaagaagccgtcagtgtataggcgctgtggagtgacagagacaccggtagggatgccgagctcgtgatcactagacggtgaggtgaggattcatatgatgatgacgccgttggcggcgacgagttggaggacttcgccatcagcaaacaagcagtaaatggcgggtcatatatataaatataagggtttcgtcatcgaacggacgaggttggcgagcatgacgccgtcgtcgttggcatgaggatgactctagccgtgacgatgaacgcgaggttatcagcagccggcggcgacgccaagcacgttcttttttaacagccggcggctccaaacttgcacgttggcgacaaatgcatgattggcgctggcaacgacgacaaggccgggcttgccatcggcggagaaacaatcggcgtaggcgatgatgaccaagaacaggttcaccattggtgatatccgcgaggataaatgtatgctaatgattgatgacgaagacgagggttcttccggtttctggccgagatcgcatcacctcggcgtcaatgacaatcatgaaaacgccctggccgtgcaggtctgagagtatgaccggcgacggcgacgagtcatcaatcatcatcgatgacggtgtatatatataaatattttgtcatggagcggtcaaggccggcgagtatgacgccgtagctgttagtacgaggatgatcccgacgtgccgaagcgaaagcgtcgtggacggaaggcacgacgacctcggccagctgaagcgaagggatcatggctggactcggcaacggcgtgcgggcaccaagcaatagcgctccggcgttgtcctcgggccgctcgacaattgtaacatgaggaagattgtagcgccggcgacggtgaggtgttggccgcgtcgcgaggcagaggctgccgtcagcacagtaaggacgcctggcatctcgatgacgtcgcagcgccaggatgtgtcaccggcggccggagtttccgacgggatggagcagcacaacctcgggcgggatggtttgacagcttccacagcagcttgatatgacggcgatctccaccgaggtagcccatatttcattatcttggacggtgtctcaggaactcagacatgcagcaactgtgacacctcgtgtctctcgtcgccatctcgtgcatgcatgatgatctgaacagaaagagaagaaaaacaagaagaaaactaaggagctatacccatggtgatgactgagtacgggctccccagtgatcgtctcctccttagcgtgcctcctcagcgcacgcgcctcctcgccggacgccgaggtactgcggccaacatcaccggccgccgagctcacgcgttcccgccggacgccgagatactacggcaagcacatggatgaacgcagtgagccagtgtgatgagtcctcgcctccaacacaaagtcacaactcggtcacaacggacggaaaaaagaagattccggaatgacccatgggtgtctcatgcgccttggccttatctctcgtacgtgcttgggcccacatgagatactcacagccacagctgtgcccaagtttgaaaaaaatgtgaccccgtagttaatggctaccaagtttttaattatagatagataaataataatctgtacaattttttttagggaaacactgtaggggaagcccccacagttaatattaaattaaaaaaaggaatacaaataatttacaaaatatttatccactaagataaagcttgtctcttataaacttttaatctgtacaactttacagtgaaattaaaaccatatggcctgatcatcatcggcaattcggcgtacgtgtcacgtttcaaatacgatcaggccaggcggtgtactgctcgcctctgatctctctctcctttgcaaagcgatcgtatcagcgttttggctcatgcatgcatgtatacgttgcagcgcagagtgcgttcactactcgaaaagcaaaaggaaaaggcagccaaattttggtcatctctcggatccctcatctctatagtccaaaccggagttaagtgtgtgggaggtatagtagtacctgtgacgcctgtgtgattttaactgcgattaagttatgtattatgtggtagctcggtttttgtgatcagtaacctaggagtactaacctgtgagtagaaacagtttcgttaattagcacatgaatgtacctacatgcagcaaaatggagtagtaccctggaagaagagctgcacaggaggcggtcctcacacaaaaacacacacactctctctctctctgtgtgtaggggagaggttggtggtggactggtagtcaagcaaatgcatgcacacaccatatctgcctccgatgcgttgtgccgtagcggtttccgcgggaggaaggggaggggacagcggctggaggcagcagcgtacaccgcggcgaaaagcaaaagggagggatgggagcctgggaggtgatccgatcggccagggctggcactggcaaagtgacaagttgtgtgtgtgcgcgcgtgtgtgtgagagagagaggggttgtgacccaggcgtggcgctgcgtagtactccctccatcatataatatataagaatttttaagtttttcttaaacaaccactcgtcttatttaaaaaatttatactaatataaaaaacgaaaagttgtgcttaaaatactttgaataataaaataagtcaaaaaaataaataataatttcaaaattttttgaataagacgagtggtcaagcagtgcaagcaaaaactcaaaatctcttatattatgggacggaggaagtacccagatgccgcgcgagggccttgccagcgccgatcccgacccctgcgaccactaggccgaccgctgctgcgcccaagatggagaaggcggcgccgaccccagctactctgcggaggagccagaggacgactgctcagaaggccgcttctctagtgcatgccgccaccactcttgcgtctccgctagcctgccaccgctccgctcgccgcgggagagagggagggaggagggagaaggaggcgatgagggagaaaggacaggagggaggaggggagagaaagagagatgtaagggagagagaaggactcacatgttagtgggtcccatgatataatttttgaatgacaactggatccatgcatattttttaattccaatgtcacctaagcgccacgtcaatacctaagtgccattgtgctattggtggttcattaaaaatggatgcctccacattaatttaaatggaccttgacgctgagctataatgactcagcaaatccatgccaccttcgattagagtttagcatcaatgaagttggcgctaagacgttataggtcagcgccaaggtccttagcgttgagtcgacgacctatttttggttgaagttttttgcaaggaccagtttcaaaataagtttttgagaaagatcaatttgtccaaaaaaagggcacatttgaagtattgaacataggctaataataaaaaacatacatattccgcttgtaaattacgagacgaatttattaagcctaattaatttatcattagtaaatgtttactgtagcgccacattatcaaatcatagcgtaattaggctcaaaagatttgtctcacaatttaattacaaactatgcaattgatttttttcgcatttgatgtgatggaatttttgaaagtttgaatggaactcaaaacaacctatgctggaaagtagggctcccatcggatggcctattcagctaaagtaaaagccaaactttaaattttcaaacttaattttaacattgattttgagatattttcaacgtagtttctttttcaatatcagcttttaaatcatcaagaacacatatataaaagttatatctataaatttacttttattctctaatgagctaattacgaaaaaagccacacgatgagatgaggccctagctttccaatctcctcccttgttcagtcctggaggcctcgtcgatccattaatgaatggaggtgggccccatgggtagacctcgttgatccattaatgaatcgaggtgggccccatgggcaagggaagtatatgcatcgttgatccattaatgaaaggttcagattgaaagctaaagcagaggatgccgatccgtggggatagtattggaggagtactagtagaagatcaaaaaaagtactacctccgtcccaaaataagtgca

SEQ ID NO: 69453 - DNA, 1837 bp, Oryza sativa
ttatcacgagatgatagctaggatgaagaccctctcttcacagtgcaagtatcgtgtgtgggactcagaaatatctgctagtgggatccataaactcccaagtcccaactccccaccggctcctcctccctcgtcacgcaatccccaaatccactcctccctgccggctctcccctcctcccttcgctgacgccgactcccctcctccctccgccggcgccggctctcctctcctccgggcggtggctcccctcctccctccgccagcgccagtgccggctctcctctcctccgggcgtcgtcctcgaagaagcgacggcagcgtcctctgagccgtgcggtggcgtcgtcctcggggccgagctacgacggcgccctcgaagacggcggtggcggcgcggatctggagcgcggaggacggtgcaagcgcgggacggcggcggcggcgcggatctgggctcctcctctctcggccggcgacgaggagacgaagccgctcgtggtcgttgtcctcctcgctttgtctccactttccgccgccggcggcgaggagagaaggacggcggcggcgccctcggcgacggtcctcggcgacgtctcatctcctcgcaaagtgggccccgcgcctgactttttaagcgaggttgctcgttcctctcctgggatgcgaagaacccagtgtagctatgggccctaccaacttttttcgccacatagactaggtaacacaccacgtaggactaggtaactcccactgtgaaaggcctaagcactacaacattttgacatggactccaccgtttctacataaataaacattcccaatactgaatgcacatttgggcgtgtttggttgcctggcttgtccctagctcgcatctcggatgcaacctgtagactgtttggttgactgcacgtgtcccacagccaggcccaacagatgcaaaaagtctctcgcagccatgctgagcaggaacgaccgaattgagcttcgttgctcatcctggctccacgcatgcagcggcgccgcacccgcgcgtgcagggagagccggagagacgatggggtccctgacaccaccctaccttcttcctcatttcttctatcttctcttctcttcgctatcgtcggtcatggccaccagcgacgaccatctccatctccgtcggccagatcaggctagctgcaagtcctgctcctccctctcttcttcagcaaggggtcgccaagagctctccgccggcggatccggagggcatgagctcgccactgccagatctacctgcacagagatgtcgaagcatgagcttggcttgagctcgtcgccgtcgccagcggcaccaccttcctcgccggcttgagctcgtcgctgcgcggacaccctcgccgccacggacagctacctcaaatccatctcctactcaccttttttttttcgccaaattcagaggttagaagctcgggcctgccagatccgagtagccacaacaccctcccggccgctggactcgctgcaccgacggcggcgaacatgcctagctgggtggcacgagcggctaggtaccggcggcggcaagttcctctgcgagctctgttctcctttttttttttctttctttcttttttccaccgaatgtcattaaccactgataaatatggtttatgtacttctatgcaactgtatatgctcatccgatactgttttcaattattgttgttaggagctccgaaatcaatgctttgtatattttgcatgtactattaaatctgatatatataccataaataaatacgcttttatttcgacggtaagaattctcactattaattctaagtg

SEQ ID NO: 69454 - DNA, 8237 bp, Oryza sativa
cactccccacccggccaaaccccaagagaacccagccggcctccaccacaccacacaccaccaccctcggacacaagaaccgcacgcgcggccggccaccgtcgatgccccctcgccactgccgccgctagccgacgaaccagcatatcttcgccgacctcgacctccatggaccgggcctccgaggagctggagcgccgcagccgctacctcagttcgctcgtccgccgcaccaagctcgccgacccgcccgagccggagccggagcctgagccggagccggagagggagagggagagggaggtggcggcgaaggagagcggtggcggtgaggggaagggcggtaaggtggtggaggagaaggaggtgaaggcggcgaaggagaagaaggagaaggagaaggaggcgaaggtgccgaggggggagggggggaatggggaggaaagaaggtggcggtgcgcgtgcgggcggcggacatgccgccggcgctgcagcgccgcgcgatccgggtcgccctggaggccaccgccccatgccgcggatcgacagcaagcgcctcgcgctcgcgctgaagaaggtatcatccatcctacgcttagcacattgttaatttcttccattcatttcctcgcggaattgttcatcagtttaagtcggggtcgaaacttgtttagatcatttgtaaatggccgtaaatgggggcatatgttgcacactcttaagattaagatctagagctgtttgttctactagcaatgatgttagctttctgccaacttcgggaaagcgtgcttctaaatttggagcatctggaatggttcgagaagctctttggtgttggcagtgaagctagatgagaatgatatgttgacctacattaagtgggaagtaggatggtgccaggtcaatttgttcatttatgagagatggtccactatagggctcgcggaatatttgtgagatttggagaacgtgacagtagttatatttctttgctgctattggtgctttaccacttccaattccaaccatgttcggagttgaatatggatgatatcatgataactaagcatcacatgctctagagagcttatggttctgtgcaatagagctagctttccagcttggtttaattagtaaatatgctagtttctcatttgatgttgagtgatcaagcataattgtgaacaactagttgtgactcatgatcaggaatcaggcagctgatatcaccttttaatgggatttcaaggaatttcttgtggtagagctttcttgatattatcagttggtacctttatctgatggctttccctgaggcggacctatcccttctgtcatttcctttgttagagtcagtaattagagcattgatcatgaaattggaaccctgctacgagtgttgtgaactactgaattagattttgtattcaccattatattttggcaggtagtaagtacttatgtctgtacaggaaaaatacaatcgcaaaaatagggcaagatgcctttgaataagttagttccaaatgttgacatgtttattacacgataaactagctatgaagtaaatggatatcctggagagttgaataagagaatttgcttgctgtatgtgcagcaagcttgttttttgccaaaaatattatgcatccagcttggcagcttgttgtgcaaaagatttgttccttatgacttctagcaagaatatcaagtttttcaaaagatattagtacgttaccctgatgatgaaccccatttcactagcatcctaaaaatacttctatgtaattgatgtgaatgcaaagcatgaatacttttcaagttttcatacattatctccccattctttaaacaaactaatgttgtgttacactgtctgggtgactgcttaaattgctgctttgttttgttattaccttttctctatgaactaagtgatagtgcctacttgtgtgtgcttgctctcttgctattacgttggctggacacttgaggatgcgacgttttcttcaatggccttacatgcattcacagtccttaacaatcaatggctgaaaatgttcctttcatttgctcacaggaatttgatacaacatatgggcctgcttggcactgcattgtcggcacaagcttcggttcctacgttactcactccttgggaggtttcttgtacttctctgttgacaagttatacattcttctcttcagaacagctgttgagccactaagctaccaacgataatgtgcgatatctctatctactgaaacaaaagtgtagattcgatgcaatttgtaattttgaactgaagttgtattagatgctcaacgagtagtaagcttgggtagaggtaaatggccacttctctacatgctaatgctaaattgtaagacagctaagcttatgtaactgccatgtaccacgtgagctcctgctgtgtaagctcgcttttgacttgcaaagctgtagcttaactgaagtttccaaagctttcctgtgtctgcaacaacgctctgtcaattcagctttcaagctgttcaatgttctctcatgggctgatggcctcgtgggagctcaaaaacttttttggtcctcctgatccgtgttaatccaacaagcacggataataatactaaaaactttcttggtgctcctgatcggtgtcaacccaacgctcacggataatactgacaatactcatggtaacattgataattagcctgacagaatgtgctacaccgagtggtgacagaaagcattctggtgagtggcgacagaatgcgctacgccgagcatggacaggcctaggtacaccgtctctgtggagagtccacactataatatagccagctaccttacttgttgccagcgtagaaagaaaccccacaaaactgaagcagcacgcagttgttggcttgttgccagcgtagaaagaaaccccacaaaactgaagcagcacgcagttgttgcccagtgtagaaaccccccaaacctgaagcagcgtgcagttcgttgcccacagcgaagaaaccccagaaaaactgaagcagagaccaagatatagacacaggattgaccataacaataaacaccaataaaaaggcaaacagaaaaacaggaagtgccaccaagcagttcaagaggctcccccacccccaaccaggcctggctccacagacccccacctgctctgctacgagtagcttaaaggcgagactgcaaaaccatcgctagcaacctcacatacgggggagccccagatttcccgacaacaatcacagccacataggtgtcattacacagtagcaaagcactagctacaagcttctagggcacataaagccggctttactgcccctcgctggagtcgcgcttcggagcttccctgatctcttccgcggtgtcctcctgaagccacaaggcacgattggtacagtttgttcagtgatcaggatgattttgacgaaacgggggtaaagatcgcgtgaagagattagtggtatttgagaaatggaaacgtaccgagatgtctgaagtccacagggtcaggttatcacggaggagttgcatgatcaaagtgctgtccttgtaggactcctcgctcagggtgtccagctccgagatggcctcatcaaaagcctgtagaaattggtaagaggggaacatcatgatgccagcattgtctcaaaaaaggtagaagcctcaaagggaccaaagttttctttatggggaggtcaaacaactctctaatggacttagttaatgtacaccacaagatttaactgggttgcaatcaaataacatgacatgaacaggctcagggaatttactactaccatggagacaaaatcaaccaacgaggagttgcatacaaaaggtgtggtaaatactcgaatttgcaatagggaaagtattgtttcttcagaattttttcacttgcaagatggcggataagtcaattagtaccaagtagctacagagcctacaactgaagagcgtattttacttttgtctactattctgttcaagccatatcgatggctaatgtaaattaataccataacatgcaaggatagattcatcttttaaaaaacatgcaagaatagatgcagactcaagacagctaatgcaaggtcagggtcaaccaaaaagaagtgtgatacttaaaacaccaattatcatacaaggtactacacatatagtatagtatggttctcttggattttttttccctaggcatcactataattgaagaacaatgcaaatattttgttctctccaaacaacacctaaacactgtaaattatactgttctacaaatccaagacagaacatcatggtagacaactaaaccaaaaggtgttggctgttctgtccgtagcataattgcatgaacagaaagtgcacataactatgactgcaacttttaaagttgatgttgccagatagcgaagtgtcaccaaatgaccaaaacacagtaaaggaggcatgcggtttagaaatgtaagagcattaaaaatagtacatagtaaaatcctgtgtgcgacgtatctacgcccactaaccttttttccttttgtggactaaacaatgctaacttttcaaagcagcatttatagaatagctatggaaggaaaggaatatgtgacgtgattttttaaaatattatccaaactactgctaaccatatgtattgtgataatcgaattatgtaatcgccacaacaaacatcaatacaccatcaagaagaaaaaaaatcaatgcttaaaaataacatgtaatctctccgttttacaatgtaagattttctagcatcgccaacattcatatatatattaatgaatctagattcatatacattcatataaatatatgaatctagattcattaatatctatatgaatgtggacgatgctagaaagtcttacattgtgaaacggaggaagtaggtaatttacaacaccaacctgctttgcgaggttgcaagcacgatcaggcgagttgaggatctcatagtagaacactgagaagttaagagctagcccaagcctaattggatgagtaggaggcagctcagccaaagcaatgtcctacatcaaaatcagtttgttgttaatttccacaaaacaaagaaagtataatattgcaccaacatagttctgttttttttttcccatagcgtgatcaaggaatatgaaaaaatattcacctgagcagccttgtatgccaccatggtattctcagcagcatccttcctctcagccccggtcttaaattcggcaaggtacctatttattaaaattgattcagcatagcaaaagcaatcacaaactagtaaatgcaaaaataccaatacccatcatattacctgtagtagtcacccttcattttgaggtagaagaccttggactcaggggcagtggaagaggggacaaggtgggattcaagcagcttgagaatgccgtcgcaaatcttggtgagctcagtctcgatcttgccacggtagtccttgatgagtgtgacacggtcctcgttaccacggctttcctccttctgctcaatggaggagataatgcgccatgacgcacggcgggctccaatcacattcttgtatgcaacagacaggaggttgcgctcctccacggtgagctcctcagagtcaaccgtcttggccaccttctccatgaattcgaccatctcctcgtacctctcggcttgctcagcgagcttggccatgtacacattctcctcacgggaaagctccgcctgtgccgacatctttgctatctataaatctaaaaactctacaaatgccaagtctgcaagatcaaagaacaaaaacggtgatgaactaaccgttctttggaggatccatacaaacaatttaaagagtaatccacgatgcagaataaaggcataaattcagaagcaaaaaacagaaaatgatgcattgttgggaaatccatccaattcctgtttcaagtgggcaagccaatgatctcaagtttgatttttgaatttggtaccgtagcacatttcaaagagcaattttgaattactgccccgcaatcgtagcttcagtattcccgagctaactgtacatcagagtcaatctaacaatagatcaagacgagaaaaatcaaaattataagcaaaattctgagaagcaaacatggaccagaaccacagaacccctacagaactcaggtttttgacggatccaaccatactccgtaaaatcacatcaaccgcacacagatcacttcaaaaccaccagagacccacccgattcgtgcagacaaacctaccactaaagcacgcctagcaaaaaaaaatcgctacgaaaacagcagggtttagctgagaattcagatggaaaacgatcccaccaaacggccacagatcacgcgggggatcatgctagcaagtactaccagcaccgatccaatcgaacggaaacacacacacacgaagcgaaaattctacgggaagagatcaaaattcgagagggggaggagagagatcgcagcgaaggaatacctctgtgtgcgtctcctcgcgctctggcgtcgaaattttggggggaggcggacgcgaggaggcgcccggggcccctagaaatgccccaccccagccaatgagcgcccgacgcgtgtccactccaccgtggcatgccgggcacgtggcctcacggccccaccacgcagccgcacaagccctactaggctacttccacgcgggggggacgtcagccgaaggtggggcccacatgtcagcgtcgtgtacggtgggtcccacggccgcgtcgtgctgataagctcggctccctcgcggtgacagcctggactccgttggaccggggcggccaagggcaaagcaaagcggggcggggtttgtttttttttggcacaggtttcggatcttacccgcgagggaggcgtgacgctgccgtgtggggcccagtgacacggtggccacgtgctacggtggtgcgggtagagagggcggtgcgtgtgtggccgtgtgaaccgggcggcgcggcggacagcgggacaggtgaggtgaggcgaggagaggcggcgatcgggggcgaggtgaaggcgtggcgctgagcaggccgcggggcccaccacgaggtggtgctcgtggccccgtcggtgttcggagttttgcagagaagacaccgaatttcgcagacaaaagttatttttgtgctgcaattggtggacaaacgtctggcaaaatttgtgtgaagtttccaaacaagcctgcaattaacatcccaaaaaactgcgtgttttgcgtgggaattcacttcctactacttttgaaacgttggttatttcagctaatcatacggcacagcgaggagtacagagtactggagctgtattgttctcctataatttgcttataaaattcgtgtctaaattgatattttccgcgtatttgccacatcgattctcctctcaaactggactgtcggctaatgacgccgtacgccacggctcgtcaaagtcgtttcgttctaatcctgccgatcacgtctcgccgccggatatctccacgtcaagactagctcggaggtcgcagtcgtcatgcaccgggaggctaatcctgatggaaaagaaaatttgataaatcgatggaggcctaccaaacacatccgctaattaaggcgatggtcgccggcgagaaaaagggcttcgccgatagaaaatttgcagcaacagttggtaggtcgccatcgttctaggcttctattagccctgtatgagatgtgaatctcgttttaattagaaaaaaaaaacagctacgcgtatgcaatgtatttgccatgctgaccgtagaatgagcttaaagcgaatttaatattttgtcatcttccgtgatgtcattcgtatgactttacgtgtaccagctccgttcggttaggctttgatctccaaaggaagtagcaggcgatcatttcgacactatacttggccaacttggcaacttgatgcatccatcactgcatttctttcttgtttttttcgtcggggacgagagaccaagtcggaggctacaaacacgaaatgaaaacaaataaaatcagcccaaagtcattagccgagcgtatgctgacatttgtacgaaattggcctctcggaccatttaggccccctaatagcaagatgctttgagagggccacggattccactggtgggctgaatcgctggcaagttcgacaaa

SEQ ID NO: 69455 - DNA, 27825 bp, Oryza sativa
ccccccaaaaaaaaacttacctggtatgtaaattacaaattaggatcagaatttaacagagtgaaaagcaaaccatcattttccaaagttctatttcacatatatttgcattgttttctcctatacctaaatacattttgtacaaatgtgctagggatcagcgaagaatttaccttctgcttgcacctccagattgtccccaggcatggtaaggtgtaagcttcaggcagttttacaatacgaatttagacaacagattacacttgaatacttgttaaaaacatgttgctttgaatgcagtgcttttttcctcagaatgaggtgaaacagattcagacacctttgttcattctcaacgcagcgtatgattcctggcaggttatcatctgatccacgttctgcaatacttctatgattatgatccttttagtgttgcccttagataaatatgctttgtagtggcatatgttttggcattgtggctgtgtacatccgatttggatgtagaggccagactttaatccattttctaaaaatatgttttggcattaatttaggtctcgtgtgttacaggtaaggaacatcttggtgccaggatttgcagaccctcatggtaaatggcatagctgtaagcatgatatagatcaatgtcctgcatcgcaacttcaaatcttgcaaggtaggtactagatagtgtattggtatgtaatactgcattttctagttggccagctatcgacccagtttaaaaattgcatggattctaaatgccatcacaggattcagagacgattttctgaaagcactgaaggaacaagggactccctccaccagaggattgtttataaactcatgcttcgtgcattgccaatctgagacgcaggagacatggtttgcatctggttcccccatgcttgaaaccaaagtaatactacatccttcaacttcaacaccacttaactcaaaattaaaccaaagttactactagagccggctactgctagagccagctatctaatgatgatctgacaagagctcttcacacttgtgtagacaatagcggatgcagttggagattggttctacgaccgcaatccgtttcagaagattgattgcccttacccttgcgattcaacctgccacaaccgaatctacgacgacccctcagaagcatagcaattacagaaacctcacctcgtactaccattcatcacattgttatatttgatgcacccttattgctcgcaatagggcaatccgtgggcaaccattgattttcaggaataactgcagatgatggcttaaagctcatctgatgcctggaggctggatgcagcttccaacagtagttacaggtgtctccaacatttgattcgctttgtcggcaatattttgccatatcttcgataatcatcgacaaagtccacattaatgttactgaagtgacattggacgaacacgaaacacgaaaagtttatctggtgaggggatggataatgctattttctcgaaattagctcaaaattcaagtacgttcagtgagattttcgaaatcaaagtggagcctaaccaaactgcgctctgttaacctgtcaacggcgcctcgccgccgccgttgcgcgtccccgccggccatcgatgaagagctccggcgtgagatcccccgtatctccaccgcatatcaccacgtctgcacgtcaacgagtgccagatccatttctgccctcgtcggcgtgacgaacgacggcggacgtacgggcggcgctgatgagcagagcgagggatgcagcacgagctcgaggaggggatgatatttcgtcgattcatgcaccgatcggagtgtgtgaaggagcttcttctagttgatctcgatagactacgttcagattcttcgctctatctagggtgcaggcgtgcggcactgaaggagacaggaggtagaatactgaacacaaagatgtcgacttgcccgatgcctcctaacacagtgccacacttgcacaatcagaggaggggagatgcatgataaatggagcacacacatgtttttcctccgagggaaaatatcactcgctctctcgctttgcaaggctgccagtttatatatctagcggtgtacctactgggagtaaataggtgtcagcgaagcatcttgtctttaatttggatcaatcacacagtagtggtctgatctgatccttttaatgacacggtattattactgggcggattgtagcgtttgtttttttcccctagcgacaagggcttttaacaaatcttcaacgttttgaagcatttgtactggtctggtttgatttgatctgtctaaatcgtcagaagtcacatgaaaagcatggcattctgaaagtaggggctgctcaacttctttttcccgctgggtttttgcagcaggcagaagcctccgctcgatgtataacaaataaaccaaaaacgaaaagaagaaaccaacagagaatgctacaattacagacccataccatacagttctatgagccggagcattgcgaagggatcaattagaggaatgcaacaaactgcaaaatcaacagcccgtaagcaatgcaaccaagagttgcaaatacaaactactaatgcaaccaattgaatggcattcctccagatccatactagaaaatccttccaaaatcctttcctgcaaaggaagacggcagtccgcctgctgtaaaagagtgaccaggccttcctcctgcacaacattcagaattatgtttcagacataaatatgcataccttctatggtttccaaatgcatgcaccgattgaaatgacttttaagctataataggttaataaagataaggcactcgtgaaaaaaaaatggaagatccaattggaaagcaaactatatcaacaggacatacatatctcatgcatgaaggttacaccttttcttttggccattgcagtcccatgtgcaattacaagcctagaccaaacatgtttcaatatactattaaacaaaatttgccaataaactatgtgtactgcaaggccattgttctgaaaattaataccaagattgcaagttttcagtagcacatttagttaagttggatacctcaaaaaaaaattagttaagttggactagaaggccatgccacataaaaaaagaggaccacagatggtagtaaatctagtgctacgatagcttttgcagagtcaatggctataccaacaacacccaattaaataaaacatacaaatgacaacatggaaatattaccccaaggcattccgtcagccatagtagcaggtggaggttctgccatgccataattaggccatacaggctgaccattgtgatgattccccattggacgtaggtagctcgcagtcatatggttataccgctgaaatggttgtccatggcgactttgaaaattcagctgagaatagtttgcattatggtaaccatcataggtcacatggcctgtagaggcactactctctgtaagagttgatgcatggaacaggcggtcacctctataggaaaagcatgaacaatgatcagttaataatactaaatataacaatatggaacccctgacaatatagcaccacccaagaaaattcaaaatattttcagtggtattactctcaataaagcaacacatagaaaacaagattcgtgtaaaagaagcacctcccttatccagttatcccttaagatgtttattgtcatgaaacaaactgttgcactgagaggcattacattttacaccccacagcgtctaataaacgtgtatgaaagctctttcgattctttgtacacatgccatccaaaatgacaatcatacccttacatatgtatataatcaaatccatttgttagcacattacaattttagcatttgtaaaaatggtgaataattaagcagaaaccagcagcacagcacaaggtgggaaaagtgaagtatgctttttttttcctaaagatatgagcgaactatacagagagcaaatcattgtagttggattgtaagcaatctatcagatgaggggtgcctctattatattagctttttatgcgtcggccaaatgtcattacatgaacaaattagaaaacacttaagtacctttgattcatggataaagagtttgagtttgcaatagcatggctttggatatgggccaatctgctggattggtttgtttgaccacttgcatccttcaggtggagatcgctcaacgcatctgatagtgaagtgtcctcttgcagaagtgactcttcgctgcacatcaaaacaaagtgaaaaagatcaacacatgttacattacaaagacaaaactgtatgatgcactgttacctatagtttggatcccaatcagctggatccggtattgatgaggtggaagccagtgtatctgctgacacattggatgagtgcgtaggaggaaaaccaccgtatcgagatggtggaaaggacccatggttcgaagtgtctgttgataaaccactgccagcgcatgtatgtggtctccaactgaaatgaccaggattagggagtgcactttgtgggtaaccagaatgtccacgagcatagccatcaaagtgattactaatggtgccatccccatggtgtccctgagtcagctgagatgtgtattcatgaggcggcattgatataggtgggtgaccaagatttcttcttctattgtattggcctacagcagcagcttttcccaatgagccatgactgctccttgcaggagaagtggaaccatactttcctgtagcagtacttgggatttgcatctgagaatttggtggagtaaattgtgatggacttgccccaagagacataggccctggacacccagggcttaatcgaatgccaccaccatgatagagataagatcgtcgtctaatatctggactagatcccaaaaatgttcctccggcttgtgaatgtaaattgaatccagaagggcctagtggtgaatgatacatgttcacactgttgacatcatagcttccatagctgcttgcaagacctacattgtcattaaagctaccatggctaccgaagctgccacagctgcttccatatgaaaagggaatctttggtgcaaaagcgttattaaatggtaggcctctgttaatgcttccaacctacaaacataatcaacaatatattatgataataattatcttacaactcaccaacttaacaaaagcataagagaacatacttacaacctgaggggaaagaccagcagctaaccagtgacctcctccaggattatgatcaactgctgcaacacgaccaacaggctacaatggcacaacacaacaagacataagtatatgacttacggactacttgtatgaaaaaaagggagcgcttaaggtacaagtattttaaggtttctccacattgtctactccctctgatttcagatatgtcaccattgactagtgcaattataattttgaccacaacaaattttgaatggtggagcatgacgcacaaaagttttgtgatatttagggtgcaacacacttcgttaatatgacatacttttaagtatttgtttttttcaaaaaagacgagctgtcaaagtttgaagatgaatagtacctagtgacaagtatttgaagacagagggagtagtatatagcaatatatagtctgttggtgggaagaaacactgtttcatgtatccatgtttgttataatgtgaaaggaagatatctaaatacctcgttcaattaaatgcagagcaaaaccaaagtcaattgttacaaatgatggtcgttccgtatcaacagtctctaaggagagaaaaattatacagcaggttgtctggaaacaagatcatacttacaattcttggagtctcctggataggctcatatggaccagtaaacgcttcaccagttatgaagggatgatatgaagcctgaaataggttcataattgtgaagtacttccattgattattcaagaagaaaaaaaaatagcgcaataggaaatcaagttaataatttcctaagtaccaaactgacctgcctaaagctcatttatttaacggctacgaaacaaggattccccagcatattcagatattgggattaataagacttcccattcacaatcaaagagtacaaccaaataggaatcaaatgttatcatcagtgaatacctgcaatggtgaccaccgcttattaggatcaaactcaacaagccctctcaagaaatcaaccagtgctaagcgatctgtcttttctgtctctgaatcaaaattgaaataggtgagaagataatgtcaaacctgcaacttcatcataaggactaggatattatcattcaagagactaatactaagaaataattctaagttcaccagtattattagtatcttgcatgattctggtatgtgccagcattgctaacctattgttcatacacctgtttaataaagaactgcaaccggaaataaggtatagttaactaggttgatcatttcccaaaaggtaccgctatagtatgcaacactatcagttctataacaactactgcaacttcctgggcacccattataatttatgccacagtatagtcgtacaccaaaggcaataaaccttaaggcaatgcacaccaaatgaaccacgtattccgcaagaaacgctaattactgggtctgccatattgatcactgctagctgagattgttctagaataaacacagtttcaaaatcagctgtaaacctacttagctccatccttaaaaataagtatcacaaaacatacctggcaagttttccccattcaaattcttccaagggtatgtatatatgagtttgtcaagccttccacgagggaaataccatcttcctacttttggttttttggactccctctgtgttgcaggatgtaaacagggtatagataagtaataatgaagtaaatgtataggacaggacaaatatgtaaccttaaaaaaaataaaaatattacagtttcaatctcctcttcagttaatattctgtacgcactgatagggccattctgcatttcaataccaggataaatacttccaacttgcttaaaaaatctcccagtatttttagcctcccgtagcagatcatctggtggttgtccactgtataagaaaaaggcaaacatgtttaaaaacacttttgaatttccataaaagcaatgttgtaacatttctgaaaagttaagaacagaagtgaaagaactcagacagttacaaagtaattgaatataagttattttcactgtaaattgttggttgtaatgaagaaaagggagggaaaagttcaatcagatgtactaacccgagaatctcaatcatacggcataggacatcgtattctgacgctccaggaaataaaggcaatcctatatatagttcagcgactatacagccaaatgaccacatatcaatggccgtggtatatctagtacttgttaagtttacaaatccagatgttagaattcacaaaagctgcaccacataatgacaaatttaaaatggacataacagagaaaaacaaattaaaagcataagacatttgtgcagctttaaggtatttcctagtgaaaaatagatgtcacacaggatacgggtaaccaagaagtacttccggagatctgtaataccgactctggaaaagaaaaaaaaaaggagaagcttctttaaatcaacaattttactataacatgaattcagagttcacactgatgggtgagtttgaatgaaacctgaatatacgagtaaatggttttaccctccaagcatgctgatccaaaatcaattactttaaccccagctgctgtttttacactgcaaagatatagcgtggatggattaatagcatgcaaacagtgaacaaatcaagtgctgatttgagatgagacaactaactttggagttatgagaatattttccggttttagatcacaatgaataatgccagcgtccttcatgacaaccaatgcatccaatatctgaccaataaagaattagacatagataatatggtaatcaatgcatttaaaattcaaaaattcaagcaccatatgaaaataaaaccttacctgtctagagaaagttcggacatatttcagttgcaaacctcttagactattcctttttagcagctcataactagatgtgggagtttaagtgatacatgaattagttacatggtatataatagattagcgaagagaagtacgacaatcttacaggttatggccaagcatttcaaatgctatacacaaatgattttggtagagaaaaaaatccagcatccggacaatgtggtgttgatcatcaggatcatatttctcattcagctgcaagattgagcatacacagttgtgatgccagtcgttacatacatcaatcacaagtgagtaaatgctaggtaaactactgtaccatgctcaacagtgagacctccatgatagcttgctgataaaaggcaggctgattttttataacctttactgcaacatagctgttagtttctccatcccagcatttagcaacctgtccaaacgtaccttggccaagcatttctttaataacgtacctacttagaacaataaaaagatgagtgcagtccaatctgatgctgttcatagtttaactttagaggtgttttacaatgctctctactggtagtagaaccaatctagatcattttttttctccaatagatcatatctatttatactaccacatcaactactggtagtataataatattttctactggtagtagaactcataaattaatagttgagatcacttctattggcaataatacttgtagtagaatactagagagcaccgtaaaggtactcttaactttaaccatcaggaactctgataaaaaaaatatgaacacaaagttgaattgatcaattggatagctttatcgcctaagttcaataagttgaaaatttgaaagaaactacaatgtgtggcaatatggcagtcctttggacatatttcatcttcccatatttccacatctgagttcttagtataatggagagtcagaatgtgcatacatatttctaacttataacataaaaaacaaaatagtgaaaagagatatatctggtaaaaatgttttgagtgctctaactcactaagaaatggacaacagacacaaatattgaatcacataaaagggttaacaagtcaagaagaaaactaacctccggtccgactttttattaaccaattccaagttgacatacaagatgaggtcagaatttgcattatcaaggccatcattgtgagctggaactgaagggttggtgagaaagcgcttggggttcagtgaatctgagtacttaaactcaggattgcattttccgaaagtttggacaatgtctgtggttaatcttgcaacaaactgcaggaataagaaaatataatttagagtgaagcatcacaagtatatgaagaaggtgtcatacacagttgaacaattgtaacaaaaaaaatgtcacatagactgttccctcatcattttacaatataatacattcagaatatcaacaaagttgaaaattgtccctaaagtattgtgcttacccctggatgagatagcaaagttatgctgccaaaaaataaataccaatttaaaggaacatcttaacttagcaaaaagctaggatcctcaagtcaatttgagttgtgcaatgcctcccattcgctcatgaattatgatcaaagtaattaggaccgcctgtagcagtaaagtacctgttctagtgactatacgattagaagaacaagctaagcaaacaaatctagtgtacattaaacttaacagtgcattcgaatttagcagaaaacaggggtcggatttctggttagcaatgctgagagctttcagaaatgaagtttgtagctgaagaatcaatagaaaatctgagcaatcgaataatctagaccatgcgtgcaagcaataagaaaaaatggcagcaacaatgggtgatcatatgatacagctagttcaagcgaccagagtttaagctattggttccttgcaagcacctgatgctaatcgcattccagctaagtaaccatgtgcgaatagctcaatgcaattgacaattcagcaaagcgaggcctgaccgcagccgcatcaagcaagcatcttaggtagccctgtgagaaggggaaggtgcaggaaacgtacaggcctcttcctgacggagctgaggttgcttgagcgggcggcaagcccattgcgtcgaccggacaacgacgcccccgcccggtccccggccgccgcagcagcagcgaacggaaggaacgccgtggactcactcggcctccacggcggccccgccgcgtccacctcccaggaaacctccatacaccacacgcgcaaccgcctcccagcacccaatcgccgccgcccccgcggagatcaaatgcccaccaccaccacctcagcccaatccacctggctcccggctcccggctcccactaggatcacaccaacacgctcctccaaataagcggcaccagcagcagcagctaagcggccgccggcggagtccagctgcatcctaggcggcggtcatcgcccaatgctcccccctcccccgatccgatctcctccgcccctgcccgctcccgctcccgagcctccgccgggagctcgggaccccggtgaattgggcgcgcggggttttggggagagcacgagaagagacccactcctctacctcgccggattggcgaggggataggctgcggcggcggcggaggcggaggcggaggcggaggaggaggaggaggagtggggaatttggagaggggggcggcgagtcccaatcccctcctccctgtttcgtctcttctctcttccctttccttgctcgtctccgtcacacctccctctcgcctatttttcgctcccttttccgtccagcgattagcttagtacttctatatatttttacgcgtcgagttttttttaattaatcaaagggggtgaaatgacaatgtgcacacagtggtaagcacagcagcaacggcctctaattatcgacgacgccgtcacgtgctccggcccacgctgctttgtcgtccagatggcacggtgaccgtctgatacgttctgatcttcgcgtcatgcggttgtacgtggaaaatgatgaaagaccaactcgtgtttcgttgtgtttttctttttgttaggaggttacacggtaatttcaaatttgttgaccacgttctgaaagtagtacatatttcgccctccggttgtatatggttcgttgctattttgaatggcatgtgaataccattagtgggaaaatatgtgaaatgcattattggtaaaaaaaaatggaaacaacgaaatagtataattgatgtgtgatttattgctattttacaaataaatgtgaacaattgacccaaaagatagaaacgtaggactttttgttgagatagatgtgttacaagacataaagtggttgagtgttcataggtagtcgctagagtacatcaaccctaaagtataaaaaaaccaacaaaaagtggacgcaagtgctagaaaatttgacgtgttaggctgtgttacatatccgacgtaatttcactctatagactagatagatagatacaatcttgtcagtgatattaatacgaaaacaacttaagtagaaatcaatatatttattttcttacaatagatgtgttatgaaacataaagtggattgagtgttcaagatagatagttgctaaaattcatcgacactatagctttaggatgtgtttatatcatcatatgatgctcaaattttaaattattcatgtcatctacaacatagagaaaccaacaagaagttaacgcaagtgctagaaaaattgatatattgggttgtgtgtgtatatattcgatgtgattgacccatcacatggaaagatagataaatgcaatttcgtcattggtaccaatatcaaaacaatgtaaaaatcagcacgttcaaggaacaaaagaaaaaaagagatatgtgttaggtcagcctttgtcagaattggttcgatattcagagttggtagatgtgaaaaggttgttggctttcaattttattccatactttgtatgaataaatcccaagaattgttgaaattaatgcatgacacaggatttgaatatataaccgcagaacatatactatggaaacttgaaaacatttttgttagaagtaaaaaaaatacacatctactcctttcgtttcatattgcaagttgtttgacttttttttctagtgaaactttcttaaatttgatcaagtttacagaaaaaattagcaatatctaaaatatcaaattagtttcattaaatctaatattgaatatattttgataatatgcttgttttgtgttgaaaatactattatatatttttctacaaacttgatcaaacttaaaaatgtttgactaggaaaagatcaaacgacttataatgtaaaatggagggagtagtttagatttaaataaacaatcatccaataagaagtttagatttaaataaacagccatccaataagaacaaactcaactttgattataggatgcaaaaactaaccaaatcgcaaagaaaaacactattctttttttccttatccactattcctcatttgggagcatcaggaaattcaaatttaaagaaaaaaaatcaatcacttttctcatttttttcttttagcgatcagcacaacacgggcgtgatgatccattgaatagagtaggaaaaaaattacaagtaccctataaggcagtagttaggaaagaaataaaaaaaacaccaccacacgcaccgacaacacatatacatactcaagtagaaggctagcattggatcggccaccgctaggctaacaaggaagctacagtcgggaccacccaaaaccaatcccaaacaaccaagcacctaactcaactctgatcacgcctttgggattgaggggggagggtgagaaagaataatggatccgctctccccctacagcccgcctactcatataaactagagcaccgccgcaagaaaacaacgcatatagaggaagcttgcactaactaccagaaggaagttttggcaagggacctccaaaatgacatctccaggaaaatgaacgacgatgagcaccaccgccgctgtccatccagatctcagggaaaccaagacagggttttcccccgacagcctgaccagaggtaaggggattgctcgacaaaaggtcaagcaataaactattcctatatgaaaagaatcaccgagctacataaaaaagaaacatacaatacataaaggtttacaaaaatacatacaaaaagttttcaaactcaaataaaaataaagtaaacccatatatatcaataaaactgcataaaaaagtaaatggcgtattgcacatcgcaacaatttagtgtacaatttttatgtgactggaatttcacaaaaaatcacacaattaaaatatagcaatattcttctcaattttatacttcctttgttttttaacgatggttagtttgaaaatgaactaaccaatgacaagtatcttacaaacgaagatgagtttatttttacaactctggggctgtctaatatcatcttagctatatgtatgatatttttctaagaactgttataccgttgtttgcaggtaccacctagatatggttttcactatacatttatgtgaaactactagcgtagttcttttataaacagttcgtggaactacttccgtggaaaagaaaagaaaaagctcgtgaaactacatggaatttagatctttgataaagcaaggacgccagtggatttgtgggatcagtgtttctccgagcacgggtttctgggcttgtcgcgacgcgacagcagctgacacgttgttttgaccgtcgacgatctcgccgaggagtcgaggagaatgtcgagaccaaaccgagtcacgggcacacgggtgcagttgcaccgtaaaaagctcctgtggagtccacgccgcgaagtcgcagcgcgccacccttctctcccactcccaatctcccatctccaatgccacgccaaaacgccgaccaacgtacggcaagtcagccacacggcgcatgtcaaccctccaaccaaccgggactagcacgctgccagttgccgcgtccgccggccgcgccggcggtgcccgtggacgctcgaggacccgggcgaccgtggaagccgtgacccgtgaacgcctctgcgcttcccctttttttctcaaacgctgaagcattcggcgacggggtcgaccggacgaggtcatcagctcaccggtctctagcccccgtccaggacgccaaatattgacctgacagctgacagcgatacgtccgtgtcgcgttcctctcgccgtgtccctgcaggaaaccgaacgggtcttgctccggaacgagggaagcgagagtgaggtttataaaaccatgcgattatcgtggttatcatatatggtaacattttcaatttttgaaacaatgatatacttcatgataaccatatggttttcgcgataaccgtagtagccacctaaccgcgggactaccacgatagagtggtggcgggcgggacgcacgacgggcgagcgcggcagtggagcggcaacgggggatgagcgcggcggtggcggaccacatatccaagagcagcggggggaggggagaggccaccggctccgcgtggtgcacggcgaccccgaccgtaaccccgtccttgtcatgctcctccccttcgtcgacaagcctcccgaagtcgaggtccatctcggagagctcccctgtgctcgaccgccaccaccgccgtacccctccgggtggctgacgatgctaggagtggcaccaccggcaggagaaggggaagaggcaaaggaggagatggttccttggtcgccgtctgcctccctcgcgcgcaggacgggcgagctcggacgggttcaccggccgcctccccctccctcccaaaccacttcgcttgccacccgccgactactgccgcactcgcttgccgcccgcatccacgctcgcccatcgctgtgcccatcgtcgctccgccaccgcccacattcgcgctcgcccatcgtcgctccgcccgccgcccgcatgccgcctcgcccatcgtcgctccgcccgccgcccgtatccgcggtcgcccatcgtcgctccgcccgccgcccgtatccgcggtcgcccaagagaatgtacagctgacatgtgggctccacatacttttttaaattttttttattaactaggatgccacgtcagcgaaaccatccatatatattatcataggaccttaaatgaatggtttgtgtgagtttagagatacacatttctagtttgtggttaagggatctcaaaatctgttaagttaaggacctccggtgaacttattcccaaacagtttgataaaccctgctcgtcgcacacacacccaagccgtgccatccagcagtcaaccacaggctacggtccaatgcaccgcaacagcacgctttgatcgctgcaaacgttgatgtacgatgcggccaatgctagtagcttttaccatgcatacactatttagcccgttccatacaggacgtattagcaaggtgaacttaaccaactttatgtagccagccagcgcgcagcacagcatgcatcatcatcacaaaccctgtacaactgccaaaaagaaaaacttcacagcttcatgtcctttttcaccacctaagctgcttcacccccttcttcctgacgaccgcgtcgaggctgccgtcgaccaggctgatctggtccatcagcgaccgccggatgtggcccggcggcgtctcggtgatgccggcgaggtacacgtcggaggagaggtcgaacttgagtgtggccagaggggtgttgggcttcttgatcaggtcatcttccagcagaatctctgctaccctggacagtatgctgaatgccaccccaacaagaacccttgagtaggcctccacaatggcatgccccacgtcctgcgtagatatgtagtaagttcgttcaaaaggcaaaaaattcagcaagcagaaccaaaacatgttcagggatttcataaggtttcataatgcattttggacaaaggttacatgctctgcgcgagcacaaatggttgttatgtaatggcgaacttaccacattgtattggatctttacaacttctataaaagttggaggaaggctcgggaatctggatttcagaagctgcataagtgtttcaaccctttctatgcacatggacatcttatcgagttctgatgaactatccttcatgaaattccaggaatgccttcctggggatttcttgctcttttcctctgagatcctttgattccatgcaaaaactgcaccctccaaccggttcatagtctcgagcacggtatgctccgtttttaaactaagagagaggaaaatttcctctatgggaatgtactctgtggttatagcatggtacaagtcttcacccaagccagctctgccagactgcaaaagaatttaagaccatatattcagtacaatcatcaattaaagggagaaaagaagcatgaaattcacagagattgtcatgaagcacaaacaagttaacttgaaatggtacttgccttaggaagagcatccgtgacagctggaggaataggtatctgaagcaggacttcttcattgattgacatcgcagctttgaggatttgatgaaccagcttagcctgaaaaacaagcctatttctctgaaattgagacaaccctatatctggcacacgaggtgatgggagccaccacttcttcgtctgcctcagaccattctttttgccccggccattagctcggctaccactctccacataccaatactctgtgtctaccatcgagtccagcacttcctgcacatttgtggcatgcaggattaggagatacaaactatgacattgcataattaagtgaacgatggtttatgaacattttttgatttgtaaaataaaatgaaaagagatggcaactttgtcagatatgcatgttcatttactagagtgtaacataataataacaaaaacatacaattagcatggaatcaagcttctgaagggcaggaaggttcacattaacatctgaacgtgctttcggggtcataatctgcagtaaaagaaacattagacacagcacttagtgaaattacaggctttattcaatggatctttacctcaaacgtgcacccgtctgctccattttgttttgtaggaaccagctcaaccatgtaggttgtaggagaaagcaaccagtccatttccttccgccacctgacttttttctcttcacagagtggttccagcttccagagttctccaaatatagtggctggcataagaaatgatcattttggtcatgatgataggagtatggaacaaatacttcaaaaaaagaaaggaaagaaagatgatagttcacccaaaaaaattctacaatggacaatatcatagtttccaaacaaatggttaagcatacctgagagattaataatggcattggacaaagccagagcagcacaaacacctctagctcctcctgaagcatcatcaccaagcagtagcttcccaaacttctccttcatggtttcaatgtctgaagcactcaaggtatacgtgattggcttcttccctttgagaggaagtagatggacagcactgagtgtatccaactcgtaaagtgaatgctcctcttgctttctcagtggatggcattgtgaagagaacgaagagctagaaacatctttacttgaggagcaacttgagacttcatcatcaacggaatcagtggttacacacccatctgctcccgttgttgcactaaggccactatcatcgtcataagaggaactgttgataatacagctctcaaggccattgtacgtcatcacccctacatcatttggtattttcaacttattttggcaagattttaaatcattcagatgaccatgcgacataaatttaagaatttccagggagcctgatcttgcgataatgaaaacggtgaataaaattagttataccgccatattacatttaaaatgcacagacatggagatcagggtttggttcagtatactctaatgtgctgattcagaaatacattttaacacaaatatttcccaacgacccaatgattcttttgaagagcacttcacaaataactcaagaaaagtctagcaattatgcactgtacaccgtaatacactcaagatattgagaaaaaaaatgcctttagcatgacagtacgagtatgccattgcaaatgttctgatgttttgccaactccatgtgcttctgtctacagatagtacagtgtgccatctgtaacgcttaatgcctcactccaccgcaatgtacaagctgataattcattccgcttccatacaaactacgctagttcaagcttgctaccactaaaaacctagctcggataagcacaggtaggcacacattaaaccaggctaggttcttgtgacaccacagaacccacaaacagacactcccattgaaagccgatagcttcaaaacattctaagtggtcccttttactgctaaccaccactgagattcccagattcccctgtaagacaaagaaaaaaggttctttatctaccctacagaaaaaaactatgttacactttcacgagatgctcacatggcgcacacgatttatagttctaaattgtagttagtcgttaagtcatactccctactcctccccaacttcctgcctgctcacattgctcagtgctcaccgtctaaaaagcagggtaccactacgttacttctttatcctccaaagtcaatgaagccgcagatgtcgcacttgacccagctgaaagtagctagctggtccccgacacacgccgctccaaaaataaaaggtactagtactagtttctactgcttgtagtcttgtactcctgcactaccactccatgaacaaacacaccagaagctaacggatacaagagagagatcaaaaacgcaaacaaaagagtataaaaatatcactaggctggtaaaagtcaagactagtgtagaccggaagcagttggatagtggcgaggcgtgaatgcggccggcgccgcccggattcgcgtcagatcaagatagcagaggccatgactcgcttgctctctcttgtttgcttttttttactcgtagagtgccgcatctttcgtgactcccatttactcccacgttcctaacgtcagtggctgatggcactgtgctgcagcctccgtcggagaccaagcacatagcagggaggagaggagaggagaggagaggagaggagaggagggcccgtgaggcatgaacagtcgcgttggtcgtgactgctcagtgccaaatctactgctgctgacaccagcgctatcccacactccatgaccctatcacgttcacatctagtactagaagaaaatatatctctgaaaatttttgtttcatcacactactagtgctcctacttctttgctgtatggattttggttgtgcgggtaaaaaaattgtgaagaaaagttaggcagctccaaatcttggccagatttggagcagcaggttgcccggggcttgtagacatgctgcagctaccatcgatccaacaactaacaactactacagctagtagtacttacaaccaactcatgcacttgagaaatgaggaccgaaatgagcaaatacaccgtgaaatgagacaatgcggcagctgtacgcacatgaaccgggcaagaacaccacgaacagaaaaagaaatgtaaaaaaaaaatgaggcaggaaaacaaaaacgggggagattcgagatttcaggcttactgtcaggctcctggtccatgtcgatgctgaagtcctgcggccgccgccggcagcacgccagcgtcttcatcctcattcccctcctcggcagccggtaccggcagtagcagcagtaactgaaaaagagaaccccacagcgtcacgatctgaaacgagcaagttacgacgctggccaccgcatcccttgcaatgaatcccgtgcagccaaagctcaaggatagcgctcgtacaactacggcggcgactggacacgagcgcgcgcggcgagaagaaagatgagacgccgaaacggccaaaaaccccccaaatctttcttccccagttggtcccggtgaagaaaaaaaaagagaaaaggtgcgcgacacgaacgacgccaccagtccaccgctacacacggcaagcgagcaaaacgcaaagcacaaaacacgcgacttttcaggttccaccaccgctaataattagcccatcaaaaaccaaaccccaaacgtagcgagaggagaagctaataaaatccacgagcagatgcggggtaatgatgcgtaatccacggggacgggtttagattagatttgggtcggatcacgctaaccgctcccgtgttgtcctgacgggatttttatggtgcgggatgagcgtcccacctatacgggtttacggctgctgccactgcccactggcccggacgcccggtgacgctgaccggtcagggcagcgaggccgaggagggccgcgcggccgtgcagcgcagcgtccggagggaggatgaggtgtttgaactttgaattttgaactggacggcggtgtgggaggttgaggaaaggaacaggacggggacgtaggctttttgttggccgctttccccaaaggtactagctagctaggcaggcagctgaagtcatggtcatgaaacaaacggaaagccatgacctgatgaagggaaagattggcgtaataaagtgggcggagctgaaaagtttggggattgttcatgctatctttttttttctccctttcttttctttcccggcatcgctgatgcttcacctgcacctgcaccaccctcgcgaggacgccgtttaccagcctagcgacaaaactggcaacaaaactggcttctcgtctactagaccattcggtagctcgctcaccgacattgcaggaagaggaaaatcgcctggactgaacagtgactcgttgaggcagtagagccagaggaagatgagaagtgttgtaccttttgcgggcgtccaaagcgaagaaatcagcagccggagcttagtcctccgccatggatcttcggcgaaggtaagtgaggaggggctcgatcactgaggtagcaaaacgaggccaagagaaggcgaaggtaagtaaaacgagggatcgatcaacgaagtagcaaaacgaagccaagatagacggatgcatggatggagaaatggctgtgcttaccactgtactagtagtaggaggagcgtcggtgaccagaggacgtgtgtgtgtgtgagagagagagagagacctcagaggcactgcactgcactggaggtcgtatggagcaggtaagcgttggtgaaatgcaagggggcagaagaagggggagccggtggagtgtgtgtgaaatggaagctcgaactgtctgactctgtcgagtaataaatgcggcaccgaggaggaggagatgaagaacagaacgcaagcgaagtggcagaggacagtgaggaggaaagtcaggaaaagtagaggaagaggaggaatgcatgtggattcggataaaatattgggccgctgcagcaacggctcgtggtggtggcatcggtccgtaccccttacgtgcatcccgatcccattcctcgcgtttgactttggtgcgttcgtctctcgcggacgggcggccacacccacacccatcgcggttcgcttgcacctgcacgcacaggagcacacggcatccaaagctcctccgctgcaaccgcgcgcggtccgcgacgctggatcgatcggcaacaaccagcgtggggggcatatcgtcattatcccccgtcgcgactgcaacgtgacaacgtgtaaccggtgaaccgtgaaccacccggcttaattcttcgctcttttcacctggccgatcacttcacgacgcactttcgtggccttttcaggccagctttttgcgagggtcagaaatctcccaaatgcgacgtatacagatcgagatgagtatccgaggaaccaggggtgcataccgacgtgtacgcatgcatgtgacccgtgtccaggttttgctacggggcgagcacacggaggagtaatgctcacttttaggatcggaatcctgaatttctgcctggctggagattggagggatatagtcgtatacataaactaatgcatcgattaacaccgaggtattgcaaatagtactggaagtgaggctacagacaaacaatattgcaaatatcgctcgaacaagcaaacatgcacgcaaaactttgttccccctatcagagttttccattgtttaccaccaaactaccccaaatcccaccattcccggatcagctgaaagtactaataatgatctactaccactgatcggttaattgtgtttcgagtactcgattagactgggggaagatccggctatcatggcacatctctctaggattatttagattccaagtcgtcttgtactctatataaactgcccataaggttttgataataaatgtacaaattatactacgatcgaagcctcatgtgtatgtacaggttcgtaataataccatcctagctataaactacccatggagggttaataccaaaaaaaacatagagtaaatttcatagagctacatgtacattgatcaatcatatcacaaaattataacttttgtaatctcaatatgttatggatataaaatataaaatgtgtagttcttaattgataacttcatcactaaatatatagttttacgatatgatattttttaaatctgtagttctgggataaatttaacattaaacctgtagttttacgatacacatagtttgatcaaagtatatgtatttatgtgaatttttttctcaaacttatactgctagtagtaaattggattcaatatagtaaaagtattgaagttgtggcgttggattcaatatttaggcagcattgtggtatatcatttgagatcaatgccaccttgtgagtagtttataactttatataaagcacaaaaaagacttggattttaaacaatcatatagagatgtgatagaaattagagaaaatcccctgtgtacccttgaaagttcacctaatcccttctgtacccctgaattttgctcaatcccttacatacccctgaattttagtttggatctcttccatgccctttccgctagttgaccgttagttgaccgttaaattcttatgaaaaagtccattttgccctttggtataaagaagcatataaattaatagagtatattgttggagcatagaaatttgttatatgagactattatgtttatgagatagttatgcaccatattatttgcgataaatatacttttagatatgacataaaaaattaatacttatttattagttattaaaagattttttttagcatatgtgttctgaagtaataaacaaatctgttgtattactatgaaaacacatatgttacataaaagaacttttaataactaataataaataagtatcaactttttatatcatatgtaaaagtaaatttgtcacaaataatatggggcatcacatactcataaatataatagtcccatccaataaatttttacattccaacaatatacttcattaatttattatgtttcttcatagcaaagggcaaaatggactttttcaaaagaatttaacggtcaactaacggtcaactagcggaaagggcatagaagggatccaaactaaaattcaggggtatgtaagggattgagcaaaattcaggggtatagaagggattaggtgaactttcatgggtacataggggattttctctagaaattaacactgtccacaatgaaaactgaatcatttctggcctgtcaactgacttttccaggtaggaggcttgcaatcatgtggagtagaagcggtgtaacgcaggccttgcttagttccaaatttttttcttcaaacttcaaactttttcatcacatcaaaactattttacacacgtaaacttccaacttttacatcacatcgttccaatttcaactaaactttaaattttagcgtgaactaaacacacccgtagttcatcagcaaaacgagaacatctagatagggaacgaagcccttgtttagttcccaattttttcttcaaacttccaacttttccatcacattaagactttcctacacatataaacttttaactttttttttaaacttttaattttagtcaaacttcctattttaacgtgaaactaaacacacccaaaccgagaaaaaatgctacagatctcatagcattgtgaatcactgtagagggtccagctagccaatgccacatctggaataaccagcgtcgtttagttctaaaatatttctttaaacttttaacttttccatcacattaaaatttttctacacacataaactttcaacttttccatcacattgttctaatttcaaccgaactttcaattttaacgtgaacttaacacaacccggatctaatcgacgacagggtgacaaagcagccgtacgactcagatttggccgcatcttctcctctgttacatgccgcgcctacgcatataattaacaacgtcataattaaacgatcacctcaggcatgaacgcttgaacgcgcttgcattctctgcaaccaacctctcgtaatgcgtccccaggtagataatgatacagccaaggtagccaatcaacacatacgcgtagcatctttgcactgcacggtcacatgcgaacgagtaccttcagacgcgagggcacgcgacgagatcgagcataaatgcatgtgtaatgcggcaacgtacgaacgattcgagtggcagctagtgcgcggtccaagccaccgctctggccgctcgcgcctagcttgtccggtactccggtatagctaagcgatcgaccacgcggagcggacacgccacacatgcaatacatgcaaacacatcgccgttttcccccatgcacggcgcagtcgccatcgggacgggagcagcaaggctctcgctccgtgcaacttagtactactgaattctcacttcctggctcgtacaactgcacgagacgccttccagctgaagcaacccgggcggctgggccgtggacaagcggaggtggggaagtggacctcgtcgtcgtcgtcgcaacgggaggatttggtgcatcgatcggcaggagcggggcgtgtctgtccgcgcgcggcgtcgtgcgtgccgggaccggagcctcaccgcgcgcgctgcgtacgatatagcgtggagttgggccggttttttatggtaactttcatggcgacatatgagaggaaacagagatcggatcggtgttgcgcggaaatccattaacgggacaggggacgggccaacggcgcacgtacgggcgttcacgatagtggctctagttggaagtgagtgacgagggcgtcaattattgtcggagatggagacttagagcttatgatctatctgtcccggatcgtctggttgcatatatggagaaggcaacaaatgttaatccaccggtcactgttactatgtcctccgaaatgaagcccggtgtcttccatggagtaggacaaggtcacgtacagacatcgagaggaatgcgtagcggctaagctgccaagtataactgcgtggccgcgtacaactgtaactcgagtgtcctgatctactcctctgccaggagaagccaaaaccagttattctgttaatttgacagcgttgcacacgctcgccatttgtagctctgcaccattcgtaggtacattcgctgtcgcgggtggttgttgcacgagttgctgtttaccttcggcctttggctttttggcagcgttgcacgctcgcctagccggccggctggccgaaccgactgatgcgcaggcaggacaacgtgctgaggaccacgggcgccaatgcaccgtgagtcgtcgcgcgggaggactcgtggattgatgaagcccggccaggtttttcatgtacctcgtcctcccggtacagtatatgggcataggggagaatgaagcctgcgcccctccaaccaggccagtgcaactgttcaaggaggaaaagtaggtgatttctctgcaggtaaatttgctcgttcgccttctccttttttaaaaaactttttttgaaaacttcgccttctcctccgttgcctcaaagtaattttggcgtttgacgttgaagcatactgaactgaatggtctgcgtttctccattagctttagcctttttagccgggtcggacgaaagaaaacggccaagcaaatttcattaagaccaggaagggagcttattagaaattacatgatatcaatagaacgctgtagagaggcgtggtccaacctcaaccaatcactagtaacctcaacatttcgcactacaggaactacttctttcaagaattaaacctcgttttgatttccctgaatagttaccatggcgtgcgaggtcgtcctttcgagcaccctagcatttcttttcttccgaatcagccaacataccaacatgaagaaggtggcaaaggattttcctatagctcgtctgaaaagcccaccttgctaccagccagaaggcaccaatcactcaaataatcctgccccagctctccaagaagttagaaagaaacaccgccttttgatagcctccaaaccctgttagtgtaggtcagtaggtgtaaaaagaaaaactgttactgtaagcacatgaaactaatagatatgcttgcgatattcttcatcaactgagatacacgagtgacaacttcgttgatgatatcaatttttttaggaggttataaactgtgaggcattttccctggattgctagccagacgaagaattcgacgtttgatggcactctcgtcttagccttgatctcaccttagcccgcccactgttgcagaaaacataataccgttcaacgattaattagaatgcaggtaatcgaagttatacgaaaatcttgtgtttgcagatatatgtatatattttataatactatgttcttctttgacttgaagattcagtccctgctctattttattaggcaaaatttgctacaggacaccgaaagattgtggcctttactgtgagacactaaaagatcgtgtatttgctcatggacactgtaaaaatatggtaattagctactggacactcctcccattattttattttttcagttgaaatggagagagaaagagttgtgtaagtaccaaaataccctttgacactgttcttcctctctctctcttcttttcttttccccttcttcctcgcggcggcccagatgtcgtcgtccaacacagactcctccgacgagtgcctcacgctgccaccgcaccgcacgaacagcatcctgacctttgtcagcctcaccatcgccatcgcgtcgtgcctcgtgccgctcatcagcaccggcgtctcaccgccagcgcggcgcacgcttggcagtgccgccgccgccgactgcgtcgttgccacgcgacgcctctggcgggacttccccttctccggcctcttctccctcgtcggtgcgctccttgcccttctcgttgacctctccgccttgtcccacctcaaacccatggccaccagcacgcggaggcgccgccgcccccaccaaccctatgttccaatc

SEQ ID NO: 69456 - DNA, 6615 bp, Oryza sativa
tgcagcaaattttgccattttatttctccgtccgtcccaaaatataaacatttctagaatagtgccaagtcaaactgttttaattttgactattaatagcgataaattaaaaaagataaatcatgtaaatttaatgttactatcatagtatgcaagtctttttatttaaaatattttacttttgtagtcatttttggttaaagtagcatttcgaagaccgtgttaaggcctgtgtgtataggatacgctgcccattgaacctggtcggtcctccttgtgtgcagctcgatctcctggacgtcgtcccacggaactaggtactcactccgtactcaccaatcgctctatattggagggtgccacttgtatatcagtatatcacgttcctaacaattatcacgctgcctttgtgccactgtaaaccttggcctaactacatgactgaacaaggacggcattgagagctggatgccccgcgccgtttccaacgacaaacagtcgaccaatcagccttccaaaagttagttccgtgccgtttccaacgacaaaccttgttgattctcaaaacatgtttccaaatccctcgctgagttgtaacattttccacggtcgatcatgatgctcaagtgatttcattagccatttttttaaaaaaatatagtacaaacacaaccactcacaacgtgcgtacacttatcatctgaacgtacacacgcacatcattcacctataaacacatcttaaaaaaaactggtcagcatgtattgaggttgatagtcactatggacgcatcgctgtgtcttgagattgatgaagtcaccatgaacgcctcgctattgatggatatatttagaacttgaacccaggtaagctaaggctgcgttcgttacctcccgttcccaacttccctcactcgttttccgcgcgtacgcttttcaaactgctaaagggtgtttttttgcaaaaaaaaaataattaaaaaaatcatattaatccatttttgaaaaaatagcaaatacttaattaatcacttgttaatcgctgctccgttttccgagccaggacaaccctcactcccaaaagcagcctaaatccaccataagaaaattaacccgttgagttacactcacttcgcctttcactagccactttaaccacaaaaccttttagaacagtttcagatccttgatgcacggataatatcagttgcatacacatggagctctatgctattaccgtccatcataaaataactttattttttatccatttcatatgccaacataaaactaaaaaaactaaaataccttattttatcaaatcgtaatgtaactatttctcactttatccactctcaatgtaactaaaataccttattttttatccactttcaatgtattttatcttctacttttatacaaactcggatgcaatggttgcttgaaaatgaactaattttatgatagatgggaggaaaaacatataatattactgtaggatagggagaggtaccaactaccaaacaatgccctcattaacctcctcctgcctcttccacaagaagactttgattggtcaccgggaaagttgcagcaccaaaagaaaatgcactgccaaagttaacaacatttcacaagggttgtcacctggatagcatctttggcttcgttccaacaactttctttggcgaggtttagtactctgggaactttaataatagatggcacaattaaaatttaaaaaaaccacaacccacaaaaaacacaatccatatttattccacgtatgaaacccaagccactgaagtgtgagggcgttgatgatacaacgacaagtttattttacgggggtttacaagacagaacttagttgctcttttgtttttattcactgaaaatacttacaaagtgaaagttcgtcggcaaaataaaagagcatcactgttcactcaaggcaagccatgaaaaaaagactcacgcatgacatcaggaaatgaactcacaattcagaaaacctataacaaacaacaaacttgtacagtttcgtgagcgacagtctttgcacttcgagaagatcaaggaccgatgcagatggcttttaaatatgctaccgagtgcaccagtaatctctacgtcgcgcctcaagttgccaaaactattatcacaattagcaagacaaccccgaagatcaccagaagaatgcagagctgcaaacaagatgatttatcaaggtagagaaatggttacaatagcaaaagcttaagaaatttgcactagcctgaacataccagtgatgaattcgatttctgagtcttggacgctttcgcgagttctgtctttgcctctttggttgctgctgcagaattctcaatgtttgtatcgatttcctctgtaataaaagatgtacgtgttaactaggaagcacaggaacaacacatgatatgtacagtgcaatgtaaaacttgccgattgtaactccttgaatatgcacaagtgtagcaagatccttaaatgcttcatgtacttcaccaatctgttgttgaatatcttgaatagcttgctccctttcctcaatgatagcttcattgaaaacaatttcattatccaattgcagcacctcttgcctgaagaaaaacatgataacttagcagagatgtaaggaaaagtgattctaccaaatcttgcatgtcgtattttatcaccatgaatatcaatcaaaataagatgcaactctttttcttcagggtcacatcaaagacagccttgtctagtcaaaattctctccatccttctctaatgtagaaaaggctctcagttcatgcgacaagcaatctgtgtgaagtaccaacatgtggaaggcaatctgtgtaaagtaccaacactgcaatttactgtaactgccacacaatctaggctcggtcaaaataatgcatggccacttggcctatgtattccagcagaagcatttgatctaacagattttaggtgcatgtactctcccaaaaagacatagaaagtgtgccaggtatataattcatgaggtgatatactgcccatgagataaatgacgtgccacgcgacttatgtaagttccatgcaccacagatgaaaactcagccacaggaagtcactaaaattgaatattttctgatgggatagaatgaaaaaacatgcgctatacgattaaagctgaccttccaccagtaagtactaaatcactagttgaaaaaataagcagaaaaagaagagctatgagaacactgacctctttgattctgcgagtagcgcatgctgttcatgaattttaccagaatccctggcttctataccacctgtagtatagctacatcatagtgaccaaaattctcaaagatattagaagataacccagtcaactctgcacatgaatacctttagttttaagataaaccatgtcactaaatgaggtcatcaggtaaactgcaagtaaaacggatggtcatgacactgacaaagagaaggcaatgtgtctttaaattagttaaattgtatgtttttacaatgcaaaataataagacccatctccatacttcaaaggaagagaagctaatggagcaataacataggcaaagttatatgacctattcaaagaaaaaaatgccaatataagctaggcagaatcctagaaggttgcagcataagcaaatgaaatggatcatgatgaacacagtaacaaactatgccaaaaagttgtgagaagtattacttggccaatggttcacatagggctagtttggtttgaaaccctatcaaaatactggtaccaaaccttgggtaaattttggcactaccaaatttttgatagcatagatttggctccactctattgatttggcaaaaattggctccaatccaaaatgctaacatgcactattcaaaactaccaaagaattggtagggcaaaaattggcaccaaaccaaaatggcccatacacaacagtatcagattattcaactttttttaagataatagaaatggtttacatctccagcctctgccgacaatcagattattcaaccaaactcttttatcaagcaatgagggcaaaggaattggttattactatactagtaactagcatggtggcccgtgcagattgcggctagcatctatattttatctcatataatagcatatatgttttctcaatttattattaaaatatattaaaatgacaacataattttaaattttgtactaactttacgaaactactaatgtgtaatattcatattgtattttatatacgtgttagttattaattatttttaatatcaaattttagttatttctaaattatattcctatatggactctagactcgtctttcaatatttcttatttttaattccaaattttcgttatctgtaaattgtatttctatatagactctacgctcttcttccaatattatttatttttaattctgattttttttttgtttctaattgtatttctatgtggtctctaaactcatctttcaatattctttaattttttatttcgaatttcagttacttctaaattgtatttttatacggattctaaactctacttttagttttattatgtttattccgaattttagttagttttaaattcctatatggactctaaactcatctttcaatattccttattttttttaattccgaatttctattatttcttaattgtatttctatatggactctatactcttcttctaaaattcttttttttttattccgaatttcagttatttctaaattgtatttctatatggactctagtctcctcttccaatattccttattttttaattccgaatttcaagtatttctaaattgtatttccatatggactctgtttttctttttctccgattaatatgagaatttctaggccgtgagagcgaacgtggaggctcctttttatattcctttttatagatagataaatagatagatttgttagaatccatgtggaagccactgataagtaacatgtgcatgtaaattaacttctacacatggccattcgtcggtatactattaaaaaccaatggcatatcatggcaggaaaatgaaacaatcaaacaatacagagaaaagtttgagatgaatcgaatgaaaagtgtacaagcattactttggctgagatgtctggggaacaactggcttatatgccatctccctttgaatcgcaagattttgaagttttccatactcctccatcgtcgtggcaaaatccttggcaagcttcatgtcagcaaccctcttgtctgcctgcacatgatacccagattcctaatcactatggtagctaagtaaactaagagcagaaagatgcatacatgatcacacatatagttggaaacagtcttgtccaagacaaattcactgggctaaaacaaagggtataaataaacagtaaattactactaacactagtatcggcgttcttgtctgcctcagcagctctcctgagcttctccttcgcatcctttgccaattgaagaatgttatgactagtcttctgcctgtggagaaatcaaccaatcagaacaccagagtgatggtaaacgacatgcctcgagggcatgagctaccaaccatcacaatttcgatcaattaacttgagctgagccaaaaaaataataataatcgcgagcatctagcattctaggacatgaaacgtgtagaggcaaacaacaattaaaggagtgaggagtgggggggagcgaggagagacagctggtcacgaagggcgggggtgtccttgggcgtcccgagcgagttgaggaggcggcggtaggaggccacggcggtggtgatctggaagacgagcgcgcgcgtggcgtcggggccccgcgccctcctgggcgcccgcaccgcgccggcctccagatccgcgaagctcatcgctgatcccccccggcctttctcctcgcgcgcgcgcgcgcgtccgatccccctcgcctcgttacgccgccgaggtgccccgcggctgcgcagggtacggcgccgggtagcgaaggtggtggtggtcctggtggaggcggcagagcggagaatacactagggtagagtcgccatcgccaccggccacgcacagttgcaggcaagagttctttattgttccatggatcaaagcgatgctacaggtggaggtggtggagtcgtggagatggccgcacagccacgaacggaacagtgtccgcccgcgggctcgatccgcggtcgcagtttgggcgtggtgcttggcatgaagccatcaactgcggaataagtccattttgcctccctcatctcttgcgcttgtgtaaataacatccccaaccggaaaaccgggtataatgcctccttcatctatgaaaaccagagcaaatcacctctctcggtggttttgctggcggtttcgtccgacgtgacgttgttgacccggttgacaagctgactcagcgtggtgggactcacatgtcagtgtgcagcgatgtcatcttggaccgacagcagttgaccaccggggagatcgacggccggcgacgcacgacggcgagccgacgaacggcggcgaggtaggagtagcgggaaa

SEQ ID NO: 69457 - DNA, 9907 bp, Oryza sativa
tttgctccgcccgcgcccggagacgccgctgctccgcttgctccggccatgcaccgcccacgctcggagccgccgctggcccgcagtcgcgcttggccgctgcttgtcgccgccgcagccgcgctcgcccagacactgccgctccgcctgctctagcgtgctgacgccgcccctccacctactccagccgcgcgctcgcccatcgccgctcgccgccggcaaagagagaggagaggaaagagaagaggagagaaaagagaagaaaaataaactgcagctgacatgtgggcctcataattttaatattttttttgctgactaggatgccacgtaagcgaaaccacccacctatactgcgaagggacctcctgtgaacggtttgaatgagtttaggtgcgaacatttctggttttgtggttgagggacctaaaaaaattctcgctgttaagttgagggacctcatgtgaacttattccgcgtctggagtacctcgcttgggcctaggccctcggtctatggatggactgaaagaaagttcagtacatgccacagacggctatttggatttgaaaaaaaaaagagtccatatttcccccctttcgccggagcacttaaccttctatactatttattcgctcattttgcaccacgaactattgaaaatggctcaccttactccctaatgatatttgtcttcttcttttctctatatgtatgtcatattttgcaattaaatttgatgacattgatatacgcattataatttatatctcaacattttttgattttttttaattgttgtagaggttggaaacactcatactaatttaaatttcaagcaaatagttttgaaaaaaaatgaaactattttagaactctgataatggtgtcatttgtggctctgcaaaatataagcttaaaatatgactcgtataaagagaaacaaataagagaaatgaaagaaccatttttaatactctctccattccaaattataaggcctatttttttacatgatctccaatgatatactttggccattaatttatttcatgtcatgttcccaatgaatataaaattagcatcacgtgaaaatataataatataacatgcataatacttggtatcgatatagttagcatgattattagtcaaaaattaccaagtttaatttttttttagaaataagggtgcccaataatttggtatggagggagtagcttatagggtaaaatgagttcaaaatagttttggagtttaagtaatacaatgaaattgtttgggtgagtaaactggacttttctctttggatttttgtgcggtagagaaacaaattaacaaatgatgactacttgccgacccgttcactgtaattttaataattgcaagggtttttttttgttaaataacatggatattgaaattttaattatatgtcaaatatgtttgttaactttcaaattaaaatagatcatgttaaaataataatccatgtcaattactattcattaattattaatttcgatttttagaattaaatacaacactaaatcaaaatttattctatatgttttctgttgtttgtatgttttatttaatatttttaaaattttaattaataagtactccctaagaaagtcgtttaggacagtgacacgatcaccaaaacacaattttgacttcttatttctataaaaatatttattgaaaagtgatatatgtatacttttatgaaagtatttttcaagacaaatttattcatataatttttatattttcaaactcaacaacttgagaattactcatgatttatattcctaatgtttacttaaacattgtcctaaacgacttactttacgagtacggagggagtatttatttgtatttgtgttggagattcaatgtactatatttcataaattaataattctgaaatttaaaatttgtaaatatcgagttgtactcagtttagacttttggagatatattaatttttatttttggtttagtgtttccaagtttgtaattggtacatactcttattttatttgaacatgtttggtagaagttgaaaagagatgatttttttaattgcatgtattgtttaaaaaactctaaatacgatatacaatcatgattccagatacaacgactaaaattttcagttaacataggagtttcctcgggaatatctataggtatagttgtgggtgttttttttttctctgagcacccaattaatatggatataaatttttcaacaaccaaataaaacaatgtgatccaatgatccattgccgtcgtctaaagaatatcggatagagtactttatatgggacctgtatgtcaaccttttgggatcagcagagtcgtgtgtcaaagatggggtgatcattgatgatttcgttttcaaaagttgtcaattttattcgggatcaaccgagacgttcgatgtgtcacggtctaatcccatcgtcttaataccacgattagattaccactacgaccaaaccaatcacaattggcgatcctctttcaactaaccccaaacagcagcagacacactgaaatccccgggttaatattgtttttttgatagcgtaatccaatatccccattgttagtaaggctctcaaccgtttctccgttcaaccccgaacctaaaatacgaggcggcggaccacggttttgctgatgtgataccgttgcttgttggcgcgagcagtccacgtcgggctgcctcttctgcttgcaaggctgacgggtgacggctgcatcgttatgcagtcaacgattgcaggctagaactcgagaggaacattttccattcttcctccatcgaaggctcgaactcgaagagtagtttaggaaaaaaaaaaaaacgccgccttgtttctccaatgtcattgtccgtccatttgacacatgcgacgcgtgacgatttgtttagcttttctgcctgttcgtaagccggtgacccatgcgaaatcgtttgcgcagcgcgcaaacgatcgtccccacgactcaagtggatcaactggcgattgggaaggcaacctagatcaacgaaccaaagagaagaaagcgagatgatggatgcgcgcatccagttggtggtggatgggcggcggagaccggagaccgaacgaaacggccagattcggatggatccgtctgccccgacgaggagaatgccgcttccaccacgccccaacgctgggccacacgcgcgcgcccaccaggccaccacccaagccgagtccacgcatcgcacgcgacaacagaaggtgaccgaccagagggcggcccaaacatccgggaagagatccattcctcacggcccccgccacaacatcgccgtcgcctcgccgtctgccgctgccacccagcgaacgcaaagacgaaaacgtcaaggaaaagggggggggggggggggggggaactctgcgaaagaaagaaagcgattcgtcgcaatcctcactcccctcccggtctttctcattcgtagttctcctttttgcccgcacaagcagcagtgcagcagcagcatacgcagtcacaaacaccggttattattggtcgatgcgtgtttcctgttcgtttgggtggcctgatgccctgatctgacgatgggtgacacgacttgggcttaaacaatggccgcaccattaggtagtgtctggtgcaggggcgaacgcgattagccatgatgtagcgtgattctttccttgcaggcttcctttcctagccaatcagccaccttctcccaaaccagtacaggcgctatccggttgaccaaaccagcctaccaacccgtcaagtcatcgacacagggatcagatcgatcaggagggcctctcatctttgccaattccatctttcttctgttctcctttcctcttcctcgttcttcttcttcttctagtatccgtgcataaaactgctaaacaattaccactattgtattgaccaatgagtcgacggggccatgtggtttggttttgtttagcatcccgtctctctcctcctctgtttccatcatcatcatcatccagaggccaccaaccctcctcgattattcagagcagccaattagtcttggcgtcttgacgtgttcggagaatttcctctcatttatatgcagtagttagacatgctctggagaagcaaagcgaggtaggaagagggatttggtcgaattttacgtacttagccgtgggcgaggcgtttacagggttgcttcggctcggggtgggttgggttgggttgggttcgatggagaagtggagcagggggctctcctgccgggccgccatctgcggcatcgtcgtcctgctctgcgccaccgcgttctcctgctccctcgccgccgaattccgcaaagtcaaggtcaggctcgcttgctcttgcgctctccgacgccggcaatggtggcgggcgggtcggtctcactcacgcccttggatctggatcatgtctgtgtgtgtgcgcaggagaaggacatgaagctggacggtagcctctgctccctgcccaagagctccgccttcgaattgggcgtcgcggccatcgcgttcctctccgtggcgcagctggtgggcaccacggcggcggcgaccaccatgtgcgccgcgtccaagcgcagcaagtcgtccaccaccaggcgccgcgcggcgtccgtcgccatcctcgtcctctcatggtacgccctatagtacggccatggctgccaaacaaagaattaatgcgtgatttctgcgagcgtggatcgctgaatcgccgcccgcggcgcgcgcgccggatgtacgcagggtgagcttcgcgctggccgtcgtcctgctggcgaccgcggcgagcatgaaccacgggcagcggtacggccggggctggatggacggcgactgctacgtcgccaggaacggcgtgttcggcggggccgccgcgctggtcgtcgtcacggcgctcctcatcctcggcctcacctccaccaccaaatcatcctcatgcgccacctcggcagcatccgccacaacgacaatccgtctcgacgcggcggccacggacgccgagcaggcgagcgggcgatcgaagcagtgacccgccggcctggccggggcggaacacgcggggcgggacgggccaaccggaggagaggcgggtggacggtgctccgcgctgttcgtcccgcaaaggccaagcggcgtgggggcaatctccgcttgctggcaaaggccaacggctggtgatgggtgggggcgggtataccggtgggttagaagatattttagctggacaaaggtagtacatagcattactgacaaaattactgaccaagaggtccaagaccgtgcaaaatgtaaatgaaaccagatcaaacagatccacgcaaagaaagtaaaggttgtacatgaattaattacagcatcttaagacatagccgagttcgaacatggtgattggtggatgtggcagagtcgaatgtgagtcgtacgatttagtcgtatgtatagcaggattctatttttttttagctcgcctatgccagattttcgtgatggttttattgtatttatatatttgttttttagataacaggagatgtattactgtagtaatatttatatatacctagcatgtgtttcttgattaggtcctcatgttttagcatgttcacttgtgctggcaaaggctggctctgtcctctatacattatctagtctgtaacagtctaacagacagcatgatgggaatgcatatgaacaattctttttggctctgtagactgtaaattccttttttttttcttcttcttctggtgagaagacaaaaatgacacggggataatatgtgatggcccccgagtttatcagtcgcattgttgcaatgagaatgacaagcacgttggctcataagcagtcgcattatcctatgtttctatcttttcatagggcaatctccagtttttgaactagaagtatcatggaaattgcagagttataatgatacgcgccgctggtccaacaatacggactattgggagagcaatgcaacgcagaaaaatgcaaacgtcatattagaactatccgtacacagtacactttatcaggtcataaagctaaaaagggtatgcaacggtgaaggggatttttaagccgttgcgggcaagttcgatgttttctttcaggttggcaacagcaaacatgttggcctggtgtgccgaaggtggaagaaacaaggcaataggattctgcatgtgctgtcattcatacgggcttgcatctggtcgtgtgttctttgttttcttgcacacaaaaattcgtggaaaatgtatactattcggtagctctattatagcatgtacaatagcatactataagccagttataaacacatatcaagaagataaaagaagagagagaaaagcagcgggctacagatttatgtgtatgataggggggaggtagtatatttattagctattaaattaactataaatgatttggagttagtagtattaaacttgctcttaccgcaccaactgttgactggtttcacagagagatacattcagttatgttgatattgattaatatcattatgagctgggataagttcatatcatccccctcaactaccacatttatctaaaagaatccattttactctaaaaccgacataattccttcccgaactcataaaactgtttaatttacacccctcatacaaactagactggttttttctatgcggcgtttacgtgaacagcatgtggtgtcgatgtcagcataaaaataaactagtagcttcacatgtgacttcttccccctccccactctccactatgtctcacgcccttactccaacgtatagatcaatgaccaaatgggccgtctggcctaggcacaaccgggcccgggccgagattagtcgagccggcagactcgacctacacatcgggctgccccgggtctatccacttgctgcaccatctgcctatgcacgacccaataagacttggatggtgtcgagctagcccaaagccacgaaagtccattgcactcttccttggataaaagactattttgcttccctcatatctttgggccgtctcttatatggttggaataaatctatttttcatccctcatctgtttgggtcatttcttgtatggctgaataaatctattttgtctctctcatctatttaactccctgatcgttggactgggccaatgccgtatcggcccatcgtgtcgagacagaggcccaggcatggcgcaaaggttgggtcatgccgacacgggatgggcctaataagtcaagcaatcatcgtgccacgtaggcgtcacattaactagaaatcgctttcaatattgtcgaggaatttaatttgtacccgttttaaaagttgagggacactccggttttatggttgagtggtgtgaataaaactcgacctatagttgagggacctaaagtgaattttatttcaaagcgtacaagaacctgaaccttgcacgttagctcaaaacctggatgtgcataaatcctggccccatcctaagggggtggctacctggcgactggtcgcgcctgccccatcgcgcgcgaccaccccccactcctcttagtatctatactatacaactagtagttactagtattactattactattacactactactattagtactagtattatttctataaaaaatatatttttatatgtatatattgttgatgtataaaaaatatacacatatacaaactttgtatacaatatgtacaaactttgtatacgtacgtattaaaaaataaaaaaaaacaaaaaaacataacgtatacaaactttgtatacgtgcgtatataaactttatatacgtacgtatataaactagtttgtatacatgaatacaaaaagtttgtatacgtatatgttaaaaaaaaccgaaaagagaaaaaaggaaaaaaaaagggggggggaaacaaaaaaaaccaaaacagaaagagaaccccaaaataacggaaaaaccaaaatagacagagaaacaaaaaaccggaaaaaaccaaacagaaagagaaaccaaaaaaaaccggagaaaaccaaacagaaagagaaacggaaaaaaagaagggcgcgcgcaactagccgccaattagcgttttcgccatcctaatgcataagcgggacattatactaaaatgtttggccaatacagttgaatgggcctcaataccgactcattcaatcgagtccttaataaagtgggtgcaatctcagatcggacccattcctcgttggaaaaagttcaatctgactccttcgatataggtcggatatgataaattcatatccttcaaccacaaaaccatatataatgtaaagcaaggtcgacaacgaatgcctgcatgagttcttggataaggcgaacgaaggcggtggcaccaccatggaggcatggagtacccagagcatatcgtgttttgctacagtcccaccgccgtcctatggaagaagtcgtcgtaccactgccgagaaggggataaacatagataggaaagtaaggagatagaggggatgacatgtgagccccattgtattttttttaaaaaaaaaattacgtgatgactaggctgccacatggatgccacgtcagtgaaaccaccaactatattgttaagggagtcattttgcatggtttaaatagttgaagaaatcactatacctagtttgcggttgaggggtaggaataagtcttgactatctttgagggactcaattaaacattttccttcctccctccagatacgctcaggacccatctcttaacttcgataggctggtgctctggcctcttcatggaccacaaaatggaataagttcaatttgactcccttaaaagtgacacgaatctaatccgtgaccctgaccctgaaccacaaaaccagatatcttgactccctaaactgttaaaaccggttcaatttgactccctcagcggttttggagggcggtttcgctgacgtggcgcatacatggcagtattgacctggttttacttccatgtggcgctgatgtggcactataatttgtaaaaaattgtgggacccaattgtcattcacattaaaaaaaaattgtgggaccctttacatgtggggcccacgtgtcatcctctctccccttccctcttttttcctccctctctcccttctctctccttctctccccacgccggcatcatggagcccagcctagccggtccttgcacgcgtagctccagaagagagcgcagcagaagtactgcgccgagcaggtgacgtgaagcagcactgccacgacgagcatgtgcgcgcggtcgtgcggccgcggcgcgcagtctttgcagtacaccttgtggatctcctcgcggtcgtcgctggtgccggggcgccaccggaggagcagcacgaggtggtggaagatcttggcgtgctggactgctagtacaggcacatgatggtgaagagcgcgttgaggaactggttgatcacctccgtccacttctttccgctgctcatcgttgggatggcggagtcaagcatgccggtcatgagcatgaacacactggtggagaaaccatctttggtcggtcgaccagattttacaatagtcccgattgtattaaaaaccgggactaaaaatatctttagtcccggtttaaaagctacagagtactttttcaatctttagtaccggttggtgttaccaaccgggactaaagatctatttgtagtcccggttaataacaccaaccaggaaaaaagatcgccatacgctttactctcagttgctgttaccaaccgggactaaagatatatttatagtcctggtggtaaaaccaaccgggagtaaagatcgacgcg

SEQ ID NO: 69458 - DNA, 982 bp, Oryza sativa
cacatagatttatactcctactttttaattttaaaatatactccatccgtttcacaatataagtcattttagcatttctcacgttcatattgatgtgattaacatctagattcattaatatcaatattaatatgagaaatgtgagaatgacttatattgtgaaacaaagaagtagcaattacgattggatacaacatatcctactactatcaatgtggtactgttctgatttctatcaatgtggtactgttctgatttgtagtaatatatatcatgtttgatgctgaggccgagtttagttccaaaatttctctttaaactttcaacttttccatcacatcaaaacttttctacacacaagctttcaacttttccgtcacatcattccaatttcaaccaaatttccagtttttacgtgaactaaacacactctttgttactctctcaatatcaaaatatagcaaatagtataagaataaacattgtactactaggttactatatttaaatataacggagataagatattttaggacagagggagtaatttcagttcggcgagaggcgacgaccatggctatatacggtccatacggagaatgcagcacgcgatggagatcccctcttgctcgtcacaaatctgaatatacggtccatacggagaatgcagcacgcgatggagatcccctcttgcttgtcacaaatctgaatgcacgagggagagagtgagtgtcaacctcaaccggattgatctaggtgaagtccaataaagctttgaacagttcgtcattataaatcccgatacgcaactactgtttggctaatttggtatttggacaactatcttacggtccagaaaaatggcaagtggcattgtggcgacctcatgttggaggatgaaagggatgtttgaacaaatctcttactaggccattccattgtttcgcttattcatacgttgattcgaaatcacttattagca

SEQ ID NO: 69459 - DNA, 20359 bp, Oryza sativa
  unsure (1)..(20359): unsure at all n locations
ccaaagaacacaggagtagggtattacgcttcccagcggcccgaacctgtatacatcgtccgtgtctcgtgttttttcctgggacgcgatctttccacacacagcgagagcttgagatctcaccctaagcccccggccgaactggcaaaggggggcctgcgcggcctcccggtgaggagccacgagctccgtcatctggcgcgccaggtagggggctcagcgtgtgttttctgagctctcagactcttccgtgggcgccaagtttcccttgttcagcctaatggccgagcaagcaaaggcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagccgcaggtgatgcaggagaacggcgagatggggagcgtcgcctcctcgtctacggcgacggcagcacgcctcagggcgcgcttcangctactggcgcgctcttacgacacccgcctgtcgtccatgacccggagtctccagcccaacgatggctggaagatgtggccaacttggtcatgacggctcagcagcgcctgggtgctggtggacggtccgccaccaccaagacctccggcgccgccaccaccggttccgtgtcatcaaggcggagggcgcggcgagcggcggcggctgcacgtcgttcggctgccactccctcgtcgacacctccgactcgggaggatcagcatggagagccggatgcccgcctcgacatcgagcgccggcgtaatagccggcgtactccccgcgcaacggagggcgcctcttcgtccagagtgtcacctcgacagggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagggtcatggcgaatttctttcccatggccctgaaggggcaagcacggggttggctaatgaacctgccacccgcgtcggtccactcctgggaagatctgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactactgcggagctttttcagctcgcggaccgagtggctcgcaaggaggaggcctggacctggaacccctccggttccggagtggcagcttcggccgcccccggatccgccgctcagacagggcggtgtgacaggaggaggaagaagaggtcagcccataccgacgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggccctccgagccgcgcgctaccagcagagcctgcggcgctatcatcagcgccacgtccgggcccgatcactctgcgtcaacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggttttgggctcgggccaaccccgcacccccccgggcgtgcatggttggccgggggcttatctttttttctcttccgtatttcaataaaagcattttcgatttcctaaaggctgtgtctatgcttttgtttccttttgaagaatcttgacttgaaataggtcactcgtgttcaatcctgccctcgggggctcgggtcggctaaaatcgccaaacggggcccagaaccgagtcgtgccccggggcgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttattcaagccaagacacagaaggaccatggcacagaccatcctcgtctcatacacagaacaaatgaaattgacgcaaaaatttcctctttatttgattgcagattaaatcagcctataacaagaagggggcctgaaggcctcggaagaagaaagaaaaagctattcaagattggcgggggcctgggggctcactccgacgcgcccgggtcaccagccttgtcgtcgctgtcatccgcaccatcgtcaccgcattcctcgtcggagtcgagggcgaacgcgaaccgaggggccgtaccctcgaagctgtggacgatgtggtcggcggcgtcccggtcctgcgcgcgtgcgccgtcctcggttccggaagggaactcttccagcgctgcccacggggagaagtcagggtccgagaggcccccaagccgaacggcggcccaaggcccccgacggccggagttggccctccgcctgcttgtcctacggtgtcaggcgcccccgaccctcaggatagcctcggggccactgcgggaaggccgcgcctgtcgccctcttaccccgagggtatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgtcaaaacccgataccctcgggcccagaagatgctatacgctattctgatggctccgagaaaagcgccatcaccatatctccaggcgaagcaaatcggctcacccagattcgtacgtcgctcaagtaatgtggcagtcttgaatagaccgcccattatggacaaccaaagttaccaataccaatatgcatggattaagaccgttgggtattttgcccaactatggagaccggtcccacctgtcaccaggctttaggggtggcgtcacacctgaccgcttcccttgggaagggaaattgctctggtataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgtttgccccggccccgagggccgaagcaccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcaagggttaggtggcgactggcggtctgacgcacgccttgccccatcccgtcaagacgaaagcctctaggcactcgtctcaagccggagctagcgtgttatttcttagagatggcacgttagccctggtaaaatgaataccaggcttcatcctaaccattacaggcaaggcgttacacgaagaagggcaaacatgcacgttgttaaaccgacgcgtggtggacaagaatgaccggtctgacactggtcgcatcagcaacgggcagccacgatcccacgttgcacctgtctccgccgggagtggaggcaggtatgggctgtcccatcaaagtgtcatttggacggcaaccataccgatctccgtccataaagagaagaaaagtccagtttggaaaggggagggtgcatgtggtatccccttgaagtaaaaaaggaggacctggcccatagagaagggttggttgattcttgagagattcagagcctagaacgagggagagtttagctcataccttgtattcccttcattcacagatccaccaaagaacacaggagtagggtattacgcttcccagcggcccgaacctgtatacatcgtccgtgtctcgtgttttttcctgggacgcgatctttccacacacagcgagagcttgagatctcaccctaagcccccggccgaactggcaaaggggggcctgcgcggcctcccggtgaggagccacgagctccgtcataatatatttgtatagagagcaagggtgagtattttttactccaaaagccaggggaaagatgacatgtttagcttagtcaaggaggctagggcttacgaatcttttaaaagagttgattcacaaaagcactagtttgtcaagttttacctattaaaaagaggctcacacataagcaaggagcggtcacccttactcctagcaacatgggaaatatagaaagagagaaaccaaagagtctttcagcaaacccaactctcaatgatgacgctcgttgcaaaaaaaaaaaaagaagaagaagggaggaagaacttaggctctggtgggagaaaaaaagactagcggagacattgccaaagtcaatcgccaatgtgtagcccttttttcctttatatctgtaaatattgttttttcctactatattcaacggtattgacacgcctcggtgctgatttgttcaaaaaaagaatcacatggctaatcattcatatgtgctaatccaatttagggtatatcaactgcttttggctcataaattagtgttcccagctcttctataggagtgcatgaaacatcaacactctagcggtactcaagccaaagctagataaaccaaaacgcagtaaaaagggttaacaattttggggaaaaaaagagagggaacccataattcaaatttttggaaatatcgggatgaaataagttgtattctaaacaagttttggtcaaatttgaatcttattttgcaaaatttcacaacattttttatgcaaattttgaacaaaatagttttcgtgtgtgtgggaatttcctttagaaacagaatttcaaacccactcaaatttgaacatgcaaaatacggataaaatgtatcttgtattcttattccacttttcatcgagtctagtacgtacttttactttacactaggttatattgaaataagtttcactagtacactaggttgcagcatataattaaagaaaaatcttgtaaaatattggtacaacttgtaaacccttttgatattaaattttatacaatttctatcaaatgaccctcaccggacctcctccttgcggtgccccgcatctccgggcaacgcgcacagtacgttccgccctcactagcaactcctgggtaggggacatccatggcgctcttacagtgccggtcatctcccaattcctactgatctaggatgcagtgcgtcctatccagctctcccggggcattgaggaacatcttgtctagtgttcgactggtgaccaatgctattaagcccactcaacctaccatgctttcttcttggggcagcgcatctttccttgcgccgatctgctctggtaggctaaaggctctgccaagtgcaagctcttcctccgacttgcgtttcagcagcgttggtggatgaccgatctcctgtagaagcgcgacatcgacagccacttggcatgtcctttttgtgcctaggagtttgaaatggcgaatcacatcctcctagacagtgtgtttgcacgtcaagtctagctcctcaaactgtgttcccctggctggcctgggctcgccccctcctagggctgctctattcaggtctggtggccatcggccagggcccgtctgccagagcatcttcgcaagggtttcgactctctcgtcctcctggtttcctggcagctatggaagaagtggaataccaaggttttcagcttctccctcttgccgtctcagcggttttagagtccatcctttaagagggtcgtctctggtctcttgctaacacagcttcttttggggatatgttgggaacataggggagttctaccccctatttccctctttataggagtagctttttttagctttgttcccatttttcagatctccttcctaaaggtctctaccctgtaccagcaagggcatgtctggccttttgcattgtgtaactaaaactctatttttttaatatactgacgtgtaattcttttgcacgttcgcaaaaaaaatatatcaaatgaccctagtgtaaagtgaaactacgtgctcaacttggtgcaaactgaaacatggtgtattttatccggtgacagaacgaagtgctatttactgttatagtgttatatgatgcaaaatcatctgaataagtaacatcttactaaaaccaaagcctacatatgccagtgtttctggcagccaaagctgaacttgcaaaatacaaaactaaataattataaaataaaaacctgcatgtctgcaccagccttttgtcctcctcgcagcaattttatcctttatgcatctcaacacttctcaacttgcagaactgaactcagcctttatttgccttatccctaaaaaagatgatgctacagacgctgatcacttccgtcccattagcctcatgcatagcttcgccaagattatcaccaaaattctggcaaatagacttgctcctcaactaaatgaaatgatctcacaaaatcaaagtgcttttgttcgtaaaagggcgattcatgacaattttctgtacgtccaaaacatggtgcagatgcttcatagatcaaaaaaacagagtctattcattaagatagacatagcaaaggcgttcgactctgtgaattggccatatctcctggaggtccttcgtcatttcggctttgggcatcgttggttaagttggatctctaatctgttttccacctcctcgtcccaagtgctcctaaatggttccccagggatgagaattaatcatgctaggggactccgtcagggagatcccctgtccccgatgctgtttattttagctatggagccttttcaccggatcattaaagcagcggagagtgccaatgtgttagccccgattggcatgagaagtggcagattcagatgttctctctacgcggatgatgtcgcagtttttgctctcccaaatcccgatgacctgaatgctctttctcgcatcctttcgtgttttgcacaaatttctggtttacattctaacatcaacaaaactgagattttccccatcagttgcaatggaatcgacttgaaacagcttcttgccggctggccagggcagatcaagaatttcccttgccgctacctaggcctcccgctccacttcaggaaattaaggaaaattgatttccttcctcttatagacaagatcggggccagactaccagcttggaaaggtcgcttctttacctctgcaggtcgtcaaaccctagttaactcggttctgagtgctatgccgatgcatcatcttacagtcattcatgcgccaaaatgggtcttcaaaagaatcgaccgtttcagaagatcttttctgtggaagggcgaagaccctgatcattcaaatccaagtgatagtctagtcaattggcagactgtttgcaaaccgaaaagcttgggagggttaggcctaccggatctggacaggttctctagagcactccgactccgctggctctggttcaagtggaaagaagttgataaaccctgggtaggcatgaatgtgccttgcgatgagatggacacaagactctttcaagcggcaacgataataacgattggtgacgaagcaaaaactagcttctggcatgataattggatccaaaaccattgtttaaaagatattgtgcccagttgttttagcctggcaaagagaaagcaaagaacagttcagatggaaatgcgagataatagatggctcacttccttcagacaattctcttccgtggaacaaattcatgatttggtacagcttggtggattactccaattggtttcgctttcccaggatcctgacgacatcacctggaattggaccgagtctggcgtctacacaacaaagagtgcttaccttttccagtttgaatgctcatttgccaccaatgagtttgattctctttggaaatccccgactgaaccaaaaataaaattctttggttggctagttctccataaaaaaattttgactgcccaaaatctgctccgcaggcattggccttgcaattggatatgttgcctttgtggttgtgcctttgaagatacaaatcatttgttcagtgactgtgtgtttgtcagacaagtgtggaccctaatttgtcaattccaaaacttgtcttcggtcggaataaatcctgtcctggatgtgtcaacatggtggtctggaaccaaatttgcaggctctaagaaggatgtgcagctggtcaggggaactcttctaactacttggtggaatatttggttggaaagaaatagaagaattttccaaaactcttcttgttcagatattgaagtagcttattttatcaagcaagctattgatatgcgctgcttggcctttaaacccccatgaattttttagctttttctgcagctgtaattctctttccattcattggcttgtaacctctgaacctatgtgctactttgtatttatttctcttctaatgttaaattccgacagatctcctgccgtcgttctccttaaaaaaagaattacttcaagagtgctagaaccaaccaatcactaacgacgattttgatctcaaatttttcaaatcaattcgcagaatcattttcaaaagtttcaatcctccctcttgttagttgttacatttgaatccttttgcagccactcgagagctagctaggagtggtcattagtaccatagaagtagttccaagttccaaatcctgagcacgtactacgcttacattttgcatgagatttaactgaattcgcttcacgcaactctctatatattgtgtttgctctagaacctgaagattttgacaggtgataccagtggttaattcgtaaatgctcagtgtctaccggaacttctctagcaatgtgcatgaatggataatattataatagtatgatatatcatctttttttaaaaaaaaacttgatatatcatctcccatgcgtaatcctctgttccagactctagtggatttaaagaatttttgtactagtggactattttctgtgtaacggtgtgtattagtgtatgtaatatcctatgatcggtgaattaagctatacattaattaatctattcatgacagagatcgagtcagggtgcaaaaaggaaaaagaaaaaaatggaaagaaacacagatgagagaactaagagaagcctaattacggttttactcctatatacgcgcgtaaggcgcaagctaaattaacgactccaaacacacgggctttacctctaatcaacatcgttaattcgatcctgattcggaaaaccgcgcgcgctctacattttgatgaattccttcacgcgtgcgcagcctgatcagagtcggatcgtgtcaggcaggttaaaaggcgagagcgcgacaccatccttcttccttcctcccgccaccaccacgagcgtccaactttcttcccgccaccgcctcctgtctcctctcgctctccatcgatctcacttccggcgagaccatgggggatttgatcttggatccctacatggaggacgcgatcttggatcatccctgcctcgccgaacttcttgcagatcaaacagctctcccattgttccatcctttctccggcggagccactccgcagatggtggataccgacaccttcctccgcgccatcggcgcgctgcctccgcttgcaccgccacaggaagctccgctcgcaccggcgccaccggattccccccgtacccctcacacctacggcagcctcctccccgtctacggtgatcatccactgctcaccggcgccgtcgtccaggagcccttgccgctgccagaaggcggcgatcaccctgtgcctcccaagaagatcaaggtcgcaccgctgctgccagagcgcgccgatcagccggtggtcaccagcaactcagcgacgacgacacggccgcagctgtgtgcgccctacgacgacgaaatcgaggccaccctacgtgccatggagacgaaccctgccgagcggccctccccgtacttcttggagacgacacagggcgggcggatgaccgcgctggtgcgcgcctcgatgatcgctttcatggacgagttcagccagttccacgagctcgccgacggcacgctccagcgcgccgcctacttcctggaccgctacctgtcggtgacgcccgagtcggacgacgcgctgcagctccgcctcgtcggggccacggccctgttcctggcggccaagtacgaggaccagtacaccctgaggaagatcgacgccagcatggtcgccgcccggtgcggctacaccagcgagacgaggcacaagatggtgtcgatcatggagaccgagatgctcgccgcgctgggcttcaaccttggcggcccgacggcgtacacgttcgtggagcacttcaccaggtactacggcgacggagaagaagaggagctgttgaaggaggcggcgcatcggttcgccgacgggtcgctgctgacgtacgggttccaccgctacctgccgtccgttgtggcggcgtcgtcgatcttcctggcgaggctggacgtgctggggcatgagccatggagccaggatctcgcggagctgacagggtacaaggccatcgacttgatgggctgcgtgtgcgacatgtacagtcaaatcgcatgtcctcgctttgctctcttccaagagtacttcttccaggattgatagccaatgtatctataggaagaacaagagtctgtaaaagcttatgtaaaaaaaaagtctgtaaaagcaaaaccatgcaatgatgcaatgcatgatggcttcaatttgtagagttcgtatgtacatcgatctataagtccaaacttgtgagttttggttgaaatatatatatgattcatcaattcaaaaaatactaacttttcgtacttggtttctgtacatcttgatcgatctgtaccgtctctcttcttcctactggcctactgcatgtacacgcattcgcgaactcgcaacttctcgtgccacctgccacgtgatatgctggtagtatctgttgcgctaggacgcacgtacacaacggctgaaccacatagccaagcttcctttttttttaacgaatcagcattcaggtgcgccaatttcattgaatatactggaggaaaaaactgtataggaacaagagatttacaaaaggaaaaggaaggggaaattattttctaaaaaaactaaggattgatatgtgcaaggcattttgttactgctagagcccaagttttggtctcctcctttattttcatagtgatggatattgtcgagagctctatgtgttcaaacactctattgtttctctccttttatatctctcatgtcgttagtagtagcagcctgcaaacacctttcctgcacaccaggtatggactgtagcgggaatctagctggtcggcttcatgtgttcttgcacattcagtttgcgagcatgcatgttccatatccttctcgtatatctacggtccacgaggaggtggaaggttgcctccaaagtgtgtctgcagtaggcattaggtgtttttttggacatcctcgaatcacttatttgtctaacgtccagtccctattatgaatcacaagccaggcgaacagcttatatttgtttgatgcccacacatagtttgtgctagtggatccaaggaacttttttttaggtggaaccaggtactcttcatgatttgtgagctgcacgctttgaactgttgcccacaggatcactagttgctccagaagctcagttgtcatggctacagtattgagaggtttaggtctcgtgaccaggtattatctgcgatgacatttctcaaggttctattcttcgttttggagattgcgtatacgtacacttgtggcatgacttccttcgggtggcgaccatgcatccaggccgagtcccgaaaacgtgatgctactccgtccccaacggttatcatcgtaatcacgaagagtattttatcggtttcatcacatggggtatccaacccaacccatgccttgtttgaggatttctatttatgacatagccatttgacatgtagtgctagtgcgaagctttctagatttagcgcgtccaggccgccatatataggcaactggtgagcatgatctttttcagtttactttgcatttcccgcccattatgttttcctgacccgctcataggaagctctttcgttgtttgtcaagcacttttatagattctttggtaaatttaaatgttattaggacatagactgactgcggggaaaacactgacttgaccaaggtggtgcgctagctagccccatgtttctttcccgccaagtggccatcgttcctgttgatttatcgaagagtggttgcaggtctgccttgcatgtgcaatctcccaacggtgaaaggtagtcccaggtattttattggtagtaatgtccgcgtcgttggtatgttctttggtacatcgtcgagatctatgttctcacacctaatgagtgccgtctgcgatttttggatgtttgtacaaagtcgagctttcggagccaaattttttacacggattgaacaaagtttcggggctaggctttctgatattgcttactcccaataatacatataatccacagtgttattagatagacaaaacaaactatgtaatttctctaactctatttttatattagatttacaccaatatttagtttgataatgatcgaattcacattcagaacaattttctctatatgctctaatcaaatccagtaaaaatctgcaggggtgcacgcacgttcatcaaattgctctgatcagacgaaagcttagcctgcattcgtttgcagggcttcccaacttccccatctcgtttggcacaattcaggactaattaatcaattaatcgttcttaagtaattttgttaatagtgtctctaccgtgttccttagagaaatagatgtattttaagaatttaagaacagtagactttttttttgtgtgttccggtgtatatggaatggagttattatcctacccaaaatggtattgatcggtgaattaatttacagcgctagaaattaattccattgcaggacagagatccagtcggagtgaagaaaaggaaagacacacatatgtgagaaacccagttgccgtttttacgcgcttctttgatggatttttcttgcgttcgtgtttgagttttgatgactccagaacgatttgaaaacattaacctgatacccaattttcttgtacccaaatttacacggacgccaaaaggaaaaagaagaaagaaacgctttcgtaagtcgacatactaattcaggactataaacaatcaactaatcatcattaagaaattacagctatccgttaatcccatcaggaatttgggacagagtcggagaccgaaataggaaaggaacacaacctaattccaggttttttacagcctagtacgggttcacaccgattcgcttggttcaaatcaaatcgatcaatacgatcccgattcggaattgcgcgcgaagcctggcctgaatcggatcgaacacccatggtggcagccaggataaaaggcgaggagcgcagcgcgacaccatcaccatcgcctcgccagtcgccaccagcgtgtgcaagtttcttcttccaccactagcctctgctctcccactgctccggcgagcgagcgagagcgaccatggattcgatcatggagccctacgtcgccgaccttctcactgacgacataacggcctcgatggtcgagctcttgtccggcgacggcggcgcggcgcagatggatgtcggggttcttgaagcgtacctccgcgccatcggcgcgctcccggcgcatccagcggcgcccggcgccgacctggccgccgccgccgaggtggagtccatggcatcgaatgatgacaccaacggcaactgggacacgaaggtggatgccaaggtgccctctgcttttcttccgccgccgccgggctttcctccgcttcccgttccagcgctggccgacgagcccgtgtacgccgctcccgtcgacgaaggcgacgctatcagggcgttcatgcagcagctggagtggagcgagcagtacaacggcgacgacgacgctccggcccccgacgactccatggcgtcgcgcccgcagctgtgcgcgccctacgacgacgacatcgacgccaacctccgtgccatggagaaggacgccgccgagcgcccgtcgccggactacctcgacacggtgcacaacggtcagatcagcgcggcgtcacgcgcctccctcgtcgcctggatggggaggctcacccaccgctacgagctcgccgccggcacgctccaccgcgccgtgtcctacttcgaccggttcctgtccgcgagagccctgccgagctacaccgagcaccagctcagcctcgtcggcgccacggccgtgtacacggcggccaagtacgaggaccaggggacggtcttcaagctggacaccagggagatcgccagctacggcgagttcgcgtcggcgcaggaggtgctcgcgatggagagggagatgatggcggcactgggctatcggctgggcggcccgaacgcggagacgttcgtggagcacttcacccggtacagcaaggggaaggaggagctgcgcgtgcagcggctggcgcgccacatcgccgaccggtcgctggagagctacggctgcctgggctacctgccgtccgtggtggcagcggcggtgatctccatcgcgaggtggacgcttaacccgccgggcgcgctgccgtggagctcggagctgcacgagctgacggggtatagctctcaggatatctccagctgcgtcctcaccgtgctcaacacgcagtgatcagccggtgatggatggataatagttacaagaatctggcaagaaatgtatttttgtaatttgtgaacacattggcaaaaaatgttacattgtgttgttcacaatcattgtctcagaaagattgcttctagatttatcaatctggattcatatggatgtacaacaaatgtaaccgtgcaatgtttcaatttaattaattcatattaatctatgttgtcaatttttttataactatttagctaacatgcaaacaacgagaggatattttctcgagggatgaaaatccatatcccttcttcgaggatccatagccaatgtatagaaagaacaagagagtctgtaaaagcacgagcatgcaatgcatgaatatgatggcttacattgatctgtaaacccaaaactctgtgtgttatttggttgaaatataggagtatgtgattcatcaattcaaatttactagattttggtagtctgatctctatatattgtatacactttcgtttctttctcctactgggcatgcattggcgaacccgcaatgtctaatgcgcacgtttggaatttcggttcgaaattcaaaccctcccctgacacaaaactatgtccgacttgtgtgtgtgtgtgtgtgaatttagcaaattttatttaaattcgatcaacattggaaatttgagcaatatttatcaaatttgaataaattttgctaacttcacaatagtttgttttgtttgaaatttatgggagggggattgcaaggtacggcgggttcacgtcggcgcaggacgtgtccctcagtccctcacggagaacgcccgtggtcgcggcgctcgactaccggctgatctgccagcgcgcccaaccgcggacgcattcgagacttcacccggtgcagccgaggagaggaagaacggccgacggcgggtgcagctcagctggcgcgcgacgtcgccgacctgtcgctgatcaactacggctgcctggctaccagctgccgtcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgttgtgacgggtcacaaccatggctcgtcacaaatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcgaaaaacctcggattgaaacatgtcctatataaaagttgtagctctcaatgatatccacaactttataactaacaacatttctattagagatcgtttacatccccgaagatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatctgatgaagatattttctatgtaaaagttataaaacacgatgagatctataactatttagttgataatattttcatttgaagtcatttagggtgttaaatatatgttaaatgattcagacaagcatagacaaaataataacattggattagtagtcaatatgtgttgagtaggtgagttggtaagggagctctatatggaggttgaggtcttgagttcgaatctcacttgtagcatacaagttatattgcgtgaaaaattgtgaatttgtaggtagtgatgtgtaaccatgtataggatggctagtaaaattcaaaatatttttttgaggttttttgttgcatttaaaattcaaaaattgtatttcttgctttgtcatcagtgacgggtcgtaagttacaacccgtcagagatgagtcatcagtgacggtcaggtagttacgacacgtcactgatgactcatctgtgacgggtgacaagttttaacccgtcagagataacttatataccggtcagagatgggttatctgtgacgggtgtttcatccgtcacaggtgattttgtcatcagtgaccactaatcactgaccaagaccaaacccgtcaaaggtgagggtttgggcccgtcagagatgacctggtccggcgtagtgcgtccgcggcggcggcggcggcggcggcggcgatcttcatcgggaggtgttcgctgaacggagctgcatgctggagctgacggggtacagctgcatatctcctcgccatgtagaacgcggtggtcgatcggttgatcgaggacgagattggtaggactgtaggagcagatatcccttgtaataaacaatgttatgttaattcgttcatcatggttgccatgcaatgcaacttgagttttttttttctttttgccccctcagcaagatcctacaatctttattaacacggcccagatgttgtgtacatccatatttgaggtatgaattttaaacttagactctaaggaatatttcttctatgttatctaaatagttataaaagatattattccacaaatatataagtcaaaactcaacttctaccaggaaaaaaacaaattaaactatagcctagttaacggataaccaccattaattttgtttttttttcaacttgtataaattgaatttgatcttgcacgtatattcgtggaatgatctatattaatctattttgtttatattttcgtattcgaatgacatgtaaataactagaaggtgtcctctagtgagtgagtttagaattgtttccccatatttgtaacttgtggttttttgcccttctgaatgtgtacaacaaatgttacacatcctttgtaacatatgcattgtttcaatttactgtagttcgttttcgttggtaagtggcaacatatatacaccattatttagtcgttgcatttcattgaggggataaaattcaaacatttgtcatggcaggagcgagataatgttgtactaatccggtaatccctgtacagttttttctctggttttctctaggaagtttctctgagctccacatttcctgtaacatcttaactgggaaaattagcgcatcatgtgcaacgaaactttattgttagtgtaggataagagtgaattagtatagttcattaatcacaatttggttgcataataattggcattgaaccagcactccagcagtaataaaccatactgcgtgactcataacttgttntaagtacatgaataatatataaatcaagtgttcttttccccctttttcaactccgtgcttgcgcttttaaactgttaaataatgtttttaaaaagaatttttatagaaattttgctttaaaatctatattaatttaattaaaaattaactaatatttgattaattatgtgctaattcgtcgatctgttttatacgtctgttgtagataaagctagattcagtcctactcattataaacgggccaaatttaggcccacataggagtttaaacggtctgaatttaggcccaatacttccgcggactaaaacgagggcctgttttgtgattattgatgggcctaattctggcgcgataagcgcagcccgagtccaccagagctggaaattccccattcccatcccaccgccgctcctccacctccccacacgtcgtccacgtccggccgccgcctgccgcgccgcgccgccggcgccgccatggccggggctccctccgtctacgccaatgtctcctcctcctcctcctcctgctcctgctcctgctccacgcgccgtcgcacaccgcgtgctgccttgcaaccgccgccgccgccgctccacctcccgcatcggccaccgtcgccctcgccgacatggccgacccggattccttcttccgccgctgccgcgtgctccgatgctctcgtggcgtggcgcacagctcgggcggcgagcccgcgagcgcgaggaggcgctggcctggaccccggaggggaggggtgaggctgtggttgtgcggcggccggagcagaagacgaagggggtggagctaagcggccgacgacggcgagcccggcggcgcgtgggcctcaatgcagctcctcggggctcctccgcctgtactcccgagcggctcggcggcgccgaccaataccccggctacggcggcggcggaggaggaggaggaggaatccctcctcgaaggccacaaggcagcgcgcgagtgggcccaggtgcacgggcagcacgaggggcgcacctgggccgtcggatcaggcgcagcagccacgttgggccaatccaacggacgagatgcgcccgctcgggccgaagacggaagctttgggttggttttactactttttgtgccccacctcctcttgcatgcaaggctttggctcctcccacccacttttgcttcgcaaccacaacaattttcacaagtcacaagcgcagcggaatcgcggagaggtgagggcttgatttgatctctctcccactctctcctcctcctcctcctctgctttcctctgctccaagacaaccgtgagatttcttctcttcttcaatgtccatgtgtttgtgttggtgatgctgttgctagtagccgctgctcttctagttcttgctgtttcgtttcgttcgccgtggtcctgtggagtacttgatcgagaccattgggtgttgtgtttgtcttcgatcttgagacgattctgtgagagttttactcttggtctggaatgctgcggcctgtgttcttgcgttggtgtgtgttgatgttgttgcggttggttttgaagttggtctgtgttcttgcattggtatgtgttgggctgcaggaa

SEQ ID NO: 69460 - DNA, 517 bp, Oryza sativa
attttgttcctgccatcttgcctcttgttaatgcacttttgatctggagctctctgcaaatgttgctgctagcttgtcccaaacctttctatagttttatggggtcatcgtttttaaaagtttcagaaaaggaaacataaacagccagccctgcagaaagaaaatttgtgtcctaaaaaactgatgagttggctgtctgatctatacctaaacattagtaactgctgacacattagcacctcttcgttttcttttggaagttatagaagaactgatcagataatatgtcccaggctttttgaagttatataatttgccattgttttggacctttggtgcaggcacgtagggcattccgtgcattaaaaggtatcataagactccaggcactgatccgaggacatcttgtaaggagacaagctgcatcaacccttcgtgtgacatggttgatcgtgaaacttcaagctttagttcgtggaagaaatgttaggggtaccgagctcgaattcgccctata

SEQ ID NO: 69461 - DNA, 13186 bp, Oryza sativa
atcggatgtacacagccaagaatactcgtttttatacgccgacatgccaccacgacatcatagaaactgactatggaaggatccttctagtcttccctaaccattcaaaccaatctaaggttggagatcccgcacatggcacacctatcaggtaggctatcatccttgtgctacgttagattcggaagtcgattagcattgattctcggttcgccctaactccacatccatcctcgccttggtgcctatgagagagctgagctatactataagtctagccattatccacactgacttatggtaagtacaataatttctcacaagagttttcgtgaattgtggtaagtgagatagtatctcaaggccattccctatgagtcttaggtagcccggcgttgcctccccctcaatggatgccataaatcccctttaatgcacaataattcgatttagggttttttgtttataataaaaaaatagtgaatattctaaaaatcatgactaaattcatatgaactccagtaaattctaaaaatgccaaaagtccaactaattataaattggtttcatgtgttgtttcattatattctaacgtttccgaagcgccattgtacttcgagatcatcgcaaaggtccaagtgtagagcaaggcaagttatactattgttcttgactctattctacgtgaattaagcaaatgttttgcttacttgaagtaagcattcattgtttcacaatttcacatgggatgtcaatgacctatatgtagttgtaagctatagttcgaatactatcatttcctcgatgacttgggtaacatgtgactagatgtttgcctaggatggttagatcaactagctcactattgggataattacctctctattttatacctaggaattaattaatggtgacactttgcacatggttcatgaggatgactaatccaactaaaagatgactaaatggtgagttttcggtgcatggttttgttgacgcatctatagcaattaaggactaattcgtcagaaacccttgtaaaatattattgtacttagcacgccagcgtgatcaatggttgggcttataatacagctcgctcctctcccaggcaccaaggtgagggtgggcatgatggagttgcgttggaccagggaacaagtcctgtcaatttctatgttcggcaatataatttatagggtgcacaagatcaaagagagatggtgacacagatttatactggttcaggccctcgagtgaggtaataccctagtgcagttggtgtagattggatctatgtcgagaggtgcggagatcagcaatggagtggctgatggcacgtgtaatggagtgtgtgagtaactcttcagggttcttgccgaagccctttatataacgttagggcttccggcggcatgcatgtcacaatatcccttataatctgggtacgtgcaatctatttacatgggattggataatatttcttatctcttatcccttcctatacatttttttttgtggggacccttcctatacattaaggatagccgcatggacctggctactcggcctgctctatgtgacacggcacaaaggccttccgtgaggtacccgggtatcgtgccctccacaggtgttgatcgacttttaagtccacagtggtgcaagggatatttcatttactttgagtcgttatatgcatgtggtagcttgatagctacttagttaaagcagtttttatccatatcatctcggaacctccggagaattgactgaaacctaaggttccaaacaattgaccggagactttgagaaataatttaatccgctacaaaagtttgtttaaatttcagttttcgcctattcactcctctctaggctttacaagggactttcagcatccacacaataaaaggtagagttgagcctatcggttatatggagaaaacattaaaaaattgaggatgatgtagagaatataaacaaaagacaaggtagaaactaactgcaagtttatatgcaaatatagcatgtctaattccctcctcatatgtgcaccacacattataatcaacatccaacttggtatgatcatccaatcttggttcgcaaacaccagaagagattgtgcatacatgagcgttttataagtttgtacactaaattacatccaactaacaaattcatatgccatcaatgcaatttgctaacaatgagtttaatagcaaaatgctatactttctatgggtaaattgacactcattttgatgtttgtccattgacaatacaggaaactattctaaactctcgagagaatatcctctcattgtttgcatgtcatccaaatgattataattttctttttaaaaaataagcaagataaattaatatgtgataaatcactccacaagcatgcaaggttaaatttaacttcaacatgttgcaatgagaaaaaaaacaaatttgactatgaatatatgttaactagcttttttttttgcagattgtggaagttaaaatttaacttacatgtttatgcagtgatatatcatatattaatcaattttcttaatttttcataactatttgtatgacatgcaaacaataatgggatatcctttggagagtttaaaatccactccattgacgatatattgtaatactagcataatgctcatgctttgctccatgtaaaggaatatatattatgacagtattatagataaaacatattttttatcgaaaatatatcagtatcacttgtttgcttattatttacatatatggtattcacttatttaaaacgagaaccctagccctagcaaaaccgggccgggctgggccgggcttcactgctttacaagagccagcttagtgaacctaataattctgctcctgtcctccttatcctgatcagtcctcggtcggcttttcctctctctctctctctctctcataaaacagagacctttaatgcgtcgtgatctctcccctccaatcccgacaaagtacacacaccatcgtctccccctcctgcctcgatgctagctctcccattcccatctctccactctccctcctatcatatgctcctcccttctccactcttcttctcaaatcctctctcttcctcttcgtcctcctcctcttgcaaccaaaaaacaccataaaatagtaatcccaatccacaagctcacctctctcttgcacacacacacacctgacacaacacttacacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatataccatggcgtgagagtagccatggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacccatcatatattcatgcaaggatcatacagttgcattccatgccatctgcataaaaatatcttattgtgtgctcttaagaatggatcaccaatttcaccatgataaagctcttgcaagttgcaagtggtagggtttggttagaatgctagagaaccttttttttaaaaaaaatgaaaatgagaatgctagagaacctagaatcattaatcaataaatcattgctttggtatattgatcgatcgatgaggattatccaccaactaatcctcatccaatgcatgcatgcaagctagctagcatccattcgatctgccactctaaataatttcttgttggttatctattgcgtacacatttcatacatcttttctctgtcaccgtatatagcttttgcaagacaaaagtttttcattcgaattgtactaccggcatgcatgcatataacctcgacaaagttcctttcatttgaatgcatatgcagtgcacggttctactagctagctagcggttggccgggcggcaaaggttgccaaaaaccaagacaaggtagcacggtagcaatcagggattgcattgggttaatccgagggtaagcatcgacgacgaacttcatcaatcaaatataatttttaaaatagtttaacagtgaagaaaaatagatctactttctacaatccagctactaccagtggcccactcctttacagtcgtgggaacacacgttttcaaatgtgggggcactcttactaatttgcagaatatgcttatatttatagtcacgtgtcaaagttccagtgggcataacactattagtatcataggagttagatagtgattttatgaagaaaaacatagccttaagttaaatagtactacctctactagcggtgacaattagtcaattagtcatccgctggtcagaggatgggttaatccatcgagagctaggaatatccttgacttgtttttaatcacctgtcaaacttgatacaaatagttaaaaaagttcaaaaacaacattgaaatatagacttcagcaaaattcaagtttacacttaatctacctacacatcaagaaaaatttgaacaaatttctgtgtgaatagcagctaggtattgttcatatatatgatgtatttgtttttttccttcctcggtgtgtcatcagtctagtttagacttgatatttttgttgctagcatgcatgtatatcttttccgcaaatacgtccataacacatttcactaaattcttattgaaagcacacctacatattcacaacattcatgtacaataaaatttgaatccgtggttgaaatcatgtacccacacgactttaccgtcacaccactagtacgtcccacaaccatacatgtatatatcaatgttacttcctccgtttcacaatgtaagtcattataatattttctacatttatattgatgccaataaatttagatagatatatatatatgtctagatttattggcatcaatataaatatggaaaatgctagaatgacttacattgtgaaacggagggagtaccaaatatttccagaacatctggaaattgtccgcgcgtcgtatcttcggagtggaggaacgtacgtacgtgggtggggattttgtaatatggagagctagcttaggttatatatccagtacccccgatcgaggcaccaaccaccaacaccaagccatccatccgactatccgtgagcacaccgaggcccccaacgccgactgatccccaccccccaccgcgaggcggcgcgcgtacgtctcaccgatcgagcgaaacgaaacgaaacgctgcctgccacggtgcatgcgcgcccggcggcccgtgcgcccgcgggatggatgggtagatgcgggcggccccgcgcgtacgtacgggacgggaggaagagatcgtacatcgcgcgagcgagcgcgaccggcccacgcgcgcctactggcgctggctggctgcaaaccgatctcgcgatcgatagcgcgcggggagatggagcgggaagcgcgtggtccacgcctttctccgccagcgcgcaagcgcaaacggagcccctgtgcccgcccgcctgcaggtgcaggggggcactgtcgcgccggtctcccccgcggctagctagcttcatcaatacaatcgcccgcctgcgcggacgtacactgcaggtggagggccggagcatgtaccccgcatcgcatcgcgcatgcatgctatgctatgctccaccaaagggtacgttacgtatatatatcagccgggcgagacacgtacgtttgcatatattttgcggacaattattacccctttggatcgatggaatttaattagtactgttttcatctcagaataaattaatatatttatagaagattggagatagattagcaacacacacacaaatgatcacaatgaacctatttaataaccacactgcattttctataatatatatacgtaaacttcttttattaggcgatgggaacggaaagatggtgggtaggagggagtatatcttcatctaattaatttgttgggttccacactttattaaaaaaataacttttttttataaattcgaatggtagaattcaattattccgggatggagctagtagggaatatgaaggaattgaatctgttggtaaaaaaaattctttgagaggcttttggatggtagggttccctcatagaaaattttgagaaactattactatatacatatatacgactcaaaccgtccaactggatttgatcaatggttgcagtgtatataaacatatgtttctttgttatttgcatatccctaattgtacatgagttatacaactaggttgtacatatagcagtactcgaaattttatatgttaggaaaaattctttcacattttgtataaattcttctagcaaattaattgctttgaaagtttcaatatacctatctctcccttctctctctctgataaatgaacacataatcttatattttctccacttttcgatcgtacgaggcatccaaataactattttgtgtaatacttgcggttttgtttcctgctacaagaaacaagttataacattttaatcatatatctttttatactaattcctgtattttaaggaacccggtttcttcgactagtgtggttggcactagcttgaccagctaattgaattggtgacacgtttgtgcatggatgcggtcattgatgaacatgaagacgatcgatcgagagactacgcgtcgttgcctcgttggggttggccacataatgagctacaatgtggtgactgcacaagtgcacagtttatgtgcgtgcaggtgggagggaggaaagaggggagagaggtgagaggatgaggccaataacgtgcgtgctggagctgtcggttgttctctgcgccaaattggagccgtcacatgtccggctgattggccgcattgagtggccttgcctagctagtggccgcagcacgtagcagcagcagctgctgcagcgccctaaacacaccagtgaagcacatgtgtcgtgcctcgccttgtctccctaatactgccactcgtttcgagctagcagcttagagctaacacatctctggaaaagtattagttcaaaaaaaaactctagaaaagtgattatgatcccatcaattaaccaagagttggttataaatcaaaacgggtggacggtgatggcaacacacccagggacatctaggaaaggagtccacactactaccctaatgttcctacttcctagtgacatgggagatctagaaaaaaaaacaaagggtatttcagctcaacgaactctcaatgctatccctctctgtgaagataaaagaagaggctagcccagatcatcccttagagcatctccagcagggacactaaatatagcccctaaacagattttggatgttgaggctaagagcatctccagcaatagctcctattttacagcccctaaaaatttaatgggggcttcccccattttctaagtacctaaaaaatatctttaactccagcagcagtcccttttctcgccccttatttcatttcatcttctattttaacatatactttaaagtacaaatctatagttctatactctagctactcctagtataaaaccataataatccaaccatatttaaattcacaattcaaattcgattcttttagaaaaaataaaatggaaatgcaaatcctagtagcatgtattcatagctcgggtgaaacgagcttctgctgctgtggcgcttccatgcattttctcacatgtgttgatttttcccgtcttctcatccaccaatagaccagctacttctctcacgaagcaacaaccaagcaaagcaacaaaaaagctgcatagcacatcgcatgtatcactttccccattcttctaagtcccacaatcgcagctgctagtgctaccctgctactactttctcaatttcgcagcctgcaacaacacttgaatcatccagtgcctcgacgccatcgcatgactcggccactgggccatgtttttcatcgagttcaggtagagggtgcaggctagaggagactccaggtacagcagacgcgtcggccgggaaggagcgttgggtagaggaatgcacctgagggatgacatggtaggcagggaggagccgcaccggccggggatgagcactgggcaggggaggtgccggtggaccaagaccacgtcgggcggctcccgcgcttttccaaccgtggatgggggctgtgcagtagagcccctgagactaggggctaggaaaggttatttgggtgcctacctaatttaggatccttgataggggctctgctggattgagttttttagcctcaacacccaaaatctgtttaggggctatatttagtgtccctgctagagatgctctaactgtttgcttggttgttgcttcgtgagagaagtagctggtctattggtggatgagaagacgggaaaaatcaacacatgtgagaaaatgcatggaagcgccacagcagcagaagctcgtttcacccgagctatgaatacatgctactaggatttgtatttccattttattttttttaaaagaatcgaatttgaattgtaaatttaaatatggttggattattatggttttatactaggagtagcgtagagtatagaactatagatttgtactttaaagtatatgttaaaatagaagatgaaatgaaataaggggcgagaaaagggactgctgctggagttaaaggtattttttaggtacttagaaaatggggaaagcccccattaaatttttaggggctataaaataggagctattgctggagatgctcttagtcttctccatgtgaatttacaattctttactttcgtacggttccttttcttccgctatgtttaatatgaaatatgcacattcgggtgccgatttgttaaaaataaataaatcaatacggtgtgtttacgatataaaataatttgtgagtaaaatatttacatatatactcttacccacctaacagtccaaattaattttataattaaattttaaaatttaaattttgactgcggttgatttctttaaggtaaacgacgagtcacatagcttagacgagatgagtgcactgtttgacgcaaattaatgcgcatgcaatcgtacacccgtacgagagggagagcatgtcatgtgatttcgagaggcctaggaacatgttggttcatcagtcatgccggggcgcatgcagaattagtactgctcggtaatttgtgcgactttatggtaatttagagagcagcagtactgcagtagtagtacgacattactacacttatttaatcgtctgactaattaaactagtgtcagtttattcagtatcagtatgatactaatgatagtatctgatctcaaggtcggcattactatgttgggagcatactccctccgtactcgtaaagaaaatcgtttagaacagcgacacggtctccaaaacacaactttgacttcttgtttctataaaaatatttattaaaaagtgatatatgtatacttttatgaaagtatttttcaagacaaatctattcatatattttttacattttcaaactcaataacttgagagttattcatgatttatatttccaaggtttgacttaaacattgtcctaaatgactttctttacgagtacagagggagtatatactttctccatcccatatactatatctatatatcctaaaaaagttatttctaacatgacagtttgtttcaaaataaaactatttctccatagcctctcctttcacccaactataaccattatttacttaatttcttcatctactttttttcttaacgaatcacaatgtttattcattattttaacttctttttaatatccgtgtttatctttaaaaaaaatacgtatattttaaaacagagttgtatatatatttttggagttcttcctaggacgtaagcatttctaaagtttgtcatggtacatgactaacgaggagagatgtgaagttaaattaagatcaatattgtagttagttaaaataggagatacagggagaaataaatgaaaaatgattgtgatcgattaaaatgagaaattaagttgatgaatatattacatagtactatatatttttttgataaaatttaaacgctagccgtagctatattttggaacgggcgagagtatttcactcactctgaatttgacctcctcatgttgcactaggtggcttttgtcaggactagctgtggcgcgcattcctcttttgaaaagataggcagggtcgacgcaggcaggcaggcgcatgtgtgcgtctctaccgaggtgacaacaaaatcacagggaaaattctcccctttcatagggatcaatgagcttaagcacacagctctcatgccgttgctgcgtccagtccttttcctctcctctgcatcatttcctttctctctgtctgcgtgagtgtgtgtgtgtgtgagagagagaggggaatctgcagagaggccacggttgggtttgcaaaacgcagacacggctgcttgctccctgatctctactgcatgcagtagctagcactgcactgcatgctggaggaacaggatgggagtaggaggagctagctagccgaggaggagggagagagaggagggcacagctttccctctactcccgtcgcttttgtggccagctgatcgatgagctgagctgagctgagcttaagccgggaagaagaacagctttatgtgcgtggtgaaatacggagcattcacacacacacacagtgtacatgtgcatgtcagtgtgagatactgagggcatgtttagatcagtttgttgtggaaaaattattttggtaaaagttttggtggtaaaagatttggtattgaagtttttctagttggtgtttagatgcatggtaaagttttatcattttactagtaaagagagatagcacggctcccaacatattttttggtaaaatttactactctagacacccaaataacaaatgttaaattgctaaattttctactagtgtttagatccattttaacaaaaagtactccaaaacagtaaaacttttgccattttagaggaactaaacaagacctaagggttgtgtgtattgtgttattgcgtggtggcagtagtacaacttctactcttacctcccctttccagtgcgtgagagagagtagagatggatactaccccacccattcatattataagttgttttgttttttctaattagaatttctaaagtttgattaagcttatagaaaaatatataatcatttttaacataaaacaaacatattatccaaatatattaaatattagttttaacaaaactaatttgatattataaatattgctaatttttatatatatatatagactaattaaaataacttataatgtaaaaaattataacggaggtggtactacactagtactcctatgttgcttgctcctgagctagctttcgacttgtcggccgctctgatcgatgctgccctttatccctctcctttctgcctcgatccgggccatcgcatgatttgcgtttgatgcaccggtgatgaccgtccaacagcaaattctggcgggcatgcatcacaccaatcgtccatggatcacttcccccctcttgcatgtcttgactgctgttcgccggtcacaagagctcccatgctggccctgttttagggaactttaaatagctacagttacttcgagaatctctaactccgtaaacaatctaagaacctgtttggtacagcttcaactcctgaatttagctccatgagttgagtctggagtgga

SEQ ID NO: 69462 - DNA, 723 bp, Oryza sativa
cattcgccctcgaattgaagaacttgtctctaaatttagtgttcgagacttggtcgaggagttcatttatcttggtattcgacctctttctgccaactggactttatctcttggtgaaattcctgagggttctagttctttgcttcctcctttcgagatatctgcgaatagtaagtgtttaccttgtatatgtattttttatttcaagcattatatatatatatatatatgtaattcatttttttcttctttttttcttctctttttttcttttttttgcagcaaaattgtgaaggacgtggatgggccaagcaagaaatatattggcccttataccaagaaagagcatggcacatatcttgcggttcagcaaggtagaaaacaaaacaggattctaagtgccctcggccaagatatgatggttcgagttcatcctgatttgaagaagaaaaagaagaaaaactcgaatatcaatccaaaagatgctgcatcttcatcttctgataatgaggagaatagcttggatggggagtctgattcaagtgatgaatcgtctgatgacagcggctcctctgagtcgagcgaacatactcacactgctccttttgtgcaagaaaactcgagtcctgctttgaagcgtaaaaagatgccttcaagttctcctgttgactcgaacttgaaaaaagttcgaattgctctggatagtgatgatgaggatgaaaa

SEQ ID NO: 69463 - DNA, 544 bp, Oryza sativa
tacagccattgccatccgccgtgatagtgcgggcgttcggtggcgcgtgcacctcgtcgaacgcatcgacgtgttaacggtaaagtaaggcatcaatcagcaggatgatgagtgttaagtcgagtcaccatcacttgcgacgatgccaaaagaaaagaaacaccgaagcttcggtagttaggagcatcaacaaaagcatgacatctcccttagctcttttccaattccaaagtccaaagatccggaggcaacagggaagagacggataagggcatcgcatcgtgatttaatacacatccaaatacctaattatcacgccgaccggatgggccaaaaggaccagccaactaccaaccccggtcggctagctcgcgagctcgatcgacctgacctccgccggcacgcacgggcggaacagcgcggcaacatggttgatttcaacgattatgcgtagcaataaacatgatgacgtcgcgcgttgttgagggcagtaatggcctatagggccgtacgtaggtggcaacaattaactgagactagagac

SEQ ID NO: 69464 - DNA, 1902 bp, Oryza sativa
atggtggcagttttcttggaggagaaggaggtgacgagcaccaacctatggtgatcttcgttgtctccttttattttcgatcttacttatcattcttctccaccttgttcctgttgttgcgtctactgctgcttccgtgtcgctgctgttgcggttcgcatggtctctgttggaggaggtggtaatctgtaattctgtatctgtccgtcttcttgcaactggatagtgttcatcagttcatgagttcatccttcatcgtagcacccgtttctacctacgcattttcttgatgtttcttttcctggcgttatcgatgtaaacatggccgctcgatgatctatatctgctcgtctctatcgtttacttattttggtatgtttttccagattctttctgcgtgtaggtgtgctttcctctctttttttttcccacactgggttttgacgttctgttgattcctcttattcttgttgattcttgatgatgctgtgcatgcggaaactcggtgatcttgatttataacctgtccgttcttgctgttgagtgccagcgagcagtgttactctgtttttcatgaaagtacttttcattcagtagatgtttacatccatagatgtatgagtctcttagttcttacttactatcaagcaatcaagttcaagccatctttatttgcagctcacattaaatggtctaacacttgatgatgtttcacttccccagtatggtgtgaagtgcgattctgttaagtagtttgttacccggcaccaggtgttactgaaatttgagtgggaaatcttagcctgtgattatttgtcccctttcatatcgtgtgcactgcaggctgctgcatttgttcttggcacaaactttggagtttttatttttgttctgaaatgctgaagccatttttcatggtcttcttaagtcttagtgaccctgatcagtattgaacaatgtttggttcaacagatagtacaatagtgtgttcacattagtccttacaggaaagaggcttctgccatgggtgcatctcccagccgtccactagaacaatcaccatcatctagtgaaggagagaatcacagagttaagtatgcctcatatactacgcaaggatttcgcccgcacatggaagatgcagtgagtaatcttgcactcttttaaccaattttatggccataaggtgtttacctgtaagtaaatgtgatcaaacaacaagcttgatttgtacctttcgtattatctagcttgcagttgaactagatctagatgcgaccacgtcattctttggtgtttatgatggccatggaggtttgatcttcattctcatcttttctaacaaatgtcaaacaattcatctgttagaccacttcacgcgttggttaaaatatcatagaagtcacaatcctctataaagaaaggacggcgtttcctattaggaacataataacagttgattcatccttcaatccttcgttctctatctgtacagtcatgctgagttttttacctttttctattcaggagctgaagtagcaatgtactgtgcaaaacgatttcatactatgcttcttgaggatgtagactatatcaacaatctgcccaatgcaattacgtctgtatgcttcaggttattttctacataattatttcatgtactctacatattttgtgcactcatgtttctcaatagtggaaaacggaaggacaagtgttcataattgcaatcattttcttgaaaatatagtaccatttgctggattagcaaacatgaaaatatgtaatcacctgccttcttaattacagacttgatgatgatttgcaacgatcaaatgaatggagggagtcacttaatccctgtgctaatcgcaattgtctcactaacatttgtgctaatct

SEQ ID NO: 69465 - DNA, 660 bp, Oryza sativa
tagttcaccaccatgtgtagttatgaatgtttttacgtggtgaagatttttgaattcttattttgagttaaatgttatgtccttggagaggctgaatctactgaaaagagagacatctgtcattccctgcactagctggggttttatagtattcagacaattatttaatttgatggtttggtatctgacaggcttaataagttggaaatgactgcaacgaccactggtcaccttatatatctgacttatactgcaagatcattcttcaagaaccatctcactaaatgaaacatttacacctgtaggaattgtgctaagatgtatcagtgttaatattgataaatgacagcaatctaccatatattatcacaatctgatatacgtttcccattggcaatgctatgtctcttccttttgtttcttctacagttttattcatattcacatagtaaacttaaatacatttttttttctctttcagggatggcatgagaaataacaatgttgttcagtttgtgcgtcaggaattacgtccggtgagtccttcctatttttctctacatatcatgaagtaatgcattaaaaaaacacatggcttttgctttgaaattatgttagcaggctggttctgtgatgagaacacgaagtgtagtagttata

SEQ ID NO: 69466 - DNA, 15947 bp, Oryza sativa
tcgatttgtggatttggaggcaatttgagaatgattgatttgagattttggggacgggatagagtgaaatcaatatatttaaaaataatgaagaaaagaaaataataaaaaggaaccggaaagagcaaccggattagcatctttagtctaaagatgggtttttacccccggttttttcacccgggactaaagatagcgatctttagtcccggattcgtacttccggttcgaaaaccggtactataggggggttacgaaccgggagtaataaccctttctccaccagtgacagcaacagtaggccagcagcccagcggcgacgaacgccaaccaaatgaccatggcaaagttcccttcacctttccatgctcctccatggttgacatgcttttgcgtacatggtgcgatgcagatggcggtgacggcggcgttgaacggactcgggctggcactgcaaatcccgacaatatacaccttcgtcgccgactccttcgacggcacgagcaggggtgtggtgtttgggttgctcatggtggcgggaatggtcggcacgatcgaggcagagtggcgcaacgcggcgtccctcgccagggcgttgtacatcggcatcgctgtcccatggtgctgtgttgcctcgtctactcgttcctgtactgagagagaagggagaaagaggggaggaagaagagagagaggatggcatgtggagcccatatgtcagtgggccccacaatttttatgggtgtgaatgacaaacgggtcccacatatatttttttaattcaaatgccacctaagcgtcatgtcaaccccacaaattaggttagcaccgccacgtcagcgccacgtcagcgaaaccgtcctccaaaaccgccaagagagtcaaattgcaccgatttcaatagttcatggtcgagatatccagttttgcggtttagggtcatggattagatttggtcacttttaagggagtcaaagtggacttattccccacaaaattcctgtgcccgacgtgttcggccggctgatgcagaggagagcccaggtttctgaaacttgcgatttcggcccataatcctgacgaaaactctcgtgataaaaaaacgtagcatatcgtatcatcgtagtttttctggtgagtgactcacgatgtctgaaattctgaatggaaaaggatacgggaaaaaggagagatgttggctgcttttttcgcataaaatattgaaacggatacgtacccggttcctggatctaagccacaatctcacaagaatcaaattcagtgaccacccccacacaacacatcggcaacgagatttttatatcagagaaatactcccatggctatctgtgtaaagattttgtgaggttgcatgcacacgtaagtcctcggcaaaagctgaagccaaaaaaaaaaaagatcctggttatctccgttttctgatgatctgtagccgtctttttggtgcgttttgatatccccaatccgcgactgtcagacggacacacaaaaatgcgctgtaaagcagatcgagccacgtatcaaccggtggtcgctagtggagcctgaggccgtagttcgtgatgactctgatctcaaatcatgagaagcctttatatgtcattaatttgtgtccccccccccccctctctaaagcgacgcgcatccagctgcgattttgtttctggctacaaatcgcgtttctttttaagtgaaagcacaagtgcagctcgatcgaccaaagcgatcgatttagcaatgtactccttaagtgaacgaattaaaaaaaaaggactgacacattagcttggatctttgcttcatgacagtatctccctcgagcaattgcatggatgcacatatcttaaactaagcgatctgaggactgtgctgtggtggcctgtgatcggaaaaaggataacaatgacagctgaatgggaaaatttttaatatggtacgcatcgagatttctgaattaaaaacaagtgaaagaaaagttgatggcgaatgcatgggtccggccttacaatcaagtccaccctgacaactggcttagtgtagcagctagcatatatatatcctcacctttgcctccgctaaaataatgaaagactcgattgcttaaccaggcagagagtgctcgtggggcaaaaagatcagaacaaaggatgatctgtcaccaaaggccctagtgtatactactgttcgcgtttgatcgggctttgagactgaccagcagctgtatcccaatctagccagattgccactaaataatagagagtgatgcaaagctactagcacggtccgcgatcgctgctccttttcgccttttggatatcattatggagtaaaatacaacgtaaggaagcacccaaggaagcagggaagcatagtagcatcagtgatgagcacgtagcttagctagctgttttagcttattagcttagcttgggggaaggcgatgtggagagagcaaccggtaggacaaaggagtacaactgtaggatcagtgcacggcgaagcgtccacccgagtgacaggggagcaaggcccgaaaaggcgaccagaaaggcagaggaaaaggagagggaggaggatcccgggcggggacggaaagcgaaagcgacggcacggcacacgcatacacatattagcatgtagcgggggtgtaagattaacggtatcgggacggccgaccaggtgcaacagccccagcagcaaccaacatcacggctatcaagttgcggcacaataccagagctgtttcagcttcccgtctcagcttttgtggttttcctctggcgctaatcacatcagctccctctgattctctctcgtcatgcgcgtgccttgaacctgcccggtttaagagttcggctaatcctgcctgcgcgcgtcgctgtctcggcctctcgccgtcccgtcgcgttccgggttttcgcctctcgcctcgcgcgcgtgcggtcgcggtcgccctctggcgcgcgaggcgaccgcggtcgccctctggcgcgcaagcgcaagtggcgcgtgctcgcgtggggccacggaacgcgcgcgcggcgccggataacggcagaggcgacgcggaaaagtcagagtcagccgtcgcgctcgcgtttcatcgacgacggaagatgtggaggggggaatagggaatcaacagcaaactaaaagcgcacgcgcgcgtcattggttgaaactggaaaaacccaacgagattacgagagaaactacctcaccggaatgctacgataggccgttgcggggtccttgaccgagccggtggtgtgcgtgggcgtggcgtcgtttcctctggtgatgagatgagatggaaagagcttttcgctgcaacagaaaactgacagatggatggaaccacgcgtcgttttggttcgcccatgctgcgtgctttacatagccagttggtcatatatcctttgctcatctcatggcaaaagttacacgtgcactattgaggaataatggaaattggaaaatcgactgtgcaaacagagctgcacacttttcaaagcaaaatttctaaagagagattccatccagaataagttaatttagtactaaatcacatccggtttctgagacggagcaagtaatctagaaattttggcgagagctagacgtaccctctttgattatgctgacgtttatgttcacaaacacaacaagctatacctattttaacgcttggtggaacagttcttttactagtacaagtcggcatggatttctttctatgagtcaattacgtgaaccgggactacgaatcgccctcttgcatgtacggtcggcattgaacttgactcctcaaaaactacgcgcgtcaattttcctgataggttcgatacaggtttccaatatatcgacggataaggtctctttaaacggttttaatgacagcggtgaaacataaccagtttgttgttatatatagtcggccactcggacagcagcttgtcttggccgtggaaaaccaagtcaactaccgcgaccttcctcatgcaaatgcgtatgtatgacttggatgagaggagaggccgagactgataggactgagaccgagccaagtacgcaacgaaacaagcaagcagcttagctatcgccatatgtgcatgtatagtcggcattgcccctgcccggtcggtagggacgacaaaatcatggttcgcctatgacaacgcgaggacgtacggtacggtgtagattgacctcgttcgttcgctcgctagtccagagctagcggtccagggggccactacctgtcaacaatcggtgctcgtatgaatagccgagcagtatcgcgaccgttatacaagcagcagcacatggatggtcgatcgatctgcgggtggcaggcgaggcgtaccgatcgaccgtacacgcacttacctggtcaggtgcatgatcgagaattcgagatacgcaacgcacggttggatcgattgatacgcagaatccgcgggtgttgatcgattggcgataggatcagcgtctggaattcgtgtgaatcatgcacggtggggcgcgcgagttgcgtgccctgattggggcgtgtagggtagcgcgtgcatgcgcgcgtacatgcgaggatgggagcgagatatatatccagatatgtgtggcggagccgatcggggtgcgggacccccccgtgccgggtgccctgggtacctgcccgctggctacgcgagggaccaggcaaccactcgcgcgcgtcgcatccgcatgcgccccaatcaaccagactctccttctctccttcttctgtttgctcgcgcgtcgtaggacccggctaggcagtacgtacgcctctcagcctctggctgaatggctggctaagatccgccacttctagcgtgatcgaatgcgcgatccatctcccctgcctcgcgcctcgtcgtgttgctgcgtacgatgtgtgccacagtgcggccagactagataccggacagagaatttgaggtcctgtggctaagctgtgcgtgtcaggggagggagtccgtcgtacgcgtgcatgcacggttctgcacggaacggaacgtcacgcgagggagcggctatttttgtagctggaccaacctgttatttgttgcgtacgtacctcatgcatacacatgcatgcagccatgcatgctgcggcagtttcacaatgtcaatatgtttgtactgtacggtgtatctagatcggccggttagctgatgatctgataatccggaacgtatagctaaaaaaaaaaaccccaaaaaaatacattagattgggtacggcgaggaaacaggatagatgcctatgtgataaaaagcgaaggatatccttccaatattgagccagcaaacaacgaacagtcgggacaaaagttacatggatgatatgtgccatactttctgcaatttatctatgcagaaaataagattgtgagcgtacgtacatagtgcgatgtgccgatgtagacatgaatggaagtcgctgtagtgcttgtacacacccaactaaagtttagcgaaacaaagattctagatatccaggagacctttcgatcgtcttatgcagacaaataatgcaacggcactaactgacactcgtaacgacctgcttcttccaacatcaacatgtacctttccatggtatattgtgatattgtctacatagacctgtacgaagacctggtcccagcagagaccgggtgtaaatgaggtgacgggggacgtaaaattcagagtctagtgccgacttgcaggggcaatttaaccactgcaatttcctttgatgaaaattctaatgcgtgtgggcgagttttaaattgaaacaaataagagtacaatgtactgcaggaactaaccggcctcttgtcacaagtgcaacaaatgggtcgccgtttaaagttacttagaacaatgctacttacactatgctgggctctcgagggaggttgggctgaaaaaaaaatccctgtcatgaacgtttaccaaactactaaatttcgtgcataagtttatgtataattttatttaaaagaatcaagtaaatctattttgacacctataataattagtattcaattcattatttgctaatcacttactccctccgtctcattttaagtgcaatcatgagtttccgtgtccaactttgatagtccgttttatttgaatttttttataattaatatttttgtagttatgagatgataaaacatgaataatactttattcgtgacttatgtttttaatttttttttaaaaaaaattaaataagatggacgatctaatttaaacgtggaaaatcataactgcacttaaaatgggacggatggagtatttgattttacgtgccactaaaattcaagtcaaactgtctccagaactaaacctaagttttggatgtgatagctttgtgggattgaaatctttagtcttttgattagagtaaatgtcataattgtggcccttgctgcctctctatcttttaaacttttttagtttgcaagatgcatgagaaaatcatgcttcggacaatgagttttcctctaacttagtggaaataaggatttcggcacaccgggtgacatgaaagtattattggtatgctatatcaatataaaacaacacactattgttgttcgttaaaaaaatattgtcgatatcaacaactactcaacacgtcaaatattgtgagagttactgacaaatatcggtttagtgtcaacagatattagatctttagatcttatacccataagtatgcatcgtctcattttaaccagtagatttgctccggtccaataaaaggtatctcgaagtatcatacctcatggtaccaaaaaaattattttcaattgttgaatctaaccatgcttatcctgtctagctaatccaacgatcggaaacgatttggtaccgtgaggtaccggtaccttaaaataattttgctggaccagaacaaatctcttcaaacagacacatagttcctcaatcgtttccttgccgaatgccgagtagtaccgacgtattcattcaagcatgcgctcgctgttggaagacacgtacggcgatctcaaatactagtatttcctgaccagcacgacgatctcaaatactagtattccaccggccagctagcgtcgggtggccgctgcgcgcccgcctgccggccacgtcgcgggcgccgactcgtccaccagcatcaccagccttatcgatcagtgccgtccccgggccccctccgccgccggagtgacattgtcgctgccacgcctgccggctcgtgtttgattgatcgggctattttattgctcgcccagctggacacgcgcgacatcgcacgcaaaacgcctggcctattgcacgcgcacactgctacgcttcgactccatcatatcccgtcggtggacgatcgatctgcgtgttacccaagttagcagcgagcaaatcgtccgtgctgatcgaaacgtgccaaaacggggaaggctaactgtactacgcagtcgcatgtgggcgcgcggggcggctcgaccgcgcgcggagcggcgccgcacggcacggaacggaagagatcgatcggtcaaggagcggtagagctgcgaccgggcgcgcggatatgcacatatgaacatccgcgcaatcattgaagacacgtatgtcctgcggccgccgtaacgtggcccgcgcgtcgatccggcgccacaacgacgcctccgcgagctccggcccccgatatttcctttagctagagcccgctttgctgggtgccgtgggctagctcactgcgaccacagacgcgcgcgcctcccggcccgggaccgcttccgcgctacgtctactacgacgacgtactatcgtgcatcccctatcagatcagatgcgtggttccacctctcgtcgaccaggacaaacaccgaagcgcgccgcatcgtctcatcaggaggtgatcgaaacgcgcacaggtgtcccgcgaccgcacgaagcggccaggagccattgatgatcccacggcggttgtcgtggagtaaggacggcgccgagacgaccggtcgcgcgcgcgccgcggcggttgattggctctgggcggctatgatgaggctatttgactatcaacggctctcgtccgcgccctgcacaccgcaggcaagagcccggacaaagcacgcattttggcgcccttgaggccttgactccaaagttagatcgcaacgtagccgccccgcgctcgcatgtgattcgtgaccgccgcgcccgcgcgcgcgccgcggtggggtgctacgtgcaaattccctgcccgcgtgccctggacggcgccgtgccagcaccgtgcggctctctcgcacgtagttccgcccatcaacctgcaaaccttgcaggctttctagcggcatccgccgccgtgcatatcctgagacgaaatggcactgcatgtatgtgcaactaggataccaccacggacagtttggtcccccaagaatctatccgaatcgcacactcatgctgtgcttcagccacttcccgatccaaattgggctcctgcccccgtgggacctgaccaccgggtctcatattcctcatagataaacttgtttagatacaaagatggactggtagctaccacactacaggacggaacagaatgcataattcacaaagggtagccccccatgcatgtacgtaattgtcctttgcctgcgagaaaatatcctgtcaaatcgcactataacattttaatattgtgcattgcatattcgtttcacagaatgctactactactgatcaaaggccaagtttcatttgttctcttacgtgaagcatgagtttgtacacacatacatgtagcctgttggtagcttgggccggtacactgataatgccgtcataattgaacgagaacaagcgatcaatatcctcccctgccggcagcatggcgcgttgcaaacgtctagaaggcaatggcctcatctgcgatgaccgatgaagaaataggttgagtatacgtttataacgcagctcattcgaaagttgtgtgagattcagattcagcatcacaactgttagactatattacgaaatgcctgccactccttttacattatattgtatactaatatagagcctcttttacatttgctcatagcgatgaggatacgttggattaagaatgaacgcaaatgatggttccgtgccacttgtccttttgcttgcatggagtcaggaagagattaggaacaaccgaacaagagggtattttcaatggtccacgtgtccagaaaccatggcagatattttgttactaatagtttccacagtagactactactacacctcctcagcgtccttccctaatacacatatactagtagtattcagtttcgagttgaaagattttttgacgggatgagttgaacgactgaatttggatttgatgaataagagatgaattgaagcacaccctcacagctgtcccatcacatgcaaaggtcaacctgtagatctgaatgcacatgcctttgaatttctgattaagatgttaacctactactagaactgctaccatccgatctttttttgcccgaatcaaaaaagagagaaaagagaaaaaaatatgcttttatttttctcagaagaaaaaaagaggggtagagctgcatgcgcacgaccatttcgcgacggactaacggtttgttcaacacctgtcattcccatcatgagcaggttaagcatttcggcacgcattcctactttgcaacctgctttagctagccgcggtcagtgataccggcaaaaattcccaagtgatgtttacttcgaaaaaatagattattcacgcatcaataaatcataaaatgagtatcttacgatggactcaggaacaatcggtagatgtgtttaccgacaaaaagaaaaaaaaaacaccgccgcaccggacaccaagtaattaagcagaacagtgttcaggccagtatgatggctggttggggatgatcagaggaagcggccaaaggagagcagcattataggagcaggagcaggagcaggagcagcagcagctgctgccggggcagtacgtagtacgtacgagagcgcgtacagtagctgatggtgtggaaacagggcggaaagggagaggtgagctggagaaagggatgattctctcgcgcgctggccagaagagaagagaggcccatttagctatcactgtattggttaaccggtttaaccgatcagttgattaatccggctctctcgcccgcacgcctttttccctttatttccgtattgattgcgcaattattcggcagcgtctatctgtctctctcgcgcgcggaggcacccagctcggctattctagcgcgtagtggtggtgctagctactagtagtagtagatttttgggcagcaagcggccgcagaaaaggagagcgaaacggaggagaaaccgggaaactcagctcgcggccaatctataaatagctgccacccctctcgcctttccctccacaccccccccaacaacaccaccgcccatttccctttctcttcctcttcttcttccttctcctcctactcctctgcgattgacaaagataagtgaagtgagcaggcgccaatgggtgcttttcttctgttcgtgtgcgtgctcgcgcctttcttgcttgtctgcgccgtccgcggccgccgccggcaggcgggctcgtcggaagcggcggcgtgcggcctgccgctgccgccggggtcgatggggtggccgtacgtcggggagacgttccagctgtactcgtccaagaaccccaacgtgttcttcaacaagaagcggaacaagtacggtcccatcttcaagacgcacatcctgggatgcccctgcgtgatggtgtccagcccggaggcggcgcggttcgtgctggtgacgcaggcgcacctcttcaagcccaccttcccggcgagcaaggagcggatgctgggtccccaggccatcttcttccagcagggcgactaccacgcccacctccgccgcatcgtctcccgcgccttctcccccgagtccatccgcgcctccgtcccggccatcgaggccatcgcgctccgctccctccactcctgggacggccagttcgtcaacaccttccaagagatgaagactgtgagttcttactgcctaactcctcttcccactctgctttgctctgctctactctgctttgctgatcgatccgatgtgtttgttgttgatggcatatacaacagtacgcgctgaatgtggcattgctgtccatcttcggggaggaggagatgcgctacatcgaggagctgaagcagtgctacctgacgctggagaaggggtacaactcgatgccggtgaacctgccgggcaccctgttccacaaggccatgaaggcccggaagaggctgggcgccattgtggcccacatcatctctgcccggcgcgagcggcagcgggggaacgacctgctagggtcgttcgtggacggccgcgaggccctcaccgacgcccagatcgccgacaacgtcatcggcgtcatcttcgccgcccgcgacaccaccgccagcgtcctcacctggatggtcaagttcctcggcgaccaccccgccgtcctcaaggccgtcaccgtaagttcgcctcctcatatctcatagtatatcaaagtccttgatggtgaggctgaccgcgggtgccatggatggaacaggaagagcagctgcagattgccaaggagaaagaggcgtcgggcgagccgctgtcatgggcggacacgcggcggatgaagatgacgagccgggtcatccaggagacgatgagggtggcgtccatcctctccttcaccttcagggaggccgtggaggacgtggaataccaaggtgagcagcagagcagagctgtccggtggcagcctgtccgtccctttcgagacagcctcgcgcttctcttccgctgcgagtgaactggaccgaatggggcagactggttccttaactgaaatagactaactcgatcagtcgtcccagaatctaacctcgttcgatcgtctgctctgtgcagggtacctgatccccaagggctggaaagtgctacctctgttccgcaacatccaccacaaccccgaccacttcccctgcccggaaaagttcgacccgtcccggttcgaggtcagcatcacgaacccactcttccgtgtttttgttcccttccctccctttcctttcccggtgcggccgacttcctagccaagtcggtccgcggtttgcgagcagtggccggtatgggttttcctgaccccgcgtccgtcccgtcactgttgcaggtggcgcccaagcccaacacgttcatgccgttcgggaacgggacccactcgtgcccgggcaacgagctcgccaagctggagatgctcgtgctcttccaccacctcgcaaccaagtacaggtggtccacgtccaagtccgagagcggcgtccagttcggccccttcgcgctgccgctcaacggcctccccatgagcttcacccgcaagaacaccgagcaggagtgaaaaccgaacagggagacaaaaagaagaagaagaatactagcatcagctaagctggggaaagctggcaaaaccaacatcaacggcgggcagcggcgccacgcagcgcgcgcgagtccattttcgcggcggtcaccgtccggggggacacctgttggcgccgcagtgggagcgggagaccgaacggtggattccgtattagcacggatcatcagagtccttgtacagattcttcagctaggaccacggttggcaatcgagaggaggagcagaggagttgatgaaaaaaaccaaacactacgtagacatctgagctagggagcgccacaaagaagtggcccttaattgtaaaaccaaccattttttatccttttttgcttagttttttttttggccaacaactataggagaagagtagagaagagaagagaaattggggagaaaatacagggaggatgaagaggccctgattgggatgtaagctaggttgcccgcctgaaagcaggctggcatgcagatgcagctataggtcgaataatcgaggcgagcgatgatggacggatggatcgattcatcgatcgccagagtcaaaagggaagaacgtcgtgatcccccgcgggctaagccaggccacgggagagcgactcctctgtaccgtttcgtccaactcaagagaaaatgaccttcttgagaaaagtattgaattgtccctatacacgcgcacacaggaattgctacccagcaccctatattgcagttgagcaagcgattttttcgatcacttcttgtgtgtaagcatgcatgcatgcttccaataaactaattctaatctgcagcgtgatccataaaaatatcggttggactttgggataggatactacccgagtcaaactgatggaatgatgcatattgtggatgatgagttcttttaaaactaaactaaaactatctgttgcctctctagcactggaagggctagctctttgtaccacgtctgtgatccatctccaatcttaaggttctagaagctaactttggatgccaatggcatgttcttgattctttttataaaaaaaatgaatatggaattaggagatgattgaaatcaaattgttactcttggtctaaatgttggctccaaaacaacccaaatgcactatgatggtttaacccttcaaaatatttcattttgttaaaaacaaccataatggccaacaactactaagattgtagcgggtaatgttgctcccattgggcacggtggcattggtcaagcgtcgatgaattaggccaaggtcgcgtggaacaacaccctagggaattgaaacaacaaatataatgttggcatcacatagaattcaaataaaatgtggttaatggagttatgaaattcttccatcgtgtattcgtgttgctatacaatcatatacgcatgggagattggatgagaacaggataagtatttttcacctcggacgaacacatgcaatttggttcccttgatagaagttccagttgatttatagaggtatcaaaaatggtttacacttaaactcacctacttatccgtttaccatgttagctgccaaggggtgaaatcaagtttggtacgtcagctcatcgtatttccgtatcttagcccatattttctttcggagttagaaagtatggatagagtcaataatctatcactcagtaactcgtatcctatttcatatttgttgtttagataatagtaccacatatctatttttctctctaatatcatccccacgtttcaggtcgggtgagtggatgggtatgtggaaaatacttatcctgttttcatccaatctcccatgcttatatgaactaacttaatcaagttgaaactgagcttttctagtgaaacaacgatgaagtttggatgataccataattctatccctatcgattggattagactcccctaactttgtgcagtttacagttgtgacactgatatgacaatgtgagaggatctgtttccctatcgattcgcccaccgaatctcaaattaaacatggtgttgacaattttcttgggatgaactttggaagcgccgtagtacgtacagcggtacagggttggtgaccgagtcgagtgattgacttttggagatggaaacaagcatacttaaaaaaaaacagagagacgcttaaaaaaacagaggtgcaaagagccaaagagagatgcagaggaacagagcgaaagcgaagtttccaggaaagcggaggccgaagtctcctctccctctaatggcgagacagatggaaccctatcctctgtgccaattattcagccagccgggcaggcaggcaagcggtcacgagcccggcattattcagttgcccatcgatggaattcatggatggacaccgatgtggtattggtgagtgaactgagcccaatcagtgacaggcaggaggcagctgcgtgcgatagcgcgcgcccggccgggtcggcttgcaatttggcctttgcctgcccatttttttagtcactgcgtgcgcgcgcgcgtccaccgatgatccatctggaaatgtgccttttactacaagtatgtttcggactttcagtgttcgtgtgcgcgtcatgcatgcagggggggaggagacgctcctgctgattggccgctagattctctgctcttctgctactggctaatataatctcttcctttcctagccattcccgggctgacacgtcagcactggtcagccaggagaggcttgacgagctccccgttttgcctaatcccatgtgctagtgccgtactagagactagagttacgggttgtcaaccgtgtgcatgcacttgcaatatagtatcacccatggttgatggttgcatgtgctggaaggtaagagcttagtgttaatgcagtacttctggtataatactgtaaaaaaatgggtgtacacaccggagaaaacgagtgggaggaagaatgtgacaagaaagtgaaaattgcagcgaacgtattggttaaatggaggacaaatggctacaccgggtgtttttaggaacacgctatttagttatgttgttgtcgcatgagagttacatatagtaattttatagatggcagcgcatgagtagttgctaaccatgtttcttacgtggcgtgaagtttgtgtcataagatggaagtgaacctttccacttccacacatcttgcattaattattgatcctaccatatggttcgttcctttttattaagtgacatagaggcagcctctttgagatgtactttgcggaaggtaaattatgtatataatgttattcacattcacagtagaaaagtgcacaccaacaaaaggaaaagaaaagttaatgcccgaaggtaatgtaaagagacaatccattatatgccact

SEQ ID NO: 69467 - DNA, 1203 bp, Oryza sativa
tctccccctcacctccccacatcaaatccactccatttgaactcatttttcgcaggattttttgtggaaattgaagagaaaggtagactcctccattcccccctcttttttttcgtttttattggttgaatttgtagatcgaagggtaaccctagaaccccttttatgcccaaatttgtgatttttagcatttgttcttgggatttacttgttgtagtgctacatgtttgcaatgtacgcattggtgtcacgatttttttaaccatatatgtggtaatgttaatttttggattgtttggttggatggatggatgaaaaattagggttgaggcatgaaagtaattttaatttgatggacttgatgctatagcctataggttaaacttttaacaattaattatatgaaggggagaaaattttggttgcattatagaaattgattatagttaattagaactaggttgggttgtatgacggagtatttgtaatatttcgatgtataatgcactagtaaacttgttgatagttgtaggtggattaaatattttttttggagtagtagctttgggacaaattaagttatgcattggttataatatgtcggtttggactacgtttataaatgaatatttaatttttgttgcaaagttacatttgattttttggtgtagatggatagacttgttcgtgtttactacggtggtagagtggtggaaccttatgttggtgcacatgttgagttttaggatatgtcattgaagaccattttgtttcccacccacccaactgtagatgaactaaggtcacgagtgaaacaagttcttggatggaccgaggataatgtgtagattcgtttttatgggagatacgatgttggtcaagggcataagtatatattaaatgtcataggtcagttggaatgggaagtttactttgatttggtaaaagagtctcagtttagatctctataggtgtttgcatcaaagttggtacgtaccgtaaaaaatttgaatctaaccaaatctccttcttatcattacgttgagaagaattttgtgacatattcttctcatcgtgaagggggtgcaagtaagactgagttggtacgagaagtacttggagggggaagaagataagaagacccctttgcttggaaatgatttaggggaggcaggatcatcaaagagacattccggtagtgat

SEQ ID NO: 69468 - DNA, 1201 bp, Oryza sativa
atttgaaagtttttgtctcaggggtattttggtcatttggatgaaagtgtacagtactaacggagactaaccggatggcggtggtaaatcgtagaagttaagcaaaaatcgatggcatattatagaacgtgataaagtcagtggcaaattgtagacctatgacaaactcagtggcatacaatggattatctctaatgtaaatgaagaagaagcgattacagcgcctatcttaggcgtgctactccactagctagctaatgaataaaaatgtagaggcagtattctctctctggtttggttttagttgatatacatatactcatccattgtagtacctctctctgtttgggcacggtttggccattgatttttcacataataaacagggtacaaagacaataaggtggcaaaatactttatagtacgaatgtagcagcatatttttttatacactaaacaaagttgtaacttaactaattgttgatgaaattctatgtggtttgatttattttgtttttaaaaagcatgcatgccatacataagagtactgcctccatgcatagatatttatatgcaacattttatttggaaaaagtcttcaacatcacactttaaccattggtttttgatagaaaatattagtcctatttataaaaaatcctttgaaatatgaatctatttcactaaaagtatttgtagtttgactaatcgttgacaagatccataaagtttgaccttttctctaaacgaaatgtatcttaaaaaagtttacagcgggagcacctgaaatttttacattttggtcctttttgaaaacttattttacaaataaacccctgggaaaacttaaaccggaaatggtcctttttggggcgccagagtggctggcgccgtaccccaacatggtggtgccacccacactggcgccgtgcccgtgccaccgtggcactagggctgtcgtggaggtgctgactggtcagaatatgggcgccagccacactggcgccaccccacataccacggcgccaacatggctggtgcgccccttctctgtggaccgaccccttaaaccctgtgggtcccaccacctttctcctcaccagtcccattttcgcccaagaaaaagcccgagctgagcagcagcagctctccaccctctctctccccctcacctccccacatcaaatccactccatttgaa

SEQ ID NO: 69469 - DNA, 509 bp, Oryza sativa
catttcccattgtgaaggtcagaccatgttacatgaaatcttccattcacatgcaccatcatgtgttcaatgttggtcgtgattgttatcatattgaaactagatttgttgatttattttttgggggtaatgctgactagctgagacaatatgggaaaattatcacctcatgtcatgtttcaatttttaatatgatagccatagttatgagtacaagcatcttctcctttttcatatggttctgtttatattacagtccacatcagcaagcattttctttccatatgtgatttgtctttagccttaagcaaaaaatatgcactggttcagtggtttatccaccttttacgcttttgtgctagcattgaaataatgtctatctttaattaattttcaggaatgggagaaaccaaagcctgggaggaggcctgatatcttcccaaaattcagccctatgaaaacaccattgccccattcattgccagctgatgatcctctggatgatgatg

SEQ ID NO: 69470 - DNA, 7291 bp, Oryza sativa
tcccatcctaggttgttttattttgggacggagggagtattgtagcacttttccggtggtatgttgggaaaaaaaaacatgaactacaacatgtttttagaacatatttttccgtcaggaataaactaacaagactaagtttccacaaggaattaggtcaaatttaaggatgggcgtgggtcactgactggtgcatttagttaattttgttgaactagacaaattcatgacgatcaagcaaccaatggaacttctcttgcaaagttgcaaacggaacttttctctttttcacaccttagagagctatatctccaagggaacagttaagatgaactataaatgggccatcatgtacataacacacgttaacctttcttttgctcagaactgctttgtgttacattggtctattgacaatctgacacgcttcttccatggattccttttctacatttcctaatatataaactatatggttgttaaggcgggtaaggcgacccacccacgccttactagttaccactatagtgtaaaaccgctaaggtatggcgacaccataacctaagtgattagcagcatcagaagagagagagaaagaaaactcaggccagcccaacaaagcccaataacgttcataccagcccaaagtcaaagaaataaccctaacacccacaccaggtacacactctctcctctcaaagcgctgcctccaatgtcacttcttcctcacgcctgtatcgcttcttccttgtgctagctctgctcctctatctgtgctccttactcccctgattcagaatgaatccagtgcttctctttgtatgtgctccttcccttggatggatctaatgctgctcccttgagtcaagatgaatctggtgcaggggagagaagaagagaggaaaccagagctaagggggagcaagatggcgatggcatggagcagagaaatgggaaaatggtgtagttgctgcttccttcacctcttctccctctccctctctgggttatggcattaagcccttaaggtggagggatgccttaacaccctcagggagccctagagctatagcgacgccttaacaaccatgatataaactagagatggcattattatcaagtatcagaattctgttgaacaattctaaagaaatgctaataaaaaatcgtaatatatttcttaaacctcaagattgtaccatagaaatatttgtggattagataagttatgagcacttcagtttaattgataacataaaattgcacttgcagagctgaatgataagagaggtgaaggcatttgggctcggttcaattatctaagaaagtgtttcacgggatatatactctattttaaaaccaggatactggccatgttccattcgtataaaagacaataaaaatgttctaggttgctaatgcatgcattgatagtaacaagtccaaacatttctcacacggtatctttacatttcggaaaaaacacagcttcaagcgttaatctacaaaaaataactagttaatcaattttatgtcagttttcaaatatttaactaaccaatggaaagatcaacttaatttgctgaattagtaagtattttcccgtctccaaacactatgcgtttccaaatgttttactacctttgtcccaaaaagagttcacttttagaaacgaatctgggcatgcctcttgtccagattcatgtataaaagtgcagtctttttgggacagaggtagtatttattaaccacaatgacagaccaacatgcaagagagagaagctctcgcaaaatttctacaagacatgttacgaataataaatatggaccacaacttaggaagctttgtgcattaacgtaccgatcaggcagtggatccacttgagaacgataatatggaacatcagatggagccaaatggcggtagtatgcatgtggaacatgctgaatctctgggatagaagggccatgacgaggctctagggcatgcggcacaagacgaggctctatgtcaagaggaacacgctgagactcgcgtgcaacaagtgtttgctgataatgtatgtggggaccatcatgagcattagacaaagaatgatcaatcctataatccactggatgtggatcaaagcgtgttgccctgtataagtctttagggggaggaacatgcatgacaggcaaagaagatcgtctttcttcatattgatgtggctgtgtttttccttcatagtggtgcatctcttcaagaggcttctgtggagctggttgaggtacactcacagactcaaatagagctattagcctatggacctgcacaatatcatgtaatacataagataaagtaaatactaacatctatgatttgttcttttaaaactttctgttttgaacaaaattcaaatgacactcacttgtctagagttgagctcgggattgaacttgctctttgcactatagttctctctgattgcatccttaaatctgctctcaggaagtggaaggcaatctttatctatcttaaatttcacctgtggcgagctcaagcacaaaaaatagttttgagtacaacgaaaatatcaaatcttcaacactaactactctagatgaagcccattttcaaacagaaggttgtgtggaatcttgtgcccatgaattcgtgcttgatcattgaaagtagataacagtccaaatatgcaattgtgaggtcttaaaagttgtgcacggaattggcaatggtggtcctaatatacatgctgtacagtcttatgtaagaaccacttgtacaaactttcgtgactttccatcatatggtttcccagatatggtaaattccaactaaccaatggaagtgcagtaaaaacaaatcgaccctcacagagttacagttatatctgaaatgacaacttgaatataaaccaagcatcaaagaactctatggacataaatggtcacaagcaaatcctgttattaagaaacaggggcaatgaatgttctcttagcagtctatcaaatcattcagtcacattacttacagcaccacctgttttcttaattaaagcaaagatgaatatagctagctagtatatctacatctgtttcaacagataaccaatgcaaatgcacaattcaagttacagctgatgatgatgtctaatgcatatgcatcaatcttccgaaaatggaaatgcaatatgtatcgacaacagggttattttgttctcagaaacagtgtgaaccagaaagataccatttctactatcgccaatcataggtttgtgtacaaaaatcattggtgcaccatagtatcaatcaatccccaaaatagtatgtacacccttaagtataaaaacataaaccccaaaaaaccatattcacttcctctttaaaaaaaacattcacagcatatgagtttgtctacagcgatggaataccagaattacctgtgcagggaattttccactgaatgcatctcgaacaagatcaagcccaccctttgatactgccttgtacaccccataaagtagcttcaagtcaaaatcatagaggaacaacctcatccctggtcggatcttctcaactattccgattttccctctgggatacccaaacaagcggctctgaaagcattctggtttagtctgcgcattacacatgaatataagccctcctcccttactgtcaagcctctcttccttcttgcttccctcctcctccttcctcctttccttcacattgctagtcctctccccagcaatctctctttttctcttcttgatggcatcaccatcgttgttatcagcacctacaccattcttggtggcaactacagcattagcattagcattagcctcagccagctttggttttagctttagccttcgctttggcgttgatgcttcagccgtagctgccgctggcgtcgatatcacccgagctgctgatccatcggccacagtagctgatcgcggagccggggctgcaggcgatgcatcagcattgccaccagcagcaccaacggatggggaccctgaagcggcagcagctgctgcagccttcgccttcgccttcaccttattcaacctagatgtcttcttgaccgatgcaggggtggaagggctccccttggatgccccgtccgcatcagccaccgcggccggtcgcaaagccggagccgcaggcgatgcatcagcattgccaccagcatcacccagggacgcggcctctttaccagccgcagcggctggcgcagcagccttctcccggctagccttcgccttcaccttcgccttccccttgaccaacttagtcaccctgagcgatgcaggggtggaagggctccccttggacgaccccccatccgccccaccggcggcggccgccttgaccttggcggcgacgttgggcttcttcatcgtggttgacctagcgtggaccaaatggggggcaaacaaacgaacgaaaacctatcatcaaaagctacaccacgcgcgcatcaaacgaaccaaatcgggaaggaagaacaaatcgaatcgatcccaactccggattggatctccgacgagggagggctacgagagagatagagatgaaaaataccttcgattcgattcgattcgcacctgctcgcgggcagcaggggagaaggcgcacgggcggggaggagaggagcaggccgaccgaccaccggtttgcccccggcccctcgtcgccggcgacgtgcgccggagcgaggcgaggcggcggaagttttccggccgtgcctccgccgggaacggcgtttctcttcgcaaacaagggttacgatagcgcaaacggagaatcgaagataaagcgagacggagagaggggtggaggtgtggaaggggaaatgctttatgggcctttatttccaaattagtaaatttagcacattttagaaaactttttttcttcaactgtcaatttccttgaacttttcgtttgccttgctagtaatgggtatatatatgccacaagtaggatgactcatctaaggccatgttttttcagcttgggattattataatccagattattaggagtaagttgaaagaaacggataacttattgaagtagcttattataatctagagcccagcttattataatctgataaactcatttaggtgagctttttctagattattgagtgaaaaattactcaccatgccaccccactccctttttagacttgcaaactcaataatctaggctctaataatctggaaagaaacaactaaccgcttattctactacagattataacaatctagcttatagtaatctaactcaataatctagattataataatcccaagctgaaagaaacagggcctaagactcttatatctacatatgtacttcctctgttccattctaaaattgcacggtgaatattaaaggtaaagtgtttttcaagcaatatagtttttctttaatatgtcaagctacaatttttgccaaatgctaatcttgataaaataggtatagcttcgtgacatttattccgattaatggatatcactattaggaacactcactaagaacctgcataaatagtaataagtggtttttaatggagtatccgccaataaatttcccgccaaagtctacctcctcactagctaaaacctcatgcctatgttatgcaaatccgatcaataatattttttttacctatctgaattacaacaccttaacatcataatgtcttgctcatattgatgttgttaaaagagaaaaatgtaattgatgtttgtagaatttgaagggtattcctgaagatcaatgtcaaacataataagagaggtgacttgtttggacccctaagaccgccaaagagagatgccattcattctatcctaagaactaaaatcctagtgtgcgatgacatagtgacgattatcatgttgcttaagagcataggaaattatacgaatgagtttgaatatatggttagatgttttctctttgctatcacttgttggtaaaccggaggaatgtgaggaatccaatggtataaaagccctacaatttaaagcttgcggcacacgccaaactaactgatgaataaagtacctatttggtgacattcaaaaaattttaacattcatgaggatattttcaccttcgcatgaattcacaatctgttaaccaccatcatcattatgtcaatgacatgagtgtgttgcacaacttattttgggcaaactaagatttaagcatcaatacatcgacaattatctcaactgaaattatgaaagaaatagcaatttcgtaacaaaggaatttgtcatgtacataaacatacataaggcaggagatggagcggagcttgaacaataaaatgaaggggccaatatgtaagtttctttgaagtataggctactatactaacataacatgtgacataacatgtgacagattatagtggacaaacttcccaagccccaagctaacaaaaaaaatttcttcatcagtatttctcagaatatcctttaaattaattaatttttcaactttcaaatatttaactactttatttgtgcgttcctataattgtcataacctcagttttattcctcaaccatcaatactctacaagcatggcctttaacttcaagcagtcatgggcatcaggttgacatcataaccaatcactttggtagaatccttttacagtcccatactcccatcctgattcagcactgcagaaaaaggggaaaattagaacaacattgcatcatctagctgaccagctctaatccatcaccgcacataggcaatccatgcgaacatgtgatgcagctttccatattttcttcgtattactcaaaatattgactagccacttcttggcaaaagaatcacagcatgatcaaatacatatttctcatggacagacggcagctggtgagtccactaagggtgagtttgaggaggaggagattgagaagattgggaagatacaaaaaacgaggtgagccattagcgcatgattaattgagtattaactattttaaatttgaaaaatagattaatatgaatttttaaagcaactttcctatagaaaatttttgcaaaaaatacaccgtttagtaatttggaaagcgtacgcgcggaaatagaaacaaactcactcactttcttcagctgccgaacgcagcctaaagattgagatggcagcagctgataagagctagcagaacagaaagctgcttcatgtgtcatactccctccgccgcaatatatccaaacttatagtactaaactg

SEQ ID NO: 69471 - DNA, 1057 bp, Oryza sativa
gacggtgaacgacggcgcacgggggtgggcgggagggtgcgccggggcgtgcggggacagacggtggacggggacgggatgctgcggcggcaccattcatcgcagtcgcccaggtctccgccctcgcctccacggtcgccgctcgcaccgccccctcacccctgtcgcaagtccggtgctagccgtcactcccctaatcgcaagaggacgaggccctaatagtgagcttgacgagccggccacctcgccacctcctcacctcgcctcctccgccaccgcctcgcctcctccgcgccgcccgccgcccggcgtgccacatgtcccgccggcccctgcacgccgaccgcccatccacgcgccgccgacgccgcccactgcccgttcacgcatacccgagagagagagatagagagagaggggggagggggaagagaggtaatggcaggtgggccctttattttattttatttctttttgctgattggatttccacatcggcgccacgtgtatgccacgtaggagaaaaaccgctcaggattgagtccggggggtaattcatccggtatcaatagttcaaggtgtaatatgtctgattttgtggttcaggggggtaattcgtactgtcacaagagtttagggggtaattcgtacttttccttttctaaaaagtgaatttcattctagaccatcatttggactatctcttaacctgtatttttccctttagactatcatttcttaccgtttgtttcatcttcaacctcattcttcttctccaacttcaacatgtcctggtttgctgataacttataactaacttgtgaggagattagcagcttatatctagctctatgccaagaaatagataggagagctagaggacagtaagggtccaaaatctatactcctttaaaaaggaatagtggtggtggtgagagctgaatctacaacctccaccagtaccaactccctaactttttaagagatgtagacaaagaataatggtaataacgaggttaatggtaattttcattgattaaaatcctattgcaacgca

SEQ ID NO: 69472 - DNA, 7653 bp, Oryza sativa
agctcatctacgtggttggtcggggctgaataacacatctttgccttgtgaatagccttacaaaatttcttggctccgtcattatttgtatgtactatcactgtctttcacagtcacttcatcttccattttctttttctgaaagaactgatcactgttctaccttcactctaacgaagacaagaccagtctgatctgacggaatcttttggttgaactagaaaagagaaacgctagactatttcttcgacggcccatgcatggcaagcacgacatacacgaacatacgcgctgaacaaccggccgcttccgttgggtaggaagaaaacttccaagctggccacttggccagtggacagcaccgcatgcactacgccgacttgaccagtttatcaagttattagcaaccgtatgaaaggagcatcttttattcccttgtcccacttactaagacgcgaacgcatcttaagatttaactctttaaagagttaaatcttatttacatatttcatatttcatcaataaatagtttattataaattaaattttatttgatgaaaataatattattaattaccatttaaatttactttcatattattatgattttgttgctataaatattatagtatatgagaaatttaaagtaaaaaaattagtctcgaaggctatattaagtttgaccacgcattagtaagtgggacggagggagtactagattgactggcatccctcgatcagtccaccctccatccgtcataaaatctaacaacatgtattgtttaaatcttgtagcaaaatatatagtaacttctgcacctctatctttcatgtaattttctaacacactttttcatcttgatcaatcatagccatcctcgatcttttccatgtaactttttataaaataatagtgtactttattaattgggaatgaactgcaattgttttccgactcttaaatacttctctggaaagtacaataaaagttgtagtaggagttaagaaaaaacctactccctccatcccaaataaactaatctaggatgtgtttagttcacgccaaaattgaaagtttgactgaaattaaaatgatgtgatggaaaaattgaaaatttgtatgtaggaaatttttgatgtgatagaaaagttgaaagtagtataatgaatctggacaggtagactatgtcccatctaaatagtataggttggacttttttttacggagggagtatataacttaccaacacaacctatatggttgcaatattttcccgagcacacacaatactaaagctcatgtacacactgctataggcccaccgttctcacgcatatatacgaaaatgctcctatcacatgctcaagagctgaagagcaatggcaatcatatagttctcgaaaaagaaaaagcaagtcatatcatccgacctcatcgaaattaatcctatatactccatagatagtagtgagaggaggggaaattaaatgacaaaactaagggcccatttgaatcataggaatgaaaaaattgaggaataagaaaaatataagattctgatagaaatacaagtgtaaaacagatgattgcaaaacacaggaacgactgtttgattgatccataggaaaaacaagggaatttgaggagagataaagactcaaaaggattctttccatgaggttctacctcatgttaaatttcctccaaaacttacatgagaagagatattccatatgaatttcataggattcattcctttgattcaaagcgctatataggaaaaatttttataggaataaaatcctctataattcctatgattttcctttgaatcaaagagggcctaagaaattatacaacgagatgagttattagcgtatgattaattgaatattaaatattttgaactagaaaatgattaatacaattttttaaagcaacatttatttatttttttttaaaaaacacaccgtttattgaaaaatgggatcaagatcccattgttctcctaaggacatccataggcataatgtataggagaagtggtcattatagtttcatatggcctacctcaccattgtaggagtagcccatataacagtccttatatatactgagctacctatataatataagatcttcatttagggaaaaacataacaataatttctctcctctcccctctcctctctcacatggttgttgattgagtgagaccagtgagactcaggttaatccctcctcctactatatatattgtagcaacaatcttatctaatgtgtgaacccactttataacaaggggtattatgcattgaaagtgccctaagtacgcccatgtgtaccgttcaataaaaaaggacgatatgctactcttttcggtttcgacaaaaggacaatatggtgatagttcagcttctctccatcggggtggcggcggctggagggtcccctcacgtacgttatagctgtaagcatgacatccagagggaagaggagacgaacaggaggaggtgtggattgatctgatgtgcaaaggagcaagaggcgtcatcgtatttagatgtggttaatacggagtaccccttcgtaaaaaaaaaactaatcataactagaattgggttttttatgggacagactagtaatgcatcaaaatgtctaaaacccctcttaagagtggtatggctaccaagcgagtagcattttaacggaacccaacgcattatcttttcctccctcattcataagagactaaggttgtgttcgtttcccctagttgaaaactaatgccgtgcgcacagaaaatggagcggtccattaacatatgattaattaagtatattagctattttttttaaaaaatagatcaatatgattttttaagtaactttcttatatttttttttcaaaaaacacaccgtttagcagtttgaaaagggtgcgcgcagataacgagggatatgggttgggaaccctgactaaagaacgcagcctaaggaaagtcacgaaacactgactttatccggcgcttgccattttggacctaaacactattagcaaaagttggtaatttggcatttatcatttactagtatagggtagcaaattttgccaaaaaatgctccgggaccacgcgctctctctttttaatgctaaattggtaaaactttaggatgcatctatacaccaactccatgctaaattttttaccactaaaacttttttgccatttaccatttatttttgaaactaaaccggcaggcagaggctgccaattatattttcaataagcaggagtaaaaacctagacgagttacaagaaaaagaaaacaaaggatgctattgttgtcggccaaacaagttcacagcacgcacaacaactcaacgctacaacccactcaaaatagacaatcgacggagcccaaacacgagtcatcgttgccaagcttgcgcaaaagcgacgtagcagctccgaccttcacttgaaagcatgttatcattgccaagcttgccaaagcaaaccagctccgacttcacggcaaacttgtgtcgtcgttgccaagctcatcacagaaacgaccaagcagcttcgacttcccatggtgaacatcagccaaatccaccgtatcaccgcttcctgcttgttgttggcaccaacacacctagagagagactgcaacgtgttatcgttgccgagcttcatcacaccccatcaacaaagcagctccgactccacctagcagaaacaaacaaggccgttggccgcctgctacaaagcaagaagcagatccaataaggcaaaggcctcgccgaacattcccggcctattgagcatcagtgtgaaggtagaagctacggagctaacgccaattccacgatcgggcatgtgcatgaaaggttctccaaacatcactcccaacagagacgcgatgttaatcaccattgccgctttcccggaacgtggcaaggttttcacccggagcacagtggtaaaagaagaaagggaacacatcgtaacgatgcctcaaaggaggggaacggcgccgaaggcgtcgccattgtcaagccggccataagacacggcaaggctttcgcctacggttccctatcctctcctacacactgaaccaaatcgcatacgaccgtcgaaaaatgccgcactgccccgattcaccgaccctccgacgaggcgacgagccgacgaccgagcaccctggagctacctcaccgacgggcgcagccaaccacctccaccatcagcactgggcgccggcgccgcagagccgccccggctcctcgcccgacgccgccaccaccaagcacgccggtggcattcgtcagccgccagcctcaccgtcggccagccgtgtcgtcacccgcatctcccgcgccacctgccgccgccacacgcgccagacgccgccttcacgcgccatccgccgccgtcgcccgcgccgtcgtcggcaccggccagatccggcggcgacgggccgaaaccagccgtgggggagccaaatccggcggcggcggcgccggatccgcagccacgcgccgcaccgccgcacggccttcccagcgcgccgtgtcgcctcctcgtgccggagacaggctgtcgccggggttgtggccccgccgctgccatcccggcgggccacgcagtttccggcggcgcgctccggcggcggcgaggcgggggagaggaggagagggtggcggcggccgagtgttagggtttcgcccccggtcgcccgcgcgtggacaatagggggccgtccgctcctccacttgctgtccatttaccatttatcattccaaatggatataaagatgcctttagcgcgcgtacgtacgtgttgtgcgtgtaacaaggagttctgacgttaaattaatcgcacgggcctgcatgccactggcgagatgtccgttcatacggctaacttagtcatcacagtgcactccgtcgtcgctgcctgcaggttgacccgcctcgcggcctcgatggaccgcaactaatccccccattcccccctaccccacgtttgcccccgcacgaatttcaaagcaacctcccctcgcttctccgctgcccccgcgtctaaagtccaagccgccggggtggccttgccgtccccttatatatacccgtgccctccggcctccgcttcccgtccccctcgctctctcacccccactcccactcccaagcgccaagcacctctccgccattgatggacttgtcgagctccaaggaggcgacgcctcctcccgagtaagccctagcaaatcgatccccatgttgtacgatttgaatttgattattgcggcgcgcgcgctgatgagatcgagaaatgttttcgctcgcggggggcatgcgcgcagggcgtggtggacgggggagacggtggcggtggtgacgggggcgaaccgcgggatcgggcacgcgctggcggcgcggctggcggagcaagggctggccgtggtgctgacggcgcgggacggggcgcgcggggaggcggccgcggcggcgctccgcgcgaggggcctccgctccgtccggttccgccgcctcgacgtctccgatccggcctccgtcgccgccttcgcctcctggctccgcgacgaactcggcggcctcgacatcctggtgagtccatccatccttcagatccatccgctacccgcttttcgttgtcggtttcctccagctacgatgtttcatctttcaaatttgcggatcgatgcatagatagaatgatcgatagatttcaaaataacctgaaaattgtaggctgtggcagtgtattattggcaccaaccagtcaatcatgcatgtaccaaccaacctatctgtataattgatcggctatacgtatcattctcctagccatttcacctggtaaaaattcaaaatcaaaatttacatcccaccctggcttttacccgttctttccagagtgtggctgcctaagctacacactttttgtgtgtgcgcgcgttacactttaattaggatcgaaagtaacgtgctttacttgccaaagtatgtgacaggcaacgaaagcctggctagttttgcttgccaccacactccacacctatcgagttaactcacactgcagcaatagtgaatgtgaattcatagaacgctaaagcaaaattggccagcttcctggttgctagagtgtgatccatctgacactgttgttgtgtagtcaatgtcgccgttagctcttcggatgggatgtgttccccttttatatgtcgcaggatataaaatttttttataaaatagatcgtgacgagagcacgaagctggtccaagtcatggtcattgatgttgacttgatattacgtagtatatcacgctcttgattgttttgataattgcatcaccattttgcatttgcatatatgccgtcgctgtcctgattaaggtccagttttcttctctccttcggagaccgaccaacttaggcagtcaggtggcgtcatcattcacttgttatttggattttcgattgcataatactggccactgttgacttttgtgggagcattctaaaaattgcggtcaatttcccttacttgcatatgtgcacagcgcagatttttcttaggtgaagaatagtttgcccttttgtatgacgagctaataatgcagcaattttttcaccagaagctgaagtataatgagccaaggcaacatttttttctattaagatttaatggcctttcaaggcacttaattaagtactagtagcaagctaagctagccgtagctgaaattccagtacagttttccgtagagtcagattaaaattatttgaaagcaaaattattgcatgatctgctatagaactatttcgtctattttataaatacaattttagttcttataaaaaaaactatattggtcaatatacactattacaatactgaccaacaaatgatgtagatatttatatttttttcctcgagtagcgtgatatatagtagtttttggcctcctcttcttaagaaatagattaacacataattatctaaatgcaaagtacatgaattagctgtgtttaagcctcttgattagttcagtagcacaccaggacgaccaggtcaaacataaacaatataaagaagtataaagaactagtcctcatgctgtcattacgcatatatatacaaatacgtacatgcttccatgtctggctaggatttgatttaagctaataatatttaagcatcgaccaggcttggatccgcatgatacacgatccaattttaaaactagcacactcgaattaacaagagaaaagatccagtgctgatctatctagattggttatacatcttttccatgcgggccaatgcaagtattctacgtaaagctgataaaaactattaggaagcccatgtcttccattccatgacgatggaacagtactgcagatggagctgttctctgaagtctaaacgatataataagctagattgcaagctaagctgtggcagttgctacattgattgaatggtatccaagtttttttaaaaaaagagatattagaatccaagtcattacactaattcacactaaattattgtagatgcctagctgtgcaggtcttagttatatgtttacgttgacgtcaagaaaa

SEQ ID NO: 69473 - DNA, 637 bp, Oryza sativa
tcagggattaaaagaactgcacaaattaattaagagcagaggccatcggaatggataaccttcggatatataagaacaaaatgattattaggatttccatgtgagattagacagtggaagaaaatgatatttaaggataattcaccaggaaggtttcaatcatgaacaggacacgtgtccccatggagagagaccatacccctctgaccctgtagtccaatcccgggactaattgttcgtagtctaaatatgcttaatacggtcatattccaaagctagtgcagtctaatcgctttctttattctcttatcaattgccgcgttcttcaaacatgggcgtgttagtgatttggattgcttcaatggtaggtgaccgtgtggcacgccaaacctgcaaaatgtgggcgaaaaggacgtgggcatttcattccggataacgaagaccttgatgaacattgttgactccctgtctggaacgctgaaatttttgttattttttttcttattcccatgtgaaaattgcacagaacatgtgtagatcacagagctagaattgctgtatacaaatattgccgaggtgatagttctggatttcacaagttgcaggtagatcagaaaatgcagttgttctgaaatgg

SEQ ID NO: 69474 - DNA, 4902 bp, Oryza sativa
  unsure (1)..(4902): unsure at all n locations
attcctgcagccctgaataaaatactccaactattagtgcagtggagaaagatatgggaaacattgacaaaataaaatgtcactggatatataactctttctcctttttggatagatacaattgggagataagtttgctataaataatacaggagcattcagctatagtttccttccaatagactgccacatactctattactctacaccatgatggtccagtacagtttagctaatgaaacaatactatcataaaccagcaagaaaaatctacaagtttctgcccagcacagttgtaagaaaatgctacaaaggaaaattttgttacagataacaaagaacgctcacgtaaaattctcctggccagtaaaacaacagcatatcagtggtttcctcattattgggagtattttttttaacttccttcatagaccaaagttgcatagtgtcaggaattccatttcagtgtcaacatacttggtccagagagctttgtactggttcaacgcaacatcaagccacggtttcatattcccattaaaatgtatcacagcagcaccagcgataacctcaggactgatgcttggattatacccaaggcccattacatgccatgatttgtcaagcggctttgtattgccatagaatgtcatcagcccagcaggtagaacagatgtgggatcccaaagcacaccatcctcattctgccatgaaaataatgggtcatacattcatacacatatcagtgccttggtgagtgcaaacgcatgctagtaagatgcaaaaatagacaactatgagatcatttgcataactgcatatgtatatagtatattacacaggacaggacaaagtaggtcaagataacatgcaaacataaattgtatatcggggctgttattgttttaattactacacaatggccaatgaacacaaaaagcttagggctcagcaaaaaagtatcacatatgcatggcaatagaaacctagtgatgaattcatcttgtgttttgtggaacactagttgagaagtcaagatcatgaagcgctcaatcaggcgactattatacactaactgacatgattggttagatccttgtttacaagatttagccacactgtggttgaatcggctaaactagaaccagtaggtttgatgacttggttcacaattatagccatacgtttcaacatgaaaaaccagcagtgtataccttcatgtctatatctctatttttttacttctctcccttcatatctctacatctctcaatcttcaacatttagtggactaagcaacacaatacttaggggctcaagaaatatctataaccacatcgtgcaatcgcatgggaaattcgctagttgataaacttttacaaatgtgatacatttctgattatccatacacatcattgatagtagctaattggaatagtcacccaagagactacataattcttcgtatgtcacagaaggaatgtattgccctataatttcctataccaaatgcccactcaggttatttaaaaattgcaggaaacatcaagatacctgaatcgcatgatgatcaatcacaaaatatcttaagaacttccatcgagctagtgaaactgcaaactaaatgcatatgcacaaccaaatggcacgaatcgaggagattgggcattgagcataactataagcggcagtcgcgtatcaaaccaaacgcactccaatgctactcatatatgttatatataaccggataaaacagaagcttaccatttccatgtactgatggaacagctccgtgcagccatcccttcgccatgcctcaagatcatacacattgaccccatatgcccaagcacatgcgccaggatcgaaccgctcctgcacgatggcctgcgtgaagttgagatacttgctatatctcctgaatccaccgaagcacatctcgacggcaccattcaccttcccatccaagtcgagatgccagagcccagccaaatccttctgcaccaccacatcatcctccaggagcaccaccctctgcagtgccgggaacatgtctgggaggtagaacctcaggtaatcgagcaatgccacgtccctcttgccggcctcgatctgcctgagcaccggcgaggaggtctcgttgaggaacgggaagtcggagtaggcgaggagctggacgtgcacgccgagcggcggcgggcggcgggcgaaccagacgcggaatgccggcaggtacatgggcgcggtgaccacgtggaagacgtggcgcgaggggtcggccgcggcgcgcgcggcggaggccaccacgacggagacggcgagcacattgtcggagaacacggcgtagtggtacagcgaagggtcgtcgaactccggggacgggtcggggtcgtcggcgaaggcggagggcttggcgaggcgggcctcgaggaggcgcatggcgaggcagtggagggacttgggggtggagcccgcggcgatgcgggaggacatgcggcccgcgcggcgggcgcgggccagatgctcgccgacggcgaacaccgtgtcggagagcttctggatcttggactgcgtgtcgaacccttccttggcgtcngcggcgaggaggcgggcgagcttgatgcggtcgcgcgcctccttctccaggggcttcaccgcgtcctccgggagggacaggtgggaggcgaggcgcgacgagagcgccgacaggtcggacgacatcgtggcgaaggacagcgnntcnccgcccnacgcctccttgagcctccgcgcgtgcgcggcgtacgcggccagcaccgccgcgtggtccgccgcgtggcgtcggatggcggcgaggcgggacggcggcgatgcgccgaggtaggaggagcggtgcgaggcgtgcgtcggaggcggcgaggataggaggaacgagagcgtcgccagcaggagcagcgtcaggagcgccgcgaacgccgcgcggcgcggcgccgacggccggaacgcgcggccgccggccatcggagcagtggaggggagggggactggagtgggaagcgcgtcgcggatctgagactgatgaaggagacgggtgggcccgcggtgtcagtgggcgcggggtcgggtatcccggcgtaaacagtgggtgggcttgtcggtgaggttagatttactaggttatttgtttataggatgttattattggtggattaagtcgtgggtttaattaaggtggggacattattaatcatttgattaactgactgactggtgggggcaccgttggattcatgagaaggtgattcgtgtcaatgacatgtggggctcgttacattgggtccacttgtcagtgaggtattaagattgggagtagttggtttaggtgggagtatgcatgggagcaagatccggccaggctggatagatatcgggagtcaagacagacattctaatcgcaattttagaatagatcaaattcgatcataagattagttctaaactacgtaccgtgtcgacgacactcgacagtggatagtcaacgcggttcccctgctctactccactgaattttgctccattttgttctattgaaacataaataaacattaacaattctttgacaatggctagctgaacaattgatctaagggtgatcgaaggccgaaaacatagccaacctatacataaatgttgttacgatctgaccgttaattagttttgcttactctaatacaattgtaacgtattcggtactccctctatcccaaaatatagcaacttttggatggatatgacatatcatagtaatatgaatttggacaggcctcttatccatattcgtagtattagaatatgtcgcatccaaccaaaagttgctatattttaggacggagggagtatatacatagaaaacatccttctttgaccaagacatcgatacacttatctaatacgagagggtggaccagaatacgacatgtgtactcggtcccccagcgatgtaacttgcaatgtaggttggcgaggctgactgataggatagatccacgtgtagagatcgcaaatgtgccacccttgcagaggttttggccagttgcgatgcccctagggtgcagggataggctgagactagccgatgaagggatgtctttacattgacgatacagtggaagctccatgaaagcaatgaggctagggtgacaattttgagtgcaatgatccctctagacggcgttgtcaaggtggctcgctctcccttccaccggtcatttcagggtgaaaaccatatgttcagttttccttttacgggcgatggtggtgctatggtgttgtatctttattgaaggcgttgtcttggaggatctgtttttgccttccgttttcagacagttgagcctatgtttttggatgacgacggtccgttctttctcacactctccctctgcaacccctctcggttgtctggtagactttggtatttatcgtcttttggcgtgttgggttgttcagttttggatctgccatggctctagtgatgtctgatctggcttaattgtagtcagtgtggtgctagtcctttggttcgtatagacattatcgatgtgtgatggtgattttgttttacttttcttgattaaagtcttatgttttctttttatctcctatatcaatataaaacatcacaatatctcctaatgttaaaaaacaagtaaattgtacattggatcacctagtccacctcttaacccatcttttcacttcagacaacccctttcttgccttttgtttcactagcatattagagtaagtttaatagtatagctcactactagctccaattaatctatagccaatctaatagtcaattcatacaatagttgctcactatactattaatatatggtcccacatgtcatacacaca

SEQ ID NO: 69475 - DNA, 6554 bp, Oryza sativa
tagtgcttgatgttaaagtactacggcagagacacggtctgtacgtgtatcataatcacggtaaccacttagatcaatttcgtctgcgtgatccactctgcccaactactttctgaatttcttttttactgaaagagaactactctctgactttcttcgagggctgatctggtcgaattccatttacatcttctctgccataaactacatcgttagcttatgccttacggaaagcactattctagtgcggtttctaactctagaactctagccaaaagctccactgaaagcaagtgtttgccaattgccactactgaaattggccggtgtcgtaactacttcagatgtgcacatttttctttgtggttttgctatctctgtaggtttgccggatctaatgttgaactctttgccgtctgctttacatttgcaggtgaacaacgctgccgtttcgttcaacaagatcgacaccaattcggtggagcacgctgagacggtgctcaggaccaacttctacggggccaagatgctcatcgaggcgctcctgccgcttttccggcgatcggctgccaacagcaggatcctgaacatcagctcccagcttggcctcctaaatgtaagtgatcatcaatttaatggttcatgtcattctaatttcaagcgaattactagtgccatttagtgacctttatggagtcagtaagttacacatatttcatcccataggagagaaattttgtatagatgatagtggcctcccttgctaattgaccttttgattctcaccggcaatggccgcacactgtgtttccgaggaaaaaaatggggacctaacactcttgtctgcacgtaagattcaggctacgttaattgtctgaaaaggctgaatagtgagttcgcaagcaaatcttgcccctacagcttctctgacgcctgcagtactacaattatcactttatgaggcactcttgaaacttcacacctgccggctgccgagtagtgagttcacattgctgccttgctggtgttgacttaaaactttgtttatttcctgagtgggcctaatcaaaccatcctctgagctcgtcagctgattgagatgccatggcccatggacttcaaagtttgaacgcactagactatttcagatgataaggttattcaagagtctctgtcgttgcacatgatatcagtcgtgccctgtctattactccctccaccttatatataagttcatttttgacttatcccatttatcctaaaataaatatatttttaagtaatcattatactgtaaatagataaagtgagaaataattgtattgggacattgagagtagataaagtggggaatatttgtattgagattaaagaaagaagaggtgttttagttttttggtgtttgtattggtaggtataggatggatgaaaaattgaagtacctactccctccgtctcaaaaaaaagacaaacattggtttccgtgcccaacgattgaccgtccgtcttatttgaaaaaattatgaataaaattaaaaagacaagtcacgtataaaatattaatcatgttttatcatctaacaacaatgaaaatacgaattataaaaaaaattcatataagacggatagttaaaggtggacacggaaacccagagtttgtcttttttttggaacggagggagtactctctatccacctcttgaactgtctgagctccaaagtcatctgaattctcaacaaacaccagtcacatgttactcagtactatgaattaggtaatcataatagctcaaatatagattgttagatcatggcagtaatgagaattaacaagactgccaaaccacgtgcatcttacagtagtgagttatagtgacatttgcaagtttcagaaatcattagttcctccgtttgactttctagcatggcatatatttatatatatatgctaatgaatctaaacgcagtcttacattatgaaatcgagggaatagtattttactccatgttgttatacgcgagagtaaaacattgttgaattaataatcagcgttttttttttgggggcatggtgcagaaggtgagggacccgtcgctgcggagcatgctgctggacgaggcgtcgctgacggaggggaagatcgagcggatggcgtcgcggttcctggccgaggtgaaggacgggacgtggtcggcgccggggcgcgggtggccggcggtgtggacggactacgcggtgtccaagctcgcgctcaacgcctactcgcgcgtcctcgccgcccgcctcgcccgcggcggcgaccgcgtcgccgtcaactgcttctgccccgggttcacgcgcaccgacatgacccgcggctggggcacccgcaccgccgaggaggccggccgcgtcgccgccggcctcgcgctgctcccgcccggcgacctccccaccggcaagttcttcaagtggtgcacgccccagctctactccaagctgtgaaactgtcagcgacatgctaggctcctgagctcctcatggtaatatgagagaaaactactgcaaatttagagaggaaaattaagcatgagttgcttaagcatcaaccctgtcagttgacagtgaaaatatatagtaccactatatggcagtatgcgtctttggtgtttagttcctcagtaacataacagtatgcacgacaacggctttaattaagctcagccacacactcgacacgttgccacgagaaaaacgacgggatagttacaatgtggcatacattttgggggtcaagtggcaggtatataatgataggatttcgcgaagaaaggtcagctggttcaatagaatacgtcaataatgttcatatgcatgcctgctgcgaaacatactacggggagtactgctcttcccggcacgcgtttcattattgaacattaatattcatctcgcacacttggaatctttggaagcaatattcaactggagatgatctgaattagcacttgtcattaatcccacaattattttacaatgttagatgtgtgttgcttttgctcaatatatatacttcactgaactctccatgctgttgttacaaccagagattgtttggaagaaaaggaaaaggtacaaattgattccctcgtatataggtcagatttgatttatatccctcaactgtaaaactgggtataataacatatcagattcaattcgccatgcttgctactagtagtgcgccgcagtggtggaggcgacaaacataggcttgtcagtggcgacgaggatggtgccaagcgcggcctccactaagaagttagccctatacgctatgtctaactcctagatgaggtcgtcgtggtagtagatggagtgggcggtgggagcgccgaagttgacgtgggacggctaaggtgagaaagaaggtggcctcaaagggggtcggatagtgaagttgttgagtgacatggtccatcagtgacctcccccttcccaccgttggttcatcgcagccttttctcccctctcccccacgctatggtggtggtctaggaggacgcggagggaacagggagatggctagcatagggagaatatgatccggccagcattgtccctaccttgccaccgccgccattggagaagacgaaggctagcactgagtcagagaatcaagaaattcccgatgggttacctcagctagcgacaggaaagaggcatgtgtccatcaaccccaagcacctttcgcttcttgttagggcaacagccttctgctatctgcgccccctgcctctgatggctctggcgccccgatattgggagagaagaggggagggctcgccaatgccctccctagcatcagctccgcgccgtcactacctccttcccggcctctctagtctctactcctaccagaagtgtgagaggagaaagaggggagagatgaaaaagagtggagagataatgaagaagatgagatgaggcaggtgcatcccattgtttctttttattactataatatgatgtagatgccatgtaggataaagattaggtcaacatgcgttgcgtaggacaaagccgatgtccaaaccacatggagaggcaaattaaacttatatatttatagttgaggaagttgttattctcggttttgcttatattttaagggacttatattgaacgttctatggaagaaacatatcggcgacctacgaaaggaaaaagtccgattaccccttgaagtattgtggtagtacgaattacccccctcaattcaaaacattcatcatcctaaactttttatattagacgaattaccccctgcccaactccggagtgttttttcctacgtagcggacacatagcagtccagtcagcattaaaaaaagatagggcctacttatcaattctgcctcttctcttggtcaccacgtgggtcctacccttatctatattttttatgctgacttgattgttacgtgtgtactacgtagggccaaacccgctccggagtctattagggagtaattcctttggtattaaaaagtaaaaggtgaagactgtttgatttttcaattaagggggcaacttgtactgccacaataattaaaggaggataaatcagacttttcccctgggaaaaggatagccaaagcccaaagggatctatggccgaaattttccagcccatgggagacccatcttcttcttttccttgagagcccgtagggatatggatatgcatggagatggaaattacggcccataccaaccgccgccgctccacctcccacgccgagcgtgctgctgctgttgcaccgccgtcgccgccatggccgggcccccttccttcttctgtgccggtggctcgtcctcctgctccacgcgccctctagccccgcatctctatgctccccaaccgcgtgctgccttgcacggctcgggcgccaaaggccgcgaggacgatcgaggagcagggggtggagagcgggctaagctagagccgagcggcagccggagcggaagacgaaggtacggagctatccgatgacgacggcggcgcggaccaaatgcagcgcccacggcgaagagaagccgcgcgggaagcgagagccgccgccgcggcgtcggcggcggcggcggagcggaggaatcccctcttcccctccccgtcgccggccggcctacgccgccgcgtgctccgcatcggtccgcacacgtggcacccatcggacggccaaggcagcgcgagcggggcccaggggcacgagctgcgcgacgggtgctcctcgaccgtcggatcaggagcaagcaagccacgtagagccgatctaacggatgagatgtggccaggtagaagaaaacagcatcttgcaatgcatgcagggctctgcgcacccacgctttttgcttccgcaagagcagcggaattgcggagaggtgaggacttgattttgatctctctcccacactctcctcctcctctgctttcctctgctccaagaaacgcgtgagattccttcacttcttccatggccggtgtgtttgtgttggtggtggtgctgttgctagccgcgctgttcttcttctcgttctgtatcgttcgtttttgttgtgattctgtgaagttatttgatcgagtagtgggtaaatgaatgatcgaacagcgggtgtttgtgttgatgttgttgctgttgcttttgatgtttgttggtgattttcttcgaggagggtgacgagcaccgagagccatggtgatctctgtccccctcttttcttctgtcttgcttgcgcttgttgttgctgttcctgctgatttcgacgttggtggcagattgcttggaggtgacgagcaccaagacctatggtgatctatgttgtctcctttgcttggagattgctttagttgtttgtttctgtttcagttggtctgtgctctgttcgaggagatcctaacgagcactacgacccccatggtgatctgtatttgcgccccttcttgcaactggatagtgttcatcagttcgtgagttcatcatcccggttctatcaatgcctttttcgtgctgcttttcctggcgttattgatgtacacatggcagctcgatgatgtgatatctctgctcgtctcgtgtatctctgcttacttcttttggtatgttgctgttccagattctttctgcatgtgggtgttcttcccttttttctacaactgtgggttttgacgctcttttgattgctcttgttctcgttaatttttgtgatgctgtgcatgcggaaaattcttgacgatgctgctgcgcacgggggaaacccattgatctcttactcaatggcgctacctgtacgtccgttttcttgctgttgggtgtaacatttattgatgtttcacttcccctgtgtatggtgtgaaaccccgtagaagatattattgaaatttgagagggggatcttagcctgtgaatttaatatttctccccttctaatgatcatgtgcactgcaggctgctgcatttgttcttgacacaaacttttagatgtgttttgggttctcaaatgttgagaagct

SEQ ID NO: 69476 - DNA, 5988 bp, Oryza sativa
gatttaggcagctctacaaccccactctagacccaactcctggagctaaatttaggaattggagctctaccaaatagaccattagcgtttaaattatgtgactccatagcggaatacgaaaaataaactagcagacagaagttgtcctcctaagggcactcacagtgcaagcaccagttgccgggtcctagctcaaaaggttggcccaaagacacacatccccacagtgcaagtaccctattttgtgtggcttaattggatgaaggtactctgggaggaaactgagtccacagtgagcgttatcccaaccgcttcgttctctccacaatgcaccaaatttatccccaacctaccctctcctcgagcgcttcttctccacgcacggatgcatcacacacccctcgccttcgctctctccacagcgcagcgcaccagcccgccggaggaggtcggtcaccagccacatcgggctcgccagcgtgcgggagggggggtagggcgtcggtgttcgtggtgacagcctggtgctcgcgcggactcggtgtccgtggcaacgacgcgatgcatccctccttctccccgaggagatgctggtgctcgacgcggtccgaagcagggcagactacgttggtggcggctggcgcgctggcgtagtggcgggaggcgtccccggcgtcggcggctggcacggtgtggcggcgagcaaccggagcgtggggctgcggttccggcgccgccacaaccggatccggcggctcagcgttggatctggccggggtcgacgggagtggacggcacaacgccgacgagcagcgggagcggacagcttctccacctcgccgatttccccttccttttctctaccaaattactcaagaattttgttggtttggtctgcatctgtggtgggttttttccttttctctaccaaattacttgagaaattttgttggtttggtctgcatctgtggtggttttgtggggggggggggattcgctgtgcgtttggagggatttcagttcgtcgatgattccgttggagggtgatttggggttttgtataggtgcagcgcgcttgcctcgcttttccccgtccgctcgcgccctcgccgcaacaaagttttgcgccgcttaggtaggggataagaaacctagctgaggtgcgggcatggtcgcctcgttgacccgaatctgagctggcgcaacaagatcacgtaccagctcagtgcactgtgaaaggcctaatttaagttttcaccagctggatacttacaggcaccaatgttttagaatcttcagcccctaaacatggcatgttcccttttgttcaaacttttcgtagtggtgatgatattattgaagcaattttcaataagaaaagaaaatctagcaaacatatgcagtttcagttctgcatgtttatcccatttcgccgtgcgtgcgcgtactctttttggccggtggagtacacgggtcgcagagaatcgttgctgggcgctcctgcgaaaaatacaaaataaagtgccatggattttagtgcgtttttggtcgcgtctaaaaggaatcaaagtcataatatatgctactgtgaccatcatgtatagtactactataatcaccatattgtatatgtatcgattgatttattcatagtctatagtgctattgttgctgctaccggtagtgtctagtgtgtggtgctaattaatattcctaggcactataattggattagaaggctctaatcgtttttaattagatttggatggtccatgccgttttgatgcttagcgctcaggatatggtcattgggacctaaattatctggagaaagtgaactatctgattaaaaattataggtgtgccatttgtgcttacgtacgcagtctcacccaaaaacagaaacttcattgtttaaagtaccatgcacagagggaatggtaatttggcacactaaattattactctctccgttttagagtcattttgactttagtcaaaatcaaatcactttatatatgatcaagtttgtagataatttataacaccaaactagtttcgttaaatctataattaaacatgttttcataatatattattcttgggataaaaacgtaactagttttcctacaaagttgattaaatttggagcaatttgactttgaccaaagtcaaaataactttaatccgtataagatgtgcacggtgagaagaatatgatataatagaagggaacaaagtcgaccatagtggtctacaagagcaccttcaatagtctcctaataatccatcttcaataaagtgatattgaactatcccaatatcactttttattattaggaagctacttttgcagctccccaatactttattttcactgtacatcatgacatataggctctatccattagatggccaacaccatcttctttatctctccttgacggtcaaattcattgtctccgcccttcctccgcatcccatgttggcaatggggcctcatttcccatttatgtgcgggaaattctctttaggacgggaaaggttagaattggttccgcataagaagtcgaacgagataaattatgtcacgtcaggtttcatgggggcaaagatgatcccccattcgatcattccccgtcccctgcggagacccacataggtttcaatctttgttaagggggtatttgaatctcctgaagatgaaaatgaagattaagtgtttcacgcaaaatgagatggtaataacgtgtgattaattgagttttaattattgcaaacttgaaaaaggattaatctgatattttagaacaattttcatataaaaagttttcgtatgaaatgcgccgtttaccagtttgaaaagcgtgccacgaatatccaaaacttaatccatttttgtaagtggaaacgaacgggggcaaatattaatattatttttttatcatgtgaattagtagatatatgttgatatattaatataaagtgtgaatatgcgttttacgttcgcatatataatttgatatgtacgtattgttttaagcaggaacagagagattaattcccatgcggaggtggggatgggaataaagtttcccccattatttttcgctgagacgaggacacataaaggtttgactcatgtggatcgataaaaatggggatgcattctccggcgaggaattccccgttgtcatatctactgcggtgtcttgcgagaaagccgaacaaggtagaggcaagcctaggttggagacgcattggatgagtcaacgacgagtgtgcgctcgaatttagcgagcaacgccctcttcggctagctagagctcggggcggtggagctccttcgggcagcgctagctaggcagtggtggcagagctccttgggcaccaaaatttggaaaactttgatggggtatttattgtcaaaattaaatgtgctaaccgcataaaaaatgccacttgttcgtgactgaaggagggatttgagtactatcattttgagatcccaccacggaagacacaattttacccatcacacccatgcacaccacatcctcaattacaaaatatagaaaattatattttaaaaaatatgtatctttattttctttttttttaaaaaaagaacaaaactccaagtacttacgaagggcagccaagcccacccgagaatacatgtgcatgcatccatccatactcctttcgtttaaaataaataaatttagtacgaaatgtgatatattttggattatttagtcccatatactatttggatccagggactaaaaattgctaaaggcacgtggaccaagggagatgctgccactttagtccctataagtacctccaagagggactaatagattttagtcccaatatgcacttttagtttcttttagtcacacctgtttgaatttctagggactaaaagagattaatgtggtgtttgaatctcctgaagatgaagatgaaaatgaggtatttcacgtaaaacgaagtggtaataacatgtgtttaattgagttttaattattacaaacttgaaaaataaattaatctgatattttagaacaactttcatattaaaagttttcgcacgaatcacaccgtttagcagtttgaagagcgtgccacgaaaatccaaaactttatccagtgttagcgatggaaacaaacagagcctagaatagagggactaatagattagtcctatgaaccaaacagggtctaagattataaatctggacaagcttcctatagccctatatatacaatacaatatgttacatcccatatactttatccgtttcacaatgtaagtcattctagcatttcccacatttatattgatggtaatgaatctagacataatgttagaataacttacattgtggaacggaggaagtaaaattattttatttgaacggaagtagtacttaccaaaactgaaactgagcaaattaatcaaagttggtggttatgcctggtggttgacagaaaaatccaggagctagcttacctgtatatatcatcccaaccctatcagctggcgcatgtgtgtgtgtgtccttgcagcagaaacaaatgaagggataaagctctctagcctaagcgatatcgatcaagaggtggctgcggggaaaggggaggaaagcggcgttgggccgggcgacacggcggacggcgacgttggccatggctgtcgccccacgtaaacgaaggaacactgcccccgcgtctcgatcgacgtacacacgaacgaacgcacgcagcgcggccgcgtcgccgtcggctgatcgatcacgtcgagacgtcgccctccggtcgggtcggctgccggcatccgtcgtcaccaacaagtgcagcacggtgagaggaggagagcaagcgaatcactcctaattaagcagcagcagctgtctgatcgcctgatgtttgtgtaattgtgtcctgatgattaccagcagagtccgaaccacaaattgggctgaaaaccttagtgggccgaaatggggccagaggcggcagtttttatcttgaggggccgaggcctggtttgggaggggaataagttcattctaggtccctcaatttgtcgccgagtttgaaattcattccttaagtgcaaaaccaggtacaacacatcctttaacttacaaaaccgtgcaaaagaggtccctcggcagtattatgcccagttttggctgacgtggcgcttatatggcaatttaattttaaaaaataaaaaacatgggacccacatgtcagctacatacaaaataataataaatggtgggacccatttggccccacatgtcatccctcttctctccatcctctctctctctcacctgggcggagcaggtctgagcggagtggctggccggtggagctaagcggcggcggctggagcaagctggcacaagcgacgggcaaggggcggcggcaccgcggcgccgagaggtggcgggcacagcagaggggcggcgggcagagagggggcgagtggcaggcgagctcctggagatggcgacgggatgaggctaaaaggacgccgccgtcgtcgtcggtgtcctcgaaccagtacggcttatccacacccttgaggagggggaaaccgttgaacagcaccgggattgcgtcaatggtggtgtagatatgggtattggccgtcttcgggtgcttctcctcgcgccacggcaccgcctcacggccgtcgccattgtcgtcgtcatctcaatccccgccgccgtcgatgaagaggtgggggacgatgttagctaaactccggcaactgcagtgaaacctgcaacacacacacgcttggacgcgagaagaacaaaccaattgggaaagtctttttggcgctgcatattacttgcttgcgacattttctgtttctttcccttttatccatacgcgattacagaacgtgggcacgatgacccaacttacgcggacacgatcctttctcagcagatgcca

SEQ ID NO: 69477 - DNA, 751 bp, Oryza sativa
aaagatcatatacatataggatcaattcagagtttgccgcaaggatagattgatatagcacaccaaaccttctgaaattgtcgtggcttactagaataatttcgtgcatatattatttatttattaaaaaaatgcttagcaggagctctttccattcactaaagaaagaatcatatagaatagagctggttacaatcagaacaccaaagagagaataatataggattatttctgggctccgttcgtcatgtatcttaacatttttgtcttgagcataccataacctcaccttttcttttttatggaatttcctgtcttttttgtttactctactgatagattgcatctactgagattacaatacactgaaaagccttttctctattaccatttaccaaagcacatatttatagatgggagttgtctgaataagatccttcttgttttagtatccactataacaatcataacaggaatccaacctaatgcttgtgttttgtcttgcttgagcacgcgtcatattttgtccaatatatggaaatagctaatcatctcctttattttacttctttagattgcacctgccgagcttgaagggttacttctatctcatccagagattctagatgctgttgttatcccgtaagttgaaccacctaaaaatttaagtgtttcttgctccttatgatataaactgttcgcttgttacaacattgttgttttggatcgttctctctctgttgtgccttgt

SEQ ID NO: 69478 - DNA, 31590 bp, Oryza sativa
tcccagactttggaggagtgttggtttccatcagaattcagagaactcctgagtgctcttggactagacactgagcatcacaccctgccttttaaagaggagaagggtggtgcatccatgaactaagcactagcagtgtgcagagctacaaccacaatggctgacacctctcgtgagctgtggtgacagtgagtagatgtccattcctgaaaagaaggggaaaacaaatcaaagaaaaaaaaaggattcgagtggagttgcacagagcagcaaaagcaagtggattaacccaatgtattatttttagtttctgacttaatagatatggttcaaagcatgagagaatcgaagatacgtataccagatgcagggagaggagtagagacgcccatgcaaaatgtgtgcaagcagccatgcgaaaagcagggaaacaagtgaagattttgctggtcatatattcttggtcttgttcagttcaaaacacgtgagaaactaggatatccaaacttttgaagttctgattatttttttcatcgcacttgtttcccttttccttggaaaaggctacagtattctgaaagtttatgcaatccgatcatcttataaaggtaggtgatgagttcattcttttgttcattgcatggcaccaaatgaaagtgatgtctcaatgcaagaagaatactctgaatttcttgccaccatgttgtacagagtatctgtcagtacgattagacccagcaaataatgtgaacaaagacttacaaagccgtagtaaaataggaaatgtgttcacataatctctggcaatactgaaaagaacgagatctgctaacaaatctcgatatctacccacgttttttaattaaagaggtgatggttatggaacatatatcgacacacgagtttctgttaattagatgctgtaacatgatgcagacagtaaaacggacagaaccacactatctcagcatccaacaccaagtcaccaatagaagtgacagagcatctaaagcaacagttaaaggtaggtacgatttaatgagagaccaaagctttcccgaatagtgaattatgcagaagaacagaatctttgttaattaattaacctcctaaaaatataataataagacattcattcatatcttaaccctacgagcttccttcaattcaaaatcactagtacatgcctgctgcactaagcataatgatagcagaaaacaatatatgtctaaaatatgaacgtacaaaatttcccaccttgtgatgtccccattgtggtgataaaattaactacaaaagaagaaaagatttgctgcactcaactagtatagtattcaaccaacacaagcataaagctttgtgctgcttactgcaggccctgcaggagcatacctaaaaaaaaacaagttccactaacttacgcctaatgggatcatgtcaaataattagtaccaaagtgatatagcattagtaatattttgcaacctaaacaatagaatagctctggccgcaatactgatgaagtgcataattcagattagttcaaatggaaaaaaaaacactttactggatgatatcacagccacacagatgtgctgttgaaagatgctaggataagtacgtaaagcatagtactgtttgaaagattctgaacgtaagcacttgataaaaaaaatattccctctttatactttcagtaattttacaagttgtctatctgaataaaacaagaagagatgtagatcaattaccctacctgaagtcccgaataaaagaatggacactaaattcggtattaatagtttgacatgcccgtacaatcttcatcttcattcactctaactaaatgttatttaccagtattattatcagtagaagtgattttagcaattgatttatgagttctaccactagtagaaaaaaattatgctaccagccgttgatatgggattatgaatacatatgatctattcaattagaaaagacaaacagtctagtatttgctcttagagatgaacatgtactaaagcacagctaagagcaagtttaatagtatagcccgttactagctctaaattatctatagccaatttatacaatagttgcttactatatatactattaatacctggtcccatctgtcatacacacattacgttttggagtccgtgctgcagctggctacagatctgtagcccgctgctcttctctcttttcctttatcttcttaaaatatatttatagtaagcttatagcctgctattgtatctgctctaacccatgcatgctctaaattaaagaatttgtgaacttgaagaccttttccattcctgtcgtttgaaaactgataggccatgcattaggtggttgcatgtaaagcacttgagctaacgcaagagatgacatataaatggtctctccttttagggtatcgagaatgctattgtctatgcactacatgtgattcaccctatatcctaaactaaaggatttagcagggacaaatatcattgccaatttgcatacttttcaattttcaaacctatattggctctgtcactaaaaagctaaatgtttgcttctagacgaaagcaaacacacaaagttgcgttaaaaggaagcatgcacatttccgtttctctaggaataaccaagataactcagttattgaaatcccctttttgaaaaaaaactcgattattgaaataccagcatatttcattgccaaaacaagaatttgcaccaagaataaatccagtgttttgttaaaaaaaatggagttcattcctaaacctgtttttttttgttactcattgataataaccataataaaggggtgacaactgaactatatgttctgcagaaaaactagtacagtaagtagtgaaaacatctttcccatttcacaaaatgattgccaacaggataacacagataaagtttttttaaaagaaaaaagctaaccaaagttgatgtcggcagctggagcaaggatgtggtcaagattcaatattcttacatgaacaaaaatttaccatgtggccaaagttgctaagagaagcagtataacattactattttcataaagccaaagccacttttttttttgcacgatccctcgaatctaactgattccaaatcagaacagataaaaacacactcccctcagggggaaaaaacaaataaaaacaccaatgggttgctggtgaaaataaatatgaacgaacggttcttgaaattgcgctaaactagattaaactcttaacaagtcatgcctgcaactagggtagttcgggaagatttcatttttgccacccattgctattgcaactagggttgaaaacaatttggaaagtttctagatttccgacctattttcacaaacgaaaagcacgtacctgtcggaatttcttttgggtaattttcaagaaaggaaacaaattcagattttcttttctcaaaatggcattattcgtcaaaaagtagaaatgttcgaaaactttctgaagaatttctcctaaatgaatttggaacttctttttttcgaagaatgtttactgtctcaaaagatgaaaaaatggagttgacatagtgatatgtgaactacgatgttatccttatgataatgctaaaatttggaattttttatctattttttagacaaaacttggaatcttagttggagggttttttacattctaataaatattcattaccgtatttgcttcgagtcgtattcgttcctttttgtatttgataatatttgattccgtttttctatccagggttccctattctgaataaaaaatattaaaacgaaaatggtaaaggtggtttccatttgttttcgagccgttttcatccataattgcaattgtactatctcttccaccattgaaagtttgtactcctcttttaccaccctttcgttagttcgtatatttttatgccatcactatctagtcaagggtagttggctattaagtttgcaattaaaatatcgttatgcccttatagatgttccaaagtgaaatagtactttaacttttagcaaatactgtaacatattaagataacaattttccccttagaagatattaagttctcatgtgcattgctattcaattttttaagaatattggaagctatgctatatttatgtggttatgcaaaaatgttttttactttactattccattttttaagttacatgtataaacctttcaaatgaattgaaaatttccccatgaattttttaactgaaaaaataagtcctattttgatacatactttaaaaactaaagaataaatgatattttcattggtttcttatataatttttagcttcataagggcacattggtcctaaaatacttttaaaactaaagaataaatgatattttcattagtttcttatataatttttagcttcataagggcacattggtcttttagggacaaataagatggtcgttgacagcgaaggaaagaaaaagttaaacaccaatggaatagtagtattatgaaagagaaagtgccaaataaaacaaggttcacaacaaattaaacaaggtttcggtgtgtgagaaaaataaatttgtcctaaaataaaacgccttgttgataagacagcacacggtttgacaatcaaagtcatgtgaagatggtttctttcccggagaaatacaatcggatgtacacatttgacacatacacaacactcacacaatcaccaatgagtcatccttccgcgtcacaaatgatacaaaatagagtatgaacggcacacagacttgcaacaagaggatatcctaataattccattatgctcactctcctgtgccacaaatgagtcatccttccacctcttcgtctagtgcagatttttcggaaggatattgagactagtagcgagctaggctgcctaccaacaaattgtgccaactgccaagtgaatggaatccaacaaccacggtgtcaaaatgatgggagatgtatgcttgcaaacagacatgacactctaaaagggaaaatgtgctcgctcgctgatactctatcatctactaggtgatatgaaaagaaagaaatgaaagaatcttcgattacaacagatcctcaaccattggactctttgcaaagttaaaagaggaggacacattgacaatggcaagcccaaagctccaccttaagatggtcctacatgtagtatagattgcccaaggcgcgtaactggttctattttcgcttagggagtgtactttttctctctataccaataaaaaaatgagtatgttctgtccttatttgttaaaaaacacaaacacatacacacacaatcatcaaatgcacgtgcatttttagtgtacacgccaaaatgggtatagtctgtctttatttgttaaaaaaacacaaacatatacacacacaatcatcaaatgcacgtacatctttagtgtacacgccaaaatgggtacaggctgtccttatttgttaaaaaaaacacagacacctacacacataatcatcaaatgcacgtgcatcttcagtgtacacgcttaaggttgagttcttttttgggtattccaaacttcttctactgttttccatgcgcacgtcccttaacatgttaaaaacgaagtgttttttaaatattttctataggaaagttgctttaaaaatcatattaacttatttttaaagcttttagctaatacttaattaaccatgtactaatccatcgctccgtttttcatatcggaatgtgagggcaacctaaaagatatccggactttggctttctagctgttggatctttggatcattggatgagctgatgccccatgcaaaagccaactaacggaatgtgcgttgttgatcaggtgaggtcggtcgtttaatcgccgaagaacacgagcacgtacgaagcgtgacgagaggatggatcgagagctagtcgatcggtgcgtgcatgcatgattctggtatgaatcgaagttgaacgaattacgggaacggcaggtgttccgctcgctgcacactgcacgcccgcccatgcggcagtggcggagctagtatatatcaggggagtgtttagcaacccggtcaaaaaaaagttttagctatactttatctattttcactatatatgtacccctcaatacaaacttaggcacccgcatcagcttaaactcgatataaaatagagtaaattaagcaggtggcaccaccctccatttcgttttagctccgcccctgcccacgccggtagtgtgtgttgtttctctcgctggatcgtcgcgcgcgcgcggcgcgcgggcggttcggcggttaaattgctgtcacgcgtggcgcggcggcgtgaggcgtcccgacgacggtcccgtcccgtggccgagcaaaataaccgatacggcccacgcaccgcgcgacagccgaatcccccacgcacgctagtacgctactacccgccgatcgagccagcctactccgccgcgcgacgaggccgtgcttttcgcgcgagcccacgtataatagaaccgatggcgcctctgcctaacgcgcatgcatccttcgctttgccgggtgggctgtgtctgagtggtctcttttctttaagaaaataacaaaacgtccactctacacccctcatttaatggttaagtctcaatcacatatcaccacaaaaccgggtacaacacataggggtggagctagataggggagggggggtgtccaggaatccggtcaaaaaaaaaaaattttagctataatttatctattttcaccatatgtgcatctctcaatttaaacttagatacttgtatcagtctaaatctattatattattaaaggaatagaaaaaggagcctccacgttcgctttcatggcctagaaattctcacattaatcgaagaaaaagaaaaaacagagtccatatagaaatacaatttagaaataactgaaattcgaaattaaaaataaggaatattagaagaggagactagaatccatatagaaatacaatttagaaatagttgaaattcggaattaaaaaattaggaatattagaagaggatactagagtccatatagaaatacaattaggaaataactgaaattcagaattaaaaataaggaatatatattatgaataaatttgttggatttttttaaacaacacttttatagaagttttcacacgaaatataccgttagcagtttgaaaaacgtgctaacggaaaacgaagagaatctaatcctataagcttaaacgagcgcacctgaagcgattcgaaggttttcacgttgcaggccatgattctccgtgaagcgggccgaggttgggtggtttacacatacgaggcccaacgtttcaaaggccacacgaaggaaatataacttcttcctttttaaaaaactagctaaaatacccgtgcgttgtaacgggtgaaaaaaattctaatgataatatacgttttttatgcataatcatgtcaatgacaatgtttgtattttaatgagcggcttgttttttttttataaacggtgtttttttttcttgcacgattttctcgcatttctttctaacagttttttttctagcatgtttttttccttttttttactaatgacgaaaaccatatttttctccccttttttttttgcttttctcacgtgttttttgcctattttttctgacaattactttctcgcatggttttttttttttgcctgttttttcggaatgttatttttttgcttttttccaatatatgagaatatatgacgaaataaaagccgggtagtagatggtaaaaaatcgatgtatcttatccgactcaagcgtccatcaaattagcttttttctgacaatttttttagagcgattttatatatatatagtgtttttttcttgcgtggctttttcaaaccattttatttagaaatggcgcattttttctgacatccttttcctcgtatgtttttttaaaaagtttttgccggcaatggaaataatttttctcacgcgtttttttattttttttaagaagatggaaaaacctcttcagtgtgttttctgtgcttttttctgacttttttctcacacgtttttttgacctttttattttctcgtgcattttttatttttaaatagttatattagattagagatagagaagagatttatactgattagaaattggactttgtttcgccctttccactttttttcttgcgtgcattttttattttatacgaactaactttttattttttacgaaccatttttttgccactttcttagggaatcggacgaacttttttagatgtttttttcggatttttttcgcctatacaggaatcagacttcttttctatttttaaaggaatcagatctagtgtttttttcaccacttttttttttccttttataggaatcggattttttttcccgtttgcatctacgttttttttcgccacttaggggaaatagacttttattgttgttgttttttgtgtggcttttctttttttttatgcacctttttgcctttgttctatcccctttatttattgtttttttaaaaaaaagaccaaaagcaccttattgcaagattatagggacttaaacgtaaatataaaaattacagggactcaaatgcaaatgtacaaaccaaaaaattaaaatcatattaaaatggaatgctctcgacatgtaggttccgtttttgcaaacagatcttcaatctggcacattaattttttttcaccaagatgtatgaaatatcacggtataaattgaaaccgagagaagtggtgcctagtatgtcggactcaaacgtgaggagtgggactcggatcagagtcggaccttttttttttctgagagggaacgaggagtcggacttttttttatttttattgatattttttttgaccgagtcggactttttttatcgctattttgttttttcttttctttttttcgcacgtttttgttcgcccggtttttttaatcggacaattttggttttttttcgcccgctttttttcccttgttctggataggacatatttggtttttctttttttttcgcactttttttcacccggtttttttatcggataaacttggttttttttcgctcgattttttacgaacgatggaagcacctctttttttttaagtagtagagaaaaaggaaaccgacataaagacaactatgctctctgtgaaaattcttcaagaatcacactcttatattcatacaactatatttttatttgtggacccgtttcacaaaactacattcaacgaggattcacccaggacccgtagctaacaattggagaacctggtacaaaatgcacaattaatcgtgccttaaaatttgatagccaaattctcatggaccctttatcgtgatcgacacgtatgacttgtataacgggagaagacggacagatggtctatcacgatgactcgtagagcgttattacatccatttctagtcgatttagcttcggtattaggcctgttgtattttccacttttagttatgggccttaatcctgatctattgggctttaatattccggttacaactaattaagtatacttaatactccatataattaagattttgggcccctaaattttgaggccctgaacagttgcacaccccgcacatgccgctctatggccctggattcaccccaagcatcctggcaagaagaaaaagataattcacccaagattgtaacttttgaaacacttggctgattaaaaaaaaagaaatttgctaacctttatttggttgaaaaatcagaggcccgatttgcagattttgaacccaccgatctgcttcgatattggtgcaccgatatcttctcctcccacttcgactatagcggcgacgaccccccaaccaattaggtatccgagttgggaccaaggtggagggagtgggaagatatgaaaattttacttggcttagaaggatggccatgggagttggcagcctagtagtagaagggtggtaaggcgatggcaccattgaagccgcaaaaggttgacaatggatggtgggcaggtgttgcagcaggggcaaagtggtgtgaatggttaggaagacgacgacagtgagggtgcctcgccaccaccggcttgaagagggtgtgaggcgaggagggagacggggaagtccgctgggactcacaagcgtcgtttgcaccttctaggttctagcaaccaacgaggctaggtggcgacaacagaggaggtgttggggaaggtgtgctcgcgtatggttcctcaatctcttgcgagggaaggtgtgctcacgtatggttcctcaatctcttgcgattttttttattattttttttagagaagggtattttttacccggcctctacatccaaccggatatatacggccattgaagtagggaacttagccccgcaaacaacccaatctgaaattcgctccatatgagatttgaactcaggaccttggggtactactcaggtcactgtaatcgatctcttgcgatggcggcagtgagaccggggagggagggtttagggttgggtgagcactgaacgaatctcaaagccaacggtctagaattcacaagatattttagggtgttctccatcaaatgtcaaataaaaatctagcattctcaaactacatcctacaagtgacttcttcttaggttcctattacgagtgcagattatgaaactgataatgacagttacatctactttactgtaccccatcacacaacaagacctcgatggaacagaacaatcgatgccaaacaaatgtcatgtcagaagacaatgttgcaagccggccacaatgtgctaaccctatccccctcccctgcccatccctgcatctttcttatccctccccgtgagccagccagccagccctgcatcccaatccatacgcacacacatgacaaaacaacacagagaaccgcacacacacagctctcgacctcgatccatctcgatcgatgcctcgatcgagacagaacaaaggcacgggagagggagagatcagaaccttgatctgtgtctgtctgcaatattttagcctaataatgcattcccccaacaggagcagcaccgaggccaaggccatgccatccactgcgtttgcatgcatcgatctcatcgacccattgtggccggcgttgttgcaaaagcgccggccggtcgccgccgtcgatcgacggatcgactggagcgtcgtgatcgtaatatatgagcgtgacgtgtaattttttgcgcgttcgtgatcggtcggtcgatcggtctggccggacaactgccgggctcgatcgattgatcatcaccggcgcggattgcgtaatcataggaaaactacaaaacctgaccaaacatgcaagaagaggatcatggtgtagtaggcactgtagcaggtcaaccgacaaccgatcgatgctgccattatcgatcgcaaacagtgcctgccagcatgctgttttaaatatctgtatgatgcatgctacttttgatcaggtgtttgattctttgcttttcttttcgatcttatcagagaggagagaaggaaatatgtatgtatataggtcttgtcatgtgttttgactttggctttcgttgtgtgctacgtgtcttttatacatcctgttattgacatgtaaggctactggagaggttttctttttccccttttctttttctttgtgttcttcaataggcattgagattcgataactaccatatatatttttaaaatataaatttacaccaatatactaactccatctcaaaatataataacgtttggctcgatattacttaacgtggattaataatcagtaagtgtactgcctcctcaaaagtggacaagtactagcccgatttgttcatgggctgctagccctgattgaggcttaattgggcctcaaaattaaggctaggaaaagcctaaaaaggattaacatatatcatgatcataatgaacaacaagggtacagtgttgttttggggcttcggataccagacattcaaaccccgggcttgagccttgcaaactagcattcagtgtagttcggatttttacttcgataaaccaatatagccaatataggccgaattgttacagtaagttatagtattcccacataactaaagtaaaaaaataatatgttgtagtgatattgagtacgtttccaataataaaaatcaataatcaccagcatttgaactctagatcattttttaattcataaattatgtgaagaacatgttagacatcaagctattgattggacatgaaaaaagagcattttggctactagtatcttgtagaattgcaaattaaactgaattagctgatcaaattaaccatttttcagctcagtaaatttggtttgagatggttaaaaaccaacatttatatttctgttattagcattttcataatataattaaccagtcaatccagcaaaaattacattgaggtatcagtacctcacggtaccaaatagtttacaatcgttggatctaactgggcaggatgtgcattgctagatccaacgatcagaaatgatttggtaccgtgaggtatcgatacctcgagatatttttttttgaccggagcaaatctctttccatggaaattgtggaggaaaacaagcatggttcgtctcatatttctccttataaattaaaatactacacttcttccgtgtatcatgctaatatttttttagaaaaactttcttgtatttgcaagtcatgaagaaattttgtgagcatgatattctattcttataactccttggggacgagaatcagtcgaactaggtgatttcccgtgctttactgcgaaaattattaaataactttatacacacacacacacacattacctataatataattcattgaattctacaaatcaacatctaattatctttcttcacattatttttaacacacacacacacacattacctataatataattcattgaattctacaaatcaacatctaattatctttcttcacattatttttaacacacacacacacattacctataatataattcattgaattctacaaatcaacatctaattatctttcttcacattatttttaacacacacacacacacacacacacacacatatatattcattgaattctacaaatcaacatctaattatctttcttcacattatttttaacatatagatatatatatgttaaaaataatgtgaagaaagataattagatgttgatttgcagaattcaatgaattataggtaatgttacatgcttgcataagttttgtatgtaattattgctagtggatgatgaggtagcacgtttgtatgttgagttttagaattagtgggttataactttatagtaagatatgattctcctatttcccgtcaaggtgatccttgtaaactatatttttagaatcgtgcgtttcaaaagaaactctaaattaggggcagccaggcagggcgcaatttggaacacatggaaaatgcagagaacaatttcccccctcctccacatttcctcctccctggctccagctgaaccgtcacagttccatatcccactttcctaaaggaaacaaagacgtacattcattttccgcattctcccatcgttttctctccccctctcctaaagcggtgtgaacatattcctctcatgccattggcaatggcaatgccactcgctcggctcaattcccctcgccatggccctcgatcgaaagggagagcagcgaccacctccgtcgttgacccatcgactgtctccgtcgccgccgtcgtcgtcgtcgtcgtcgtcccacgacgccgacgtcgcgccctcgccacatcacagcgacctcctcctcctcctcgcgcccggtcaaacccggtcgccccgcggcggggcacgcacgaacgcactgccgacgccgtggcgggcgcgcgcgggggcgagcgatggcgaggccacagggggagtccactactgcctttgccacacgcgcgcgcgcgctggctgtctcgcgcggcgccttgtttggctcaaattttctcggaaaaggaaagaacaatgggttgcatcgatcggccgcggttgcagctaagctttgcagatcgcgcgccactagctaagctgagacgactgagagctagtaagtgaggtggtagtagcagcttcgagctgatctcggctttgagttacttctcctttctcctacctcccacttgcaagtgtctgctgatctgccgcctccttgtgcgggagggaaaacgaaagaacacaaaaattaatcctttggtctcaacaagtggagagatcagtaaatgcttacttcatgcctagctagctagcccatcgaaccatataacaaaaagatttaaattttaccatcttacctactattggtctctatcattatcttctatcccttaattagctgacattttacaactctattttttttattaataaggggtatttcgatcttttacactccctactaagggcatgtttagttcccaaataaaattcttcgcgcagtcacgtcgaatgtttggatacatgcatagagtattaaatgtagaaaaaaaataattgcacagttcactaggaaattgcgagacgaatcttttaagcctaattgcgtcatgatttgacaatgtggtgctacagtaaacatttgctaatgacggattaattaggcttaataaattcgtctcgcaatttcctggcgaaatctgtaatttgttttgttattagactacgcttaatatttcaaatatgtgtccgtatatctgatatgatatgcaaaggaaattttttttgccaactaaacaggctctaatttatcaagtcaaagttagaaattgagtcttctaggatggaggtagtgctcctgtatatactcctttcgttttgaaatgtaggaggttgttgacttgggcataacttacttacacaaattggtgtaaatataaaagacataaatcatgttgaaatgccacatttaaaagttaattgtgtcatacatttagaaacaaatgtagtacctttctcttcttagtaattttttttcgaaccaaccaccgcacgattgtgtcgattttattgtatatagcagaaaaaaaatataaggttatatagtcctgtgaggctacgatcaggagaaaaacacaccactgctataacacatccttggagaaaaaagaactagctaagtgagcgagagaagtaaaaccctcaattagtgcagcaatcttcttagcaatttttttgaaccaaatttttttgtggaaaggtgaaaaagagttcactcttgtcttttagatccaagtccaacaaacatttctacacaccgatgtaagttgactcagctcactacctgcagcctgcctggactaaaataaagctggcaccatgcaactagtcaactagatagcaggattaaggcaccaagagagattctttcaagataatgatgatatattctccagttcgtcattaacgagctagcaccagtacacagcttcgatcgtcttcaccctgtttcttaattggccggacacaaacgcaacttcctccaacttcccctgatcgtatgcataattgcacgagctctcgctgaacgccaaaatacagcgccaaaaattccacaaaacccagcggatgatagctcgagatcaggcacgaaaacagttcagaaatctcatgcgctgggatcaattgttcacgtcatggtagaccattagaacgcatatacggatgcacgatggatttgaatcacatttatttcgtaccccgtcccgtattaattctaagccattcgtcaacggagatgcttagcctgcagaaaaattatttgcttttggaccacacagcctacagaggaaaaaaaaagcgtaagcagggagcactacgacactagtagtagctgtgaatgcacttccttgcatggagagaaaaagggtgcacgaacgagagcaatgtgactgtagaaaggtggtgtattggggcgaaggatagtacatcccatctggcatccgccactcgacttgttgttttcgcccttgaaaggaggagagaaaaaaaaattactccgttcgttccattttaagtacagccatgagtgtccatgtttaattttaatcgtccgtcttatttaaattgtttttataattagtatttttgttgttatgagatgataaaacatgaatatagtacttttattcgtgacttattttttaaattttttcaaaaaaatttaaataagatagacgatcaaaattaagagcaaaaaatcatgactgcacttaaaataagactgagggagtataatttagcgggcgagaacgaaagcgtaagcggaacggggtataccacactagctcgcgagcatgcacgcacacgtcgcgtcgcgattgggtgggcgtgtcatgtcttgtcaaataccggaaaaaaataaacatgctccaccaccgtcacctgaagctttggcctcacccaccatcagcaatccagcatgctctaatcaagcttagctaggttgatacgcatgcttgctaagcttacctagcttagctgcgtgcgccaatggccacggccaagcactgagatgtacagagaagggccacctctctaagctactctaccactagccgtagcgatcaagggacgaattattggccatgagatccactaataatacgggtcacgaaacaaaatttccccgaatgtgacggcgatttcctgtagcactatgaaaaaagttatctcctgatctctctcttccagtccatctgtccccaggctaagcatatgcaacagggattagggtcaacgtcgcgcatgcgctttaatctcttcgtcgatccatcggttttgcgagagatgaccatgtcgacattgctcattagcatgtacctcgcacaatgtggtttcttcacaggagattttgatatgcaattcgaatctcaggcatagtatttgactatttgggaggcctgaaattactgtcgttttaaggccacaaattaatccgcggtaattgcgtgtcctagagatcaactttggtgatacacatacatgatacatcgagctggatatatagttagctgaattagctagagtggcaagaacaaattcgatggctgagacagcacgaccaggtgcccctgcacaagagcctagctaattagctagctatctactgccagtttactactactactactactactactactactactactgctgttgttacattgtaattgtgcaatttgatgcagacaaaagttagctatatggtgattatattggatgtcaggatcagtgcatctgtagataacactgataagcctgcttcgctagctacaactgtcatgttatttgggtggtaattgatgcatggcttgtgtgctttcaagatcggttggattggatccttgaattgatacatggtctagctttgatctctgtgttggaagataatcttgttgatgacactctgacacttgtaaagagattggaagggcctgatgagcaacagtgcaaggtgtaaagatgaggagagcctcatagagttttccttccatcgtccaattcatcttggactttataaaaccaggaatgccacgcaatcttcagttcagagaaaataatttgacacaaaaagcaagtttttacatgagaggagccatcgatcaggcacatgtattgtgcccaatgcatgcagaaaccaacagaacctaacctgaactgaaaatttgtagagatttcatactggttcaggtttgtctaacaacattcaacccactttctatcaactcagattagagccacacaggttattttccacgagtccactataactgacaataccaatctgaaattctctactcatctactgaagatgtcatgtcccaacaatgcatttggttttgctggtgatacgggagaccatcgattaagcactggattaatattcgcatatctaatcatcatacttttttttggaaaaaaaaacaaacagggagaggggaactcccagcataatcatatattgatgatcaggaaataagacataattatcagtaggaccatatatttgaccatttgttccccttgaaaaatgcagtgcttcagaggatgtaatggctagtacaatggcttgatgtgcgagaggtctttaatgtgtcccagtctgaggctttgagcctcagcaaccagttttcgacagcctgatctgtccacaattaatcgtacttgtaatctgtaacatcctcttcagtcttaaaaaaatttggtcggtctaacccttcgatcggcccggctaaaagaaatgcagtgctttgagtacatataactacaaattgaaaggttaatgatccccacttgtgtctcataagtttgtgttaattgcatgaaatctgaacagttagctagttcaacaaagtctagctgaatctctacaatcgttgaccattaatattccaataggccggtccaataccaataaaataaattctaggtcaaacatggtcctgtgaagctgtttatactaactgtaacctttggactgtgacattgtataagaatattatagtaccactaaacttattcaataatcagggttcagttgctatttttgattattacacctcctaaccttaatcactttatacaggagttttatgatgtatgcaaaagtaaatttcacaaaactacaagtgcattgatcaatttattacaaaactacagatttaacattatattttcaaaaaactacagaatttatcacatcagaaaactacaaatttaacatcagttttatcacaaaacaacaacttttataacctcaatagtgctatggatatgaactctaaaatatctagttctttgctaacttcattatttaatctatagtttacgttaaatatctatatttttgttatacataattttaaatctgtagttttacaatagtttaattaaaatatctgttgttttgtactctatatgcaatctttgaaatggacgggacctgaaaagaggagacggatcctaagtccctgtcaggattccatttcaagtaattaatggtaaactaacgaacagtagtgtcaaatctgaaaactttgatttgttcgagtatatgacatgattctgaaacaagcatatataacagcaagaaacaaaattagctaatcatcaaaataaaaaaggcagctactagctgcttctacctataaccaccccaacatatgcgatgcgtcactcatagtcatcagtccttttatgtcaataatggaagggaagaaaagaaggatgtcacctcttttgcgaatgctttcatggtcttaggaggaggaactgtcatttccctttcattgggaaaaagtcaaaaataaacaatatatgcttgattaaaacatgtgatttcccaaagagaaagaggtgagtgcgtttcgtatgttgcgccggaccttccacgcatgctttgcttccggccaaagggaaaaaaaataaataaaaactttcaccctgtccctccaactcccacaagcaaaatgttttttgttttagaattctttacccttgttctgcaactagtatttgcacgaccactttacatgtctgaactcatcggcatgctctcacaaaccacttctagtggggagcaagaaaattgcctcaaaaagttgggtgtgccaaacgaaatgaccagatagctgaataattttgcgataattatttaaacgtataaataatgaactagctattatataaattaaaaatatttggaataatttcataagaaattcaaatgcagatatttgttttaagaaaaaaatgtattgtttagaaattcgagaagcgtgtgcattcctcaaaatcattggttaagaagagagaacagggtaagcaacttgaccagatctaccatctagagaccacagttgtaaaccatatttgtttttagaaacacctccctgacttatatttcctcgtttttcacatgcacgcttcgtaaaatgtaaaacgacatgtatttttttaaaaaataaaatttctaaaaaaagtagtttcaaaaatcaaattaatccattatttcaaaatttatgttagctaatgctaagggagggatcgtttcgtttaatgtacaggaagtagagttcccaacctccactccgtgcacgtaaaacaaaataatccattaacacataattaattaagcatcaactaatttttttaaaaaagattaatatcattttttgaaaaaacaacttttctatttttttaaaaaaatataatgtttagcaattttgaaaacgtatgtgcggaagcaaagggagtataagttgaaaaaggtgagtgcatgcatgcggaactcagcctaaaatctaccatctgtcactcaaaagcaacgtctcaacatgttaacaagggatccaacattgatccatcctgcgttcagacaacaaaagtctctagctagctagctaaagctatagcgattggcaatttattaccggagttaattcttcccttgaccagagccagagggcttcttcttccctcagcaagaagccactgtccgtcagctggtaggccggccgacaccggtatcaggcaggcttaatgactatgatgatctccaaacaatcccattcactacagtagtgtagcagcacagtagcagcagcaacagcagcacattgctgatctctctctctctctcgatggaggacaccacaattaagccaagagcaattaagccaagaggcagcttaggtgcttactgcttaatactcctacttgcttaatgccctcatctagctgcttgcaattgcccaccggccagctactagctaccaagtactaccaagtggatttggcatcattgtaacattgcagcacactgcactagagtgcatatgcatgcatgaaacactgcacaatgcctcctcctcctagctgtcactgcaatagccaatctcatgcagggtatcagagtgtactggtgctgatgcaggaggagtagatccaaaaattcttgagctgactcaacagatcagcggtccatacggcagggcacgccattgaagatggcattcaagctagtactcccagtagtattcaactcttgactttcacacagatcagtgagcagcgtcgtcgtctcagctgctgaagctgacagatgaggagttgaagactttgatctttactcaaaactctgaagacacgctctgtgttgctgtatttattgtcgtctaaatctctgaacctctctctctatcttcttctttgattagtattaatttctctcgctgcatgccataaaactcgcttgtacctgcagctgttacggaacgagaggagaggaaaaaaatggcgatgctaagctagcccaagatcgaagccaaagcttggaagctggtgaagttaactgaacgagaggttttcgcacatgcagcgtttgtcaaaggtgacaccaccgtgtttaactacgcctgaatgcgacaatcttgggagcaaaattttggctgcagattagctcgacgtggagtggctagagcaaagccgtactaatgctttacttactcgcgtaatctcgcagatcatgacaagtctgattaatcttgattgatcctgcaaccacgcacgcgagcgggcgatccatcgatcggtcccttttctgaacctgaatatggacgatcggaaacaagattttcttaacctgaatattgacgatcagaaacaagaaacgctgcatcctttcaagccacatctgaaagacagattgattgcttcgatttaatttactgcgatgctattacatctcaacagattgattaattgctctgctcgattgatcgagatcgttgaatctgaacattattcagagtccttgccgttgattttttctgctgcagtcggtggcgtcagacaaggggcatgtactgctgcgcagtgctaggtaattccgtgcgagtgcatgtagacgtcgtcgccgccatcgtatgtacggtcgtcctacacaacttgtttagatgttgcagcatagtcctgtacctgtaaaaatacccagaacaaaaaatctctctttttggaggttgccatccaaaaagatcgagaaaaatttcccccagcctagatggctagctagaaatgcaacttgctggtcctcctccacctcgtcctcctcctcgttgttgtcctcgccattttaccagcgtatcacgggacaatgacgtccgccacgctttctcgcgcaggccaatggagctgctagctatggacttacaatggcttttatttctgttatctctcttcagactcggtaacagtagaatttgtcatatttcatattagtttatttcagactttcagtatgaaaaaagtacaatggcttgcctttcttttgtctctgtcgctaggacagagctcctatacacgtccaagattgttcctttcaaaaaaaaatttcagctttgtacttgaacaaatctgacaaagtgacaaagtgcacgcggatatatatccatgtttaatttcaacattgaccaatgcccgtgccgacacggtacaattgtacaaagagcttgttctagtttagtaggacaggtacagatcaagagattaattaatttctgggttcttttgtgcagaaagtttgtatatttttctatcataagggctttggatatatcgatcaagagcatgagcatctgcttggaagttcttatgtgtgacaagatgctctcgtctggtccgattccaacttgctactgattactggtactcacatagtcgtacatgccaagaagacgagatagagcataattgaaaagtataatcaaaatgatggtagtattaattaattagccaataagcaaacccctgtgtcctggatccaatcgccgtccaacaacagggtcagctgggattacaataagctgggtaatcatcgaacgtgtacggaacgaagaatctattgcgtcagatgatgcccctgccgttggatcgacgaacaacggtcaggaacgaccacagggttaagcggaataggtagagatcgatgaaggtgtcaatttttttaaaaatttccgatgtaagtactttgacagccgtacaaatgtacaaagcaaggagtgagtaggaaagcattaatcctctgttgcagtacaagtgacaacttatcttcagaaataatataatggttatattccagcctctgtcgtttataattaaggtgttaggacaacaaaccctaaaaacctgtttgttaatatgatcaattataaacggattttctaattaacctacattcagttgaaaactaaagtcaaaatcttgtagattcctagccttttaatattcttcacgatctcaatatacttcaataacggtggcgacaactcatactagctaattaggattcggggtggagggagagctagaaaaggggtagttccccagtttagagaaaggtagcataggcttggcagtgagcagtaatgagaagactaaggtggcatggtggcaccggcgtaaccaaagctgcagggatgaaagacggtggtaggcaatggaggtagcagaagcataagaaagcggcagttaggtgctttgtggtagtggtgacggatccaacggcaggagccatcaaaaacatatgtgaaaaacggtgcgaggcaccaactatatgaagaagatgagtgaggaaggttggaagaaatggagggagaaaggcgatggtgttgggggctaaccagaagacattgtcagcatagcctccggcgatagggaggcggacgagtagtggcacatggtgcgggagagagcggtggaccaaaaagatggcagcgacaacggaagttgcgtggttccgaggaagatgagcacgtgaagccaatggaggtggactagtgaagatcagcaaatcgtcaaatttgatagaggaattctttttgcaaatccaatgggtatataggtagtcccaattataaatgtgtgttgctttctttgaagaaatatctctttggacataagacacacatactatcttgataacgagctttctcgagccgaggctagacatatgagtgtgctctttcgaacccacgctatcgacaacttacagaaacataccaacactattaggatgggttcttttcagattattgaaacggattagttgctccatcctttaaaagatacattttctcaaaaacttttttatactgtataacttagataacttgctttgagttatttatctattaagtttattcagtaaaatgtttaactcattcctgtaatcaagtagaaaatcagctcattaatcttttccaaactgagcccaaaacaagcaaaccaaacaagttcaattaccatcatactcacaaaatccagggtaaagaaagcgtcaactctccaacacttctatgttgtcgtgtgtagacgattattcgggttgggtaaagtagtactctacatagtacatacacccctcgtactgtacaggccgtcctacataataattaaggaaaattggagccatgccattataattttgtaaagtttaagatatgccatcctaactcacatgttattgatttatgtgggtcctacatgtcattgagataccgatggcatatctcaaactttacaaaattataatggcatggttccaaattagcctaattattactacctcccacacgtactcctacaccactacgactactccagttaaatttaacagcagctccatttatatctcgctgaacgaaaccactgtagcccgtgcccggccggtcgtctaccgatgaaaaccacttgttcagatccaccctcgcggtcgtcacggtaaaagtacaaattttcccggccctccgcatgtaacctccgtacgtgtacgtgtgtgcgcggctcctcgatcgcctgatccccaactcggtcgccacaaacagcgcccggccccgcgcgcccgcggccacaaacgcaaaggccccaacccaaccgcgcgcgcgaggcgggcatggcagctatgcgcagtggagcgtgggggccagcctcgcgcgcgcgcggactggctacaccactgcacacacatacactgggtggcgcctaccacctgtcgcgtgtcgtctccctccgcgcgcgcgcactgcacgggtcgtcgcgggggcgcggctataaatacgcctcctcccccgctgcggagaggagaccagggcaagcagcagtagcaaagcagaagcagaggcagaggcagcacagcttgatcgttcttccatcgatcgatcggcagctagcgctcacagtactctcgatcgctcgctcgcgctggtccgttgattcgttgtcctagatagatagctaaaggggggccatggcatcgacgacagcgccgtcgaggaccaactctcgggtgaactactcgaacgagatccatgacctctccaccgtgcagagcgtctccgccgtccccagcgtctactaccccgagaaatccttcgccgacatcttccctcctaacctcctcaagaaggtatatatatataatcaagcaataatcctagctagttagcaacgatcgatcgatgatcatcaatcaggatcgagctagctagctagcaaatcaagaacaacaacaagaagaaggagaagataaagtatatatatggtgtacgatgatgtgtgcggcaggtgatatcggaggtggtggcgacgttcctgcttgtgttcgtgacgtgcggggcggcgtccatctacggcgaggacatgaagcgcatctcgcagctggggcagtcggtggtcggtggcctcatcgtcaccgtcatgatctacgccaccggccacatctccggcgcccacatgaacccggccgtcaccctctccttcgccttcttccggcatttcccctggattcaggtaacttaattcatgcacatgcatgaacacatcgatcactcatgcctgctggctatctatctcctttactttatttccattttccatatctcctctccctttctttcttgctttctttcttcctttttcatgggttgtttcggatgaaaaagaaaactctatttcctcaaaaaaaaaaagaaaagaaaaaaggagtttccattaattggttgagttctactaactagtactgttagttagtactcagctccttaatttactccttgtgtttggacatcgatgcaacctcatatattaaccagctacttttcatctccaaatatatactagtaccaaaattctttttcaaaaatcactgtacaaaaatatattttccattatctttcgaaaaaaaaaacttcccgtgaataggagttgtcagcatgtactcctggacgtgcacaggaattagtcacggcttaattaagcaaaactttggagcctacctggcatctaccactccttgaaaaataaatcgcatccactgtacacatggacgatgcataaccttctgacaactgaacatattcgaagcagccagccaaatagttcatcctattcatcaagtagctaggacacacaagttgataaaagagtatataggactggctcataataatgccataaaatatactttccttttttttttgcgaactataaaatatgttttctgcctcagcatatttgtccttacctagtctggcatgaggccagtagcatgcatgaggaattagcaagctgacaaaaaataattggcattactggcaacatgctgggctaatcacaacatgtgaacaagcccatcattcatcagatcgaaccaaggctctaggtaattaaaaaaggacaaaattagaacaaaaaaaaaggagaataagacaatcagtagtagtagtactttttagatgagaaggataaggcaacttgatgcatgatcctctcccatgattaattagctcataattaattcggcttaccatgaaagcctcaatgagttgccactaaccccaaccaccaccacgtaccagcctaagctaaggagagggggtttgacattcgcatggttcccttgttaaccatgtgatttttgatcattgatatccttaatatatttatatgcatacatacggccttgctccctagcaaccatattcccaattattgcgaagccgttcttgcttgtaggtcacaaatacaacatctcacgtacgtacttgagctaaccaaaccatcggccgtgccaacaatggcattaaagtggaatagttctggaatcagccatgatgatagaacccaaatttcaaaaaaagtataacttccagcctctgcaaaaccacgaccatagataataatgcctatatatgcttagaaagttgccgggctttagctatgaaaggcacgtgtgcacgcttctgaatcacgtacgtgccctcaatctgccgtgaaaccacgccggccgccctttcggcgagaagaaattattcgatccgatgcgatgcgatagatgctgtgctcgctcttgcgtgccagtctctcgccacacgcgagcatggctagctaaggatctatagctaattaagctacttgcagcatgtcgatcaatctgacccaacttgcccatacagttagccagccagccatattgcatacttgcatgtctgaatcctgatcgatctgagtgatgcccagagatagatagatagatagatagatacgattattcattctctgcagcgatagatttagatcaagagggggagttcaagaagactccaaagattcgtacgctcttttaattttttttctcccttttcttcccatgtctcgatcggccgtataatcgatcggtcgcgaggagcggcgtgcattgcgttcgcggtcacatcacgatcgtggagctagcaatatatatagctttggttgtgtggcgttttcgatcggatcctctaagcaaagcataatattattgagcgtagtacactacggccgtcggccgtgtggcttatacgtattcgcggctgtgtgactgtggtgtggtggtgtgtggtttgcaggtgccgttctactgggcggcgcagttcacgggggcgatgtgcgcggcgttcgtgctgcgggcggtgctgtacccgatcgaggtgttggggacgacgacgccgacggggccgcactggcacgccctcgtcatcgagatcgtcgtcaccttcaacatgatgttcgtcacctgcgccgttgccaccgactccagagcggtaaatataataatacatttactcacaagattaattaattggcttcttaaatctgctgtaaataattaattacaaaaaaattaattgagatttggtttaattttggttgcaggtgggtgagttggcggggttagcagtcggttccgcggtttgcattacgtcgatcttcgcagggtaattaatgaatcgattactaatgaccacccctaaacttgggaagaattaactagcaccggattagttatttaattaaccgtaatcaaaatattttagtaaccactagtacgctgcatgtagtgggtaatagctaaccatcgtggcttttcaacaaacctctggaaaatctagcttagctgacgacattctttggtagaatcttcgttgttcagcccacataattatttttttttctacagagaatttaaagcgccatatttataacaaggtgtcacacacagactgacgtagagcagagccggactcagatgacttatattagtatacacagtacttagatagttaggttcaaggcacatgcaccaagctagctatgtctctcacatcgatcagccattaagctactgtttaattatgtacttcacaaaacgacgttgctaacatggactcctgattagcctgtacaaaccattctttggacctcctaacactcacacacattattcctgaccgtatcactacaaggacacaacttgcatgtactgactgaaactaaaaaaacttctaaaaaatatataaaataagaaaaggggtaattaaccatagtataaagtagagacgagtagtgaaaaagatcagtatgtgttgattaatggggatgtatagctgattaagacgcggcgaaatacgacgcgagtggaaattgcaggccggtgtcaggaggatcgatgaacccggcgaggacgctggcgccggcggtggccagcaacgtctacaccggcctctggatctacttcctcggccccgtcgtcggcaccctctccggcgcatgggtctacacctacatccgcttcgaggaggcccccgccgccgccggcggcgccgccccccagaagctctcctccttcaagctccgccgcttgcagagccagtccatggccgccgacgagttcgacaacgtctaatcgccctgacgccatggacccacaccgtactgctatactgtatacgtatatacatatgtatgtatgtactgcacgcgtacgtacgtacgcacgtgcacgagcgcgggaagccattgtttgtacgatcgacgactctaccaagtcgaaatgtaatgtgtacggtgtctgtgtacgtgtggtggtgctgtgtgtacgtgggcccgctctgcttgaagaagaagagagagcttgagctagctatacgtgtatacatgtaccgtgtactatacgtacgtgcgtatttgtcttttttttttcctctcttccctgcgcctacgtgcgtatgtacgtacgctttctctcgctggtataatcagctggcgatcgatagcggcaaaaatatgttatgtgttcgtgtcagtctctttggctttgtattaaaaatcaatctgagttaatgaaggagctgagctttgcttgtcattgatttggggtgaaatttttgtgcggtattagttgagaatttgtgggctccattgaagatttaccttttggttttataacacttaccaatatagcactatgtccctagcctctcactatttatttttatggatgcatatgaacagcttttgtaaatagagatattactaattactttttgtctgcttattgttacctgaagatcaatcatagtgggtgctttgatcgatcatttggtgatgatagcaccatcatcaattaaaagcatgggtttaaacatatgttactgacagtttaattaattaattaagtcttgttgactataacttaaaggagtgaaataatttaaaatgacgactctgagatgggaattcaactactgcaagtaaccctgctggtttgctgctcttgttttcatcgatgcttgcaacacacacacaatcatgcacacatgtcgttaattcgtaggaagctgagagatttggttgttagaaaaaggtggatgaaggagaccagcagcaaagttgctttgcctaggcaacgtgaaagcacctgcagagtggtcaaaattctttccacttgacacagtaacattccaaaacagaaaaaaaaaagagaaaaggttaagaagcttcctcccactatatgaaaaaaagaaaagaacaacagtgtccactgaagtaaattacaaatagtcaaatactgtaccttcaataatacatgtgggacagaagcactacaagaaaagaattaagagcaggcaagtgattgttattttcatgttcgtgatttatatgttcttccactatacctcttgtcatccatgactcctgctacttgatgtacagggagaaagttatatccttttccttgactttttgacttggttaaaattttgtctctcttctccaaaatcacatcgtttgttatttatccgccaataactctataaactggataagagtttgtctcttcgcttgatgactattttgacttaaaaaaataaatattagggaaggacctaatatcaaataaactagcatggtgacccgcacagatagcgcagctaatatcactatattttttctcaaataatagcttaaatatttttcacatttatacttaaatatattaaaatggcaacaaaattttaaatctattatattattaaaggaatagaaaaaggagcctccatattcgctctcatggcctagaaattcccacattgatcggagaaaaagaaaaaaacagagtccatataggaatacaatttagaaatagctgaaattcggaattaaaaaacaagaaatattagaagagaggactagagtccatatagaaatacaatttagaaatagttgaaattcggaatttaaaaataaggaatattagaagaggagactagagtccatatagaaatacaattaggaaataactgaaattcggaattaaaaataaggaatattagaagtagagtatagagtacacatagtacatatagagtataagtaaattttatttcgggctactatattatatatgttcaccaaagttgcacaatagatcatgccagactcgccaagaagaattatatatgtcctgacgtaatgatttattatttttaactagaaaaaggaatctattaacttattaaaggaatagaaaaaggaacctccacgttcgctctca

SEQ ID NO: 69479 - DNA, 693 bp, Oryza sativa
atgttctttcttttagaacttgttacatcaaacattaaaagcacaacacgtgcacaagggatacatttgttagagtacgcagcctgggccaccgaccatgtcacccagatcacattgggcctgctccaatacaggcccaaccggagccacaactttaggtcctgagcctacacaacccaaaagactagctccggtttggaacccggaacaatttccatgggtcacatggtggagagcccgggtaacaagttttcggggtcacatggggttaatgtgacgagggagattgttgggcctgaggccaggtaacaagtcttcgaggtcacatgggttaatgtgacggggagattgttgggcccgatgtgtgacgagggagattgctgggtttagtcccacttaaaaggtggggcggtcctcaccccatcagactagtcttttgggttgtgtaatcctaggacctaaagttatggcttcggttgggtctgtggtggagcagacccaatgtgacctgggtggcccacggttggtgggccgggctgcgcactctaacaacatttcagctgctcaagaggcaaaaagcaggatttgtttggtggaactagtatttgctattacaaacatgattaatatttttgacagcttgctataggcaaaacaacccttgcttctctggccttttcctagataagtaat

SEQ ID NO: 69480 - DNA, 2139 bp, Oryza sativa
actcgtccatttctacattgttttcttggtgctcttcagcagttgctttcgctattggcgtgggatcccatggtatcatggtaatctgttggattggaggaggggctaacgagcacccgcaaccccatggtgatctctgttttgtctccctctctgtacggaatggtgttgttcttcttgagttcatcttccgttgatattcctgggcctttattgatgtgtgcatggcaactctacgtgttcttcatcttctcatctctcactttattctgcttacctcttatggtatgttgttgttccagattctttctgcatgtggtgatttgggtgctttcaccttctttcacaaatgtgggttttgacgttttgttgattcctcttgttcttgttgattcttgatgatgttgtgtgtgcggaaaactcggtgatcgttatctgatgagcgcttattgctgttgagtgctaacaaacggtgcaagagtaattatcggtgtttttttcttcatgaaattacttctgattcttttgatgtcaacatgtatttccaattatagatgtaacttgtaagttgtaggtccccctagtttttactttttactgaccaagcgatctagttgtttcaaggttcgatggtgccttattattgattttttaatttccccattatggtatcaagtgctattctgtaaagtagcttaataccagcagcaggtgttattgaaatttcagagggaaatcttagcctgtgaatagttctcccctttgtaatgatcatgtgccctgctggctactgtgtttagtttcgagacacttttttggatgttcttttgggttctgaaatgtggaagagcttgtcattttggacgctctcttctttttaagacgtagtgacttggatcaatattgaacaacatttggttaaccagattgtacatcgttgtgttcactttagtctttttcaggaaagcaagtcttgcgatgggtgcatctgccagcagttcagtaacatcgaagcttactaacgatggagagaatcagaaagttaagtatgcctcatcaactatgcaaggatactgtccgacaatgcaagatgctgtgagtaatcttgcactgcctttatcaattttgttgggatcataatcctacagataaagtgttaacttgctggtaattgtggccaaacactgagcttgatttattcctttcttattgatctagcttgcagttgaactagatctagatgcattaaggaacacatcattctttggtgtttatgatggcgatggaggtttgatcttcactctcatctttttccaacaaatgtccaactattcatctgttagcataacagaccttcgtgtgttagttaaaatattgtacaattcataatcccctaaaggaaagagagtgtccatttgtgtacataatggaaatatgtcaactgccatatataggctgtgtttcctatcaaagattctagtaacacaggattgcagttgactcatcatccattctctattttataaaatatccatactgagtttttttttaatcttttctcttcaggagctgaagtagcaatgtactgtgcaaaacgatttcatgctatgctttgcgaggacgaaaactatctcaacaatctgcccaatgcaattacatctgtgtgttccaggttattttgtcgataattgtttcatgtactctgcagatggtgctacataagtccactcctatttttcgatggtggaaaaaaggggacattgttgcacccattttattcatagaatcatagttgcaatatgtcttggaaaaacgaattatgtaatcagtgttccttcttaatctcagacttgatgatgatttgcaacgatcaaatgaatggaaggagtcactttatccccgtggtaatggtgaatgtttccagttccttaagactggcgtttgtgctaacctctggcattccgaagaggtgatatatcaatttatgattgttctttacacatccaactgcacagaagttaaccaaagttatatttctagtcgtattcgtatagagtgcatattattatcttgaagaaaatcaggagtatgcatgatatgcagtccatatttttctttcccaatgatctggagttccaa

SEQ ID NO: 69481 - DNA, 1001 bp, Oryza sativa
atcaggaatgtcacagaattttaagtgaagattggcaacagttggaagagcctttctattaagtctccaaataaaagttttaaatttaggaggaatgcacttagtggaacagattttcaaaagaatattaagctgcaaagaagtaacaattgtgaaaactgaatgtgatagattatatacctgcttgtatgcactctttgaagtacattcacctgaagaattatgaatccagcaaattttgtcttcattgtcccgaggaacgatctgaactttcattatatgttgtaccattggctgatcaaatatttgattgagtttgctcagttcccaacatgtcctgtcatcccaaagctgagaaatagtattaggagatgcatttgcaaaaatcattccaagaccgccaggaaatacctttcttagagccttcattatgcactcttgtccaccaaaaccgcgctaataatagctgtcaacttgttcaataagctcttagaatgtaaaatcgtggacatacagtaaatagggattgaagcgaaaacatatttaattaaagacaagtggctagcatgagagagcatgttagctttaagagaggtaagacgagctttgaatttggaaataataaacttataagcagaagctctagttcttgtgttaataatcaaagggtgaccaagatgtttagtggaattttctatcagagggacatgaaaaatattgagaatttgatgtttttgttgattaggagtgcttgagctaaagaaaatagaaaattcccccagttaggagtttgaacagattgagcacaacaagtttgaacagtttgaaaaattctagtagcttctccatcatttgcctgacccacagtgattaggttatttgcatacatcagagaatgaagaattgtacctcctgtcgtcgttatccctttaatataacctgattgcctgcatctaaaagagactcagaaagttcattaattacgagaacaaataaataag

SEQ ID NO: 69482 - DNA, 10611 bp, Oryza sativa
tgaggaaaattagaagtttatatatgtagaaaagttttggatgtgatgtgatgtgatggaaagttagaagtttagggtagttgagggtgaactaaatacggccagagtaagaataagaatttacggagaatgatgtcattgaagtggttgttttatctttaactatactaggcatgtgccctaattaagactttcccctattcacactttatagcatttcatataaaaatatcataaattaaatttatttttaaatttaatatactaaaattcttatacaatgatgttactcaaatttgtactcctttaatttcgcataaacttaacttgcgttccatggaatgtcatggaatcactggttaatctatgtgctaattgcagcatatattggttggttggacctacatgtcaatgagacgcattaagaaaatgcaggttaattgtttatccatgtagaatggttactataacagatcgtatatatccagaaaattttggccttgtgctatttcggaccttaggatgtaaagtccaaattaatgattgatgcatggatcacaagcgcactactacaaactcaggtctccatcgggtcattttctattagggatgtctcatgtatatatagtgcttgtttactcatgggatcacctttgtgatgtgtgttccaatggaggtctcctgaagtggtgtctggaatcttggaaatttttttatcattgataggtttattactgctggtaaaaaataatgtgaaaagcagggagcacacgcagcttccttctgtcattttccttcaccacaattaaggtgactttggaaagtcagggttcagagttcagacatggtttgacataagtaataatatttatgttactaatcaacccaagataattaagtgagattaattagctgattaagccaaatgaaagtaggaggaaagagggtggcatggcaagtccagtacaactctgctggatttgatagggcatgggttagtgcgtctagctttataattagatggaacaaaaagattggaatatgcattttgggcctcatgttttgcttctccaattcatatggaggcaagcatatacatttagcccgtttattattagcctctagttcatactggccgttttgtttccagactaagaatctcataaagtttttttaccaggatttttgtaggtaagctttttagctgtacgaaatggtgtgcacctcacaagcgaaagatgctctgtttttttagttaggatgtcacatgtaacggttcaggtatactttttaattttctttatttgatcaatgcgtgagtttctttttttcaccttttcatagaaatttccagccttttatctttcaaagattaatgcggagacttctagaagaacatgtcaatatgtactatatataaaaagaagattgttgcagtgttttcccacaattaagaaaatgacatgaacttttgaaacacaaacttaatgatttctcatatgcgtaaactttgtctctaaaggtgctaccataatattttaattgaactggctgttagtctagctttgctctctatttattttttgtaggtaggatatgatctcgtccacagatccaaatgttcccggttccaacagcaaggaactataagtgcgcctctcttttccaaagaaagtaaaaaatttaatatagattaaccattgatgggctaaattacctggtacttgatacactctctggtccacagatggagactgattaattctaagccactactttagcttgtcatgcgtttgtgtgtaggtgatttatacttcggtaaagcccacttagctcgaatcagaagctgtcatcttattcgacacgcagctagtatatatggatgtatctccatgatactgacctgcatctccattgttgttgccattttctgaaagcaatccccattaccattttcttctctcctggtgttggtcttagcaggccaacagcaaactaaccgtggagtttgttcgttttgagaaaccacgtacatatatataaactttgttcaaagaaattagccaatttctttgctagtggtgaggatactgtttagtttctacgcactttggtagcaaattctatgatcgatttgggtgcgtatgtgccattcgtgtaatcgtaaaagaaaaacatatatgattgactcagtatggatgtgcaaacacatataattcaagcctttcaatccactggtagtgatcaggatatatactatttagtttctacgtagtttggtagcaaattctacgaccgatttggatacgtatgtgcctttcgtgtaatcgtaaaaaaaacatatatgattgactcaggatagatgtgcaagcacatacttccttagttgatagatgatgccgtctttcgaatatatgtttaaccattcgttttattcaaaaaatttatataaatgtataagatatatatcatgtttaaagtattttgagtgctaaaacaactcacaacggaataaattataattacataatttttttaataacacaaattgtcaaacgtgtgataaaaagtcaatgacgtcatctattaaaaaacagatagtataattcaagccattccactggtggcgaggatactatttagtttctacgcactttggttgtaaattctatgattgatgcatgtacgtttgtgttttctattagcctcacctgttacacatgttccctaataagccaaaatagcttattaggaaataaaaaattaatttgtatgtaaaacttttgtatatatgtttttagtgatttaaaagctaatataaaaaaactatgttgaaatatcttaaaattaacttcaaaattaagtttaaaaatcaaattttgattttggttttagcttattaggccaaacggtggagccctatgtaatcgaaaaaaaatcaataattgacttggatgcatgcatacatatataactagccagatgggacaaacccccaacttatgccgatgatatgatctactaaaataatatttttttcaaaatcacatagatactatcacgaaattctgtaggtactacgccatccaaactggaataaaagttccttaactactaattccaagcgtgtagcaccattgcgcatagtatcctgttattcctgtgaaagcatcatacaccaagagtggagccaattggaacacatgaagataacttgcatgatgttaggcatttttttatggttaaaaactatatcattacggcaacgccaaattgaccaacataaagcactagctccaaacaaaatcgtttttttttttgtctaggcactccccttaactggtcaccaaaaatatcttttacattgtggggagggggatgttgaaggcaaagaagacacatcgccaagcaaaatgtgcaacatgacagtcaaaaaaaaaatgttggatggtctcttatgtattaaaaaacaacattgcttgtttcccctccaatttctctttataagattatctttcgttaagattactttatatggatatatacctgaaattgacgaatgaaagaggatacggagcagcacggacagggatcgagctagttggacaaccgttagcagctagctgagtgaaattggccggttcagtaagaaaattaagtagagtatgtggatttggagacagcagtaacctgcatgcattccctgtccgtgaggagaaggagtgcgtaccagacgaaaggcggcggcagctgctggatcgccgaagagacgagggcggcggtcggctgcggcgcttgcccgatggctccgtgagaaggcagatgccgccggctagctccgtggcgacgctggtccggcgagggcggcgaagatggcgccgcgatttccctcgctggctcgacaagaaagcggcgacgctggccgcaggctccgcaagaaggcggtgtcggcgccgacgaacctcacgaggaggcgatgaagatttggggattttgggacgatgggtgcgctgattggttaggagcgatgacggaggggatcggggtgatgcggctatgaggcgtagacggatggatcgatgaacccgtggacatcgtcccggacggtgcatcaagggtgaggtcctgtagtactgtagcaggctttctgggctgagaatcgtcgattcactgttggtagtgggtcacaaaaactaaagatttaatatgatatgatatgattcaagtcaatggttttttttttaagaagggcaagagctttgaggatctgaaaagctttcaagtcaatggtcttttggtgagcatactttttagtttctacacatttcagttgcaaattgtcctattgatttgagtgcacataagccttccatttcataaagaaaacatctgcaaatgactcggatgatatgcaaacccatataataattcaagccatcatgctgggacttggatgtcagcgacaaccactgtatagacagtactgcaagacagtccctatccatgtgtgttggtacttgtaatgaggatactattcagtttctacgcactttgtttacaaattctatgattgatttggatgcgcatgtgtttatgtatgcgttttccatataatataatcggaaaaaaaagttctacgattgactcgagccaatttgattcgagccaatttcctagtgggcaggatactgcttagtttcacggtttgattaattgcaaattctataaatggcgcttgttcgtgttcttgttccatgtaatcggaaaaaagaatatgatttgcacatatacattgtaatggatcaagctcatacaattgaagattgactgggtgggtgaattaagaataaaacactgcacgggtcagatatatatttcgggattggctcggtttgtggttacctaagaaaagtaccggatgacacttacggtgggaaaggggtgcaagaggatgactccgttttcaaaatagtagacaaatgatagaaaaggttgtgtgtgtgtgttttgggctagtttaccacacagaaatcagaaatgttaactttcggccttgctgcatggctgatggctagttgatacccagactgcccaggccgtcatcttatctgaagcaattggcccatatcaccacatgcatcggccgaaagggcccgacgtccaacaggaactcactatttttggcccaatattaaacacgagagtggcgactggctgctttgggccggctctatgggaaacaaaggccgtcttctaagcccaccacttatttaaaatttatttgcatctgattcatgatcaatttagggtgtataggtatgcaacattctgcaatttatttggttaaaaaactttcaaatgcaattatattataataaaatgtgatcagcagcatatttctctcaactaccccattgatatcttatttgtttcttgcatggctgcatgtatttttttttagaattacactgaacaatacagacactcacaacgcacgcacactcacccctatgaatgcacgcgcgtaaatcctacccctataaacattttcgaagactgggccagcaaatcctgtattggacagctgtgggagtgcatgtaggatcgaagaacatggagcgggaagaccaattaccaaagcgactccaggactgaatatcgatgcagagttatgaagtttgatcacgcccgcgttattttcgtagtctcgctgcccataacaaatgtgacgatcaaaaccgaatggaaaactatttgacagcttggttgcgctagcactatgagcttatactgaaatcaagggcatgtttggaaaacttaaaattctaagcaagaactggttggtagccagtttcagagaatataaaaaggttgggttttccagcttctgggtctgggttctagttcattttctagattctataactatggattcttcgaatttagaccaaatgctgaattatttgatgtagcttctgattttacgagaagctacagcagctagaaactcttccaaatatgcaacaaatcggatggataatcatcgaaactagaataataaattttattgtttgaaactgagatattagatcaccttggaacgctgatctggaggcaagtcggatggatggattagggatcgacttaccgccggtaaccgcgcggttaccgtggttaccgggcttaccgcgggggtacggtaatataaataccgcggtaacctccttaaattcaaataaatttaaaaaataatttatttttttgataaattttgcgcagtttcatacggttttcacggttaccgcggttaccgcgcagtaaccgtgcttaccgccggggcgcggtaaccccggctccggcggtttgggaaaccctggatggatattcatcgaaaccggaataaactttatttggtggatagatatccatcgttcattttgagtttttttaaacatttaaactattcgtcttattcaaaagattataaaattgttatctattatattattaaaatggctttgaaaggaggtaccacgttcgttgtgggggctagaaattctcacattaatcggagaaaaagaaaatgagagtccaagtagaaataaaatttaaaaatagctgaaattcagaattaaaaataagcaatattgagagaagagtccatataagaacccaatacaagattaatctaaattcgaaataaaaataaaataaaatccgaaattagaaaagaaaatgagagtccaagtaggaatacaattttaaaattactgaaattcggaattaaaaataaggaatattgagagaagagtcgatataagaacacaacacgagactaattaatattcggaataaaaataaaaataaaatccaaaattggaaaaaagaaaacaagagttcaagtaggaatacaatttaaaattaactaaaattcggaattaaaaataagcaatattgaaagaagaatccatataagagcccactacgagattaattaaaattgagaatgaaaattaaaataatatccaaaattagaaaaattataagagggttcaagtaggtacaattttgaaacaacttaaattcaaaaataaaaaaataaattatgaaattagaaaaataaaaaagatttcaattaggaatacaatttataaataactaaaattggtgataaaaaatagactattgaaaaaaaaaagaccatataaaacacatgatgagataaaataagtaacagatagggatagcaatcgggcgcgacgggcacgggtagtgcctacccatacctgtgcccatgagattatttgtgcccgtgggtatacccattactacatgacgggtaaggatgattgcccatgcccattgccagcgggcgccttgtgcccacgggcgtgtccgtttacccgacacaacaaaagcagtggaacaacaagtctacaagcttctaagttcgaatcgaacttaaaacatcaaatattctccgtctcaatgtggtgtctctcctctggcggcgatagagtaaggggaagagaaataataaggaaaataaaagggaaaccgtagaaaacaaagaacatggcttatgtattctagtggattttgctcctcgcctacatgtaagttagactttacgggtaaacgggcaaaacgggcatgggtagtgattacccatacacatacccatttacctatcgggcatagcttttgacccaataagatacccatgggtataaaatggagaacaaacccaaccctaatagagtttttacccacgggtaaacgggcaaacgggcagaattgccatccctagtaacaggcctataaaggagtagtgtggtggcggttgatacaacatataaaaactgttaataaaacaccaaatagaatcctaatgacgattaaaatgaggaacgacaggcaggctgtaaagctgacgggcaagacggttgcttgaacttctagaaagtaaaaaaattaaaagagagttcaagtaggaatacaattttgaaacaacttaaattcaaaaataaaaaataaattctgaaattagaaaaataaaaaagatttcgattaggaatacaatttataaataactaaaattggtgataaaaaatagactattgaaaaaaaaagaccatctaaaacacatgatgagataaaataagtaacaggcctataaaggagtagtgtggtggcggttgatacaacatataaaaactgttaataaaacatcaaatagaatcctaatgacgattaaaatgaggaacgacaggcaggccgtaaagctgacgggcaaggcggttgctggaacttctagaaagtaaaaaaataaatcccattgataattataattgatttttaaattcttaatgacaataaaaaggagaaacagagcgtggggtgtataggagtgtagttgcagagccactaatggttggcaagacttctagaaaataaaaaatgaattccaatgatagatatgttcgatttttagaatctcaatgataataaagagtaggcggcggatgggctgtagaggagtatacaggcatcgtttgacgggacttctaaaaattataaaaaatgaaacccaacaagacaataaactctaaaaactacaaggagaaaatttttatatgttcggaacttctaaaaagtaaaaaaaacccaatgataatcatgttcgattttaaactctgtgacaataaaatagggaggtagcgggcgagccacaaaaggagtacaatggcaaagccgctgatggtttggctggacttctataaagtaaaaaatgaacccaaacaataattatgtttgatttttaaaatcccaataacaataaagagaaaagacagtgaacgggtcgtagagaagtataatgacagcgtttgacgggacttatagaaattataaaaacgaaacccaacgaaacaataaactctaaaaactataagatttaatttttagaggtttcaaggtgaatgaatagaaatagtggtagatcgagcaagcaaataaagaaggatatgacagaagtaaggggtagcagctggcgtgacttttgaaaactatataattagaaatacagggatggtaaggtttggtctttcaaaattttaagacaacgacatagctatttaataaatttgaagtaaaatcatactgaaaaatatatgattttgtttaggtgctagccgcgtaattgcacgggccacccagctagtttattttatttgtgacttgctttattattaaaagtatattaactatgatttatcttttttatatttatactaatttttaaataagacggataatccaacgttataactaaaacaaatcaaaatgacgaataatttatggcggaaggggtacaaagcatgcgtgtgcgttcatcctcatgtcggtacacgaagacgttttcacgccgacgccgacgcggcggcgcgccgcctctcctccctctcgagcagccgcgcgaggaggagctcgtgcggcacgctggtcccgaaccctgcgacgcgctcgtcgaacgcggccatgctggcgtgcacgtgcggcagcgcgtccggctccacgacctcctcgccggccatggcggagatcgccctcgtcccggcggcgcaggagcccagtatcacgtcgagcagccccggcgtcgcgccgtgcacgaacgggccgccgacgaccgacgacgggaagtccctctcaaacccggcctccatcacggccatccgcgccttcatctcccgcaccgcctccgcccgctcctccggcgtcggcgcgagcaccgccgccgcgcgcgacagcggcgacacctcgccgtggaagaacctcgcccagaacctggccgcggcgcgagcgcgcggggacgacggcggcggaagcagccgcggcgcctgtggccacacctcgtcgacgtactcgaggatgacgagcgactcggcgagggggcagccgccgccgccgccgtcgtcgtcgacgacgaccagcaccgggaccttcccggcgtgggcggggttgaggcgcagcagcagcgtctcgctcttgcgctcgaggtcctcctcgacgtactcgtagcgcacgcccttgagctccagcgcgttcctggccatggcggcgtgcgcgctgccccacgcgccgtacagcttcacctccttgggctgcgccgccgccgccaccgccgccgtcgtcatcgccatgcttgtgatcttcgtctactgtgctggtgagttgctgtgagtttcttctacttgtccatggatgataaattcatcgatgaatatatattcttgcggatgctgatcttcttgcggattaagaaatggatttggtttttgcaattgaaattggaatgctataagggaggcacgtgtatggtgttagaatggaaatctttcgacgtggctgtgcttgttcggcaagaaaatgttttaatttgttgattactctagtcgagtagtggagttggtatccgatcctaaaatattcatgcatcgagtataagctggtctgtttgataagcctacaagatctttttccacgaattaccccctcaacaattacgtcattcgatttttaaccctgaactccaatactagttatttttaa

SEQ ID NO: 69483 - DNA, 690 bp, Oryza sativa
cagagtacaatgataaaggtgcgttaaacgaatccaagtgactctcaggcacaaatgtaacggactgtctcctatgctaatggactgatggcatcatactacgtacttagtggcatcccatcaacgtcgccttggacaaaaataggactctctggaccttcttttcctgatctaaccccaaaactccctgcagctagctaagatccttgcaagaactaaggtgcactaaattggagggccagtgattagtcattgtcattgttgatgtcaagtttttcatcaccgccctcggggttgtgttgatgttcatccctggcactggcaacttcatcggggtcctcaatgggcttgaacttaaccagtatggcagtcgcgttgtcatttgagtgcaagcaatgaccaacaagcttctcacaagtctcgcgtagattttcctccccctgtgttggttaacatgcatacgtcaaggcacaggccaaagggcataataacaattctagcaacaaatgaatgaacagcgaaaaacatcctacgatcttcatatgtagactttagatttcaatctcttgataacaaaacgaagcagatccatgcacatgtgttcagaactggagtaaactttcattgatttaatttaagagtgcatgcatgaaaggaacttctagagaggatgcgttttttagacaaatg

SEQ ID NO: 69484 - DNA, 615 bp, Oryza sativa
gctgctagagggcccgcttaatataatatcatttcacttttcagatcaaatcagtatataccgggaagaaaaccaccacggtgattctcccacagcattagtgattagtgtttaatccggcccaataattccatgaatgaggtcagagagtttgatcaactaccctgtcctggtctttttagtataatggtgtgtgtcagtgtgtgcgtacgtatataccgcgtaattagaaaaataaaactacgtcccatccttatagtcaggcgtactatatacatatatatatatatatatatatatatatatatatatatatatatatatatatatatataatcattgttgatttgtcaaaaaacgcatctcaaacttctcagaaaaacatataattgacggggactgttcaaatcgaaaatattgtactttgtatgaaagaattacctgcacgcgatcacaactccgatttggacaaaatattttataagcacagattttataatcgaaccaaagctggggccacacgcgctgtgctagaaaccgattaataaaccggtaggctcacaggctcacagtgcagtggcccagtggccgacggtgaggtcattggagacaccc

SEQ ID NO: 69485 - DNA, 21210 bp, Oryza sativa
agcccgccgcgcgagcccgcccgcagctgttgcccgcctgccgcccggcgatactgtcagctatggatgagaaactgagagagagagagtagaaactgagagagagaggagaggaagagtcagaagagtagataaggttggggtgaaaaaaaggtggatttttttttcaatgtaaaaatcgactttttttatatgtggctctttaaaatgaattttaaggcattaaaatcaactcgtatgaaaaagttgtcaaaaacaaagttgtataatttattgatatctaccatttttattttggtcatttctccatccgagtttcattaaactatataaaatttgaatttaaaaatctaagaaactcaaataattattcgggtagtaactgatttcaaatgaaaaaattgtcaacaacaaagttgtataacacatcaacatttacaacttttgttttggacatttttcaatatgactttgtttgaaccgtttgaatttgaatttcaaaatatgacaacttcaaacaatattttgaaatactaagtgatttcaattgaaaaagtcatcaacaacaaagttgtataactcatcaagatctataacttttattttggttgtttcttcatccgacaaagtgatagtatcattgtttacaaaatttacatctatctcatctggttctataaactataagagagagatgtaaactttgtgaacaatgttactatcactttatcggatgaataaatgaccaaaataaaagttgtatgtcttgatgagctctacaacttttatgttcatgactttttcatctgaaattaattacagcttcaaaatattatttgaagttttgaaattcaaatttttagttgataaaacaaagtcacaagaaaaaatgaccaaaataatagcagtaataacacaataacatgatagagtatgattttagaaacatttagaaaaaagaatcatccaatttggagttcatatgagtgagataaactagtctcaaattttcaaatttatttttcataccgcttcttaagtcacccgtatggaaaaattgatttttccatgcgggtccttaagtggtccacatacaaacaaataaaaaaaattcaattctgaaaaataaacactcgaatttttaaaaactttcaattgaaatgttcaacccaaaatttaaaatattcatccaattttcagaaattttaatgtgcctgcgaaaatttcagtgatatacattaatttatctgtttcatgataacatgaatttgtatgaaaagtaaacataacattttctatctcccccttgcccttataaatagagataaaatttgaaaatactgatgttttgtttttgaaaactaatggctacatctctttctcgatttaagaaacttattttgaggggtcttgatattttgataattattcgttaccgtattcgtttcgattcgtattcggctccgtatctgtattcgataatattcgattccgttttcgtatccgggtttccgattccgatttcgattccgagaaaaaaatatgaaaacgaatatgatatagctagtttccgaccgtattcgatccgttttcatccctatcttgcactcgtcgtatgcatgtttcagtatacgggggatacaatactgctttcgattttgctatatctcactcaaaagattttttcttatctctcactcgattttctcactcaaatttacagtatattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatatatcggattttaatccaaagattaaaaatctgtgtgatacgatcataaaaatctttcgaaagatgtataggtactccctactgcttttgcaatgtggtgggcccccgtagggttggggaaagctgaatgtttcataccccctttaccctcccgaattgttcccaaccacacatctcgccagcgcgttcgacgtcacctttccgtctcgccccccctccccctccccccaccatctagtcgctgttttttctcgcccgcggcgatctcgtcgacgccggcgacgaaggagtcgatgccacactccgttttgtccacaccgcactctgattggacaccggcggcggcggacgttttgtccacggcggcgatggcgtatacgccgcacactgattgtacaccggcggcggcagatggaattgggtggagatcctcatcgccatcatgagtgtggagatcctccacggcaagacggtccagagcttcgtggaggatgagggcgccttcaactcctccatcgacggccgctttgcagcgcttgacactaacagcgagtccgcgacgtcctgctctcctacgtcgagatggccaacgagctgatgagccttcgtatgctggacaagcacttcggcgacgacgaggccgtcatgagcgccgacgagctcgtgaagctgtaccgcggcctgtttgcgtggttcgaccgtgatggcagtggcgccgttgaactggaggagtttcgggctgagatgaaggaagtgttgctcgctgttgctagtgggcttggattcttgctagtgcagatggtggtcgaggatggtcggagtgtggcgaaacacctaggcgggcgtttgtagagattcaaacaattggaaagacaaagggaaaggttccaggctcttcctgcaaactaattgatttttcgaaaaacaaatgtttgcactgtctttttttttttttgctactttttgtcctctgtgagtgataatgtgatatggtgtgattgaaggtaggaagggtgatctgcttctgctcatgatccgctaagagcctcagatagagagagagagagagagagagagagttcttccatagagagaagagagaaagaggaaagaacaaagagagtagatctgagatgttcttttatctatttgtattcggattattgttttgctagaactagatgaacaaaaaagattttgtttaagttcgaatcaattttcgtcatcccaaaaattggctcgcttggtcttaattataatcaataattttgaaacaaaatctcagtaatcagaatgtgcaaaaacaattgtgttgtaggtttctttctttcgcccggcaaagtgtaggggaaaaacaagcaacaatgggcaaatttattcaccactattgctaaaaagaattgaaactttaaaagccctggagttaatgcgtgctcctgcctcgtctcggcgtccgccaatgaacggatggagaaggaccccaagaagctcgtgttgtttcttcgtctcggctcgccggtgtccgctcacagcacatataaaaatcgtagtgtttgggcaggggaaggatgctgcttagcagcttgccgaagagctcatcgggacgggcgcgaagatggcgcgctttgaatccgaccacgaccgagagtcctcgtcggcgaggaacgccgccgcgtcgagcacgaacaccggctactggtcgtcgctgggcgtgaatgcctggatgcttctcaacagcttgcctcagcgctcgagcaggccgcggtcagtccggagctcgtcagggcgggcgtgaagatggtgcgctttgacctcgacgacgacagcgagtcctcgtcggcgaggaatgccgccgcgtcaagcacggacatctggcacggctgctggtcgtcgccagctgtgaacgcctggatgctgctcagcaacttgccgcaacgctcgagcaggccgcggtaagtccggagctcgtcggggcagcgcgctgctgcattgcaaagattttgttagatgattgagtttccgaaatggtggtcgcctttgaaggaggtggagggctcacctcgaagtcccagcgggaggaggcgataagtgtgccgctgctggtgccgtcggggaaggtggtggacgcgtcatcgtcgagagatagcgccgcggtgctgtgaccgctgcggcggactccggcggcgtcgccggtgctcggcttcctgagcggcaattggtaactcggcaactgcgcccacgagacatgtcgctgcgggaattgcgggccgcgtcaagcgggggaagccaaactccgtgcgggtgacgcgacgcggtcgggtgaggcgagcgttgtcggtgtcgacgcggactcggctgtggcgaaacacactctgtgcgacgccgaaggccaccgtccttccaggtcatggccgtggcttccctgcgcgcctcgacgtggtctctgagcttctttccttgctcggactccatggccaacctcaccttcgcctccacctcgttggccatgacaagctcttccagccatccctccatctccacgccgacgcccatgacctccatgagcaccgagttccaaagctgttaccagcaacaagcaaaggaacctggagggtcatggcgagggcgccgacgtcagacgggtagaactccatgacaaggactcccagcttcctcacggcttcaagggcatggccgcacgttgtgttgatgaggacggcgtggaggccctgcacggagcagaggaagtcgtggaggtgttcgttgttccgtcgcacgatgtcgaagtaattcttgaagaacttaggagccgagcgtgggagggtccgggatgcactggagcgtgtggaaggagatgatggagggctttggccggagcgtcggcgagcctcgacggagcaccgcttccggcgaaggagatgcaaaggggatgcggcggcggcggcgatgctgtgtagatggggctgagaccagcgcgagaggatggaaaacgaatgtgtgacgagaatagcgaggcgtcgtatacccaggtgatgaggtgatggtccctctcccagccttcctcccccgcgcatctgctggtgggcccatcattgtatttctcgtgggtaaaaaaaaaaaggaaatacgatgcccacctcttcagatactaattgatacggtagatgtgcgcgcgaatcttgatgccatcctgtggcatgcagcctaggtgctaaaaagactttccggacgtgtggtggcatggcgctgcggtgatgttgtggtaagcttgtcgcgacgccgcaaggctccaactctgctccaggtccggcgcgggtggcggctcctcgtcggcggcgagcaatgtttgaacgccttggaggttggtcggctccgccgagagcacggtgacctcctgatggagacgtgacgacagcgacatccagacatggacgaggcgttcgggctgagggtggccggcgacctgcgcggcgagcctgagcgccggctggaacgccttcgccgacgcagcggaggtgatggagaaggccatcatgccgcgcgacgcgacgacgaggcgcgcggcgacgaggaggtcggcgtcagcaagcagcaggtagcgcacggcatcccagtcggcgaggtaggggaagaagtagagcaggaaggcgacgaggccgtcgagggatcaccgcgcgagctcggcgtcgtccaccacggccgcaacctcgtcggagacagaaaggacggcgttgacgaggatgttggagctcggatcgaggaggacgacgcagcagaagccggcggagtggtcgacggcgaggcgggcgcaggtgtccgtgtacaaggcttggatgttggagaggaggcgcgacctgttgtggagcgcctcttgtggagtgggcatgtatcgttgctgcggcttcaccacgcgccggaggctactgccgccgcccgcagacgacgcatccattggagatcgagttggagaggacacggatcgatcatcattaattatatgtttcggtccaagaccgttgcaccgatcgaatccgcttcgatttgcgatcttcctaatgtccaagatgcctgttcatcaattcaccgaaggcgccctgttggcgaacggcttcgtcagactctcgcggcgcgctccacgcgcacgacgcgcaccccgcgcacgacgcgcagcgctcctcgctccgctcgcaccgctgcacgtccgttagaccaggggattagttaggcccaggcaactcccaagccttgttgtacatgtataaatgtaagctccattgatcaatgaaagttacggttgatccaaatctccttctacatggtatcagtgaccctctgatcctagtcttccgctacctctcccttgctagccatgtcgcacagctccggcgcttccgacgcctcgtccacctctgacgaagagcctgtgccggcgccctccacctctgttcttcaaaccgtcaacatccgctcccacgtcccggtcgccctcgatctcgacgtctccaactacagccagtggcgctgcagcttcgaatcggtcctcggcaagttcggccttgaggcccatgttcaggagccgcccgctctcgacctccgcactgccgagtggcgccgtgcggatcactgcgtggtcaattggctgcacaactccatcgccaagaacatcttcgacgtcgtctacaagccccgcgcctctgccttcaccgtgtggagcgacatcgaaggcgtcttccgcgacaacgccgtccaacggtctgtctaccttgagaccgagttccgctcgatcaatcaaggtgacatgaccatcacgcagtacaccgccaagctgaagcaactcgccgacggcctccgcgacatcaacatgcccgtgtctgagcccagccaggtgctcaacctcctgcgcggcctcaacaccaagttccgctccctccgtgccagcatcgccgaccggaatccgccgcacactttcatgaccgcgcgctcctacctgctgctggcggagcatcccggcaagtgggtcttcaagaccaagcttcatgctgacggctcactcgacaagtacaaggcacgttgggtggttcgcgggtttaaccagtgcccgggcgtcgactttggcgagacattctcgcccgtcgtcaaaccagcgaccattcgcaccgtgctgacgctgatttcctccaagcaatggccggtgcatcaactggacgtttcaaacgcgttcctgcacggccatcttcaggaacgtgtcctgtgccagcagcccacaggctttgaggatgctgctcgcccggcggacgtgtgcctcctctcccgctcgctgtacggtcttcgtcaagccccgcgcgcttggttcaagcgcttcgccgatcatgtgaccagcctcggcttcgtccagtcccgcgccgacccctccctgttcgtgctgcgccgcggctccgacacggcctacctcctcctctacgtcgacgacatgatcctctccgcgtcctcgtcgagcttgctgcagcgcatcatcgatcgccttcaagcggagttcaaggtcaaggacatggggcccctgaagtacttcctcggcatcgaagttcagcgcactgccgacgggttcgtcctcagccagtccaagtacgccaccaatgtcctcgaacgtgcaggcatggcgaactgcaaggccgtggccactccggcggacgctaaacccaagctgtcaagcgacgaggggcctctcttccaggactcctcctggtaccgcagcattaccggcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggatcaaacacatcgagctcgacatccacttcgtcagggagaaggtcgcgctcggtgaacttcgcgtcctaccgatatcgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcatgacgcgcagcgctcctcgctccgctcgcaccgctgcacgtccgttagaccaggggattagttaggcccaggcaactcccaagccttgttgtacatgtataaatgtaagctccattgatcaatgaaagttacggttgatccaaatctccttctacacgcccagtgcccctggccaggagggaggtagaggggaacacgcctcgtgcttgccttagcagacccagccgtcgccgccgtcaccaacggcgcccgtagccaggggggaggcgcgcggcgacgacggtagcaggcgagagacggaggggattatcggctagccgacgacgccgaggagatcgagacgatccggatagacggggaaggagatcgcggcggtgggggaaagaaaagcggaagaaaaggatgcgagcgagtcgctaagcgacagtcaccacgttcggtgatattagctctggcttagcgacatgtcatctgctgctcaccacgttgggttcagtgacagtgacatggctggggacatggatgataggaaaagcactaccggagtgttgaacaagttgggagaaagcttgatcagttggcagtctcaaaaacaaaaaggtagtggctttctcaaaaacaaaaggtactgctggctgaactgcttggaggagaacctaaccaaactgtgatgaagattgataataagtctgcaatcaatctctgcaagaacccggtactgcacgatcagagcaaacacattgacacccgatatcattttagtagggagtgtgtggagaagaaacaaattgctgtggagtatgtacgttctgaggatcaacttgcagacatgttgactaaacctgttggacgagtttgctttctggagcttcggaagaagatgggtttggagtagacacatcaagattggggggtggggaagagttgattggataatctttgtgccaaggaatttatcttaagtgagttgcgtgttttcattattagttgcactattttgtaacagcatcgtagctttggattcttttgttgcatgttttcattattagttgcactattttagaagagatcgagcgaagatcggatcgtgggatggcacggtcagtcattgatccggtgagatcgcgcatgtaacaacctcctccgtggagaggatatagcccgttttaaatgaaataaccaaaaataagaaacaagcaagtaaaaaaaatcataaatgtagggaaaaaaatgttctaaattattttggtgcacagagtgtaactgtaagttggatgtaaacaaacacgaatcttaatgcgagatagaaacccaaaaatctattgcaggtaaaataacaaaaaccttaaaaaaattaacagcagaacaactaaccccatctagcagcaagtgttggttcaaggctgccttgaccttggcagacgtcttgctctgctcagccatagaccgcatctttccgtgcacgacgagccagaaggacttcttgcggactacttgtggagatggcttctgctctgcgagcaacacgccggcgaggtacccgacatcctccggcgagagatagagtcttgtctccgttctcctgcaccagcagcgacatggcgaccggtgattcctgcagcctcgccttgcatgaggccaggaacgctgcttgcgccgcagggtcgtaggcttcttgcacgctggcgcacaggctttgttgctccgccttgatgatggcatcgtagaggtcgagtgtggttgtcttgcatgggcgacgccggcgttgatggttggcgccatctggcgccgccgtggcttcggtggcgaagaggttggagtcggcgagagacaggttgccgcagtaggcaacgagacactggacgatctcgtgctcggagaggtgatggtaccacgtaaaaatattaatcttaaggagtatcttaagttttcagataatcttcttcctctcaatataagcatgattaattaaagctaagtacatatagctaactgagaattgaccattttgatgaaaattccattttgatgtgtcattttcttctatcaaacgaatatgcacaattaaagtacataggttatgccaattgaccaaattctggcctactaaagctcttataaaagaaacatttagcagaacagaaatcataacatttgcaacgcgaagaatttctccttcgaactataaagttcaaagacaagtatatgtctgaagaatttctccttcgaactataaagttcaaagacaagtatatgtctttaaaggaagcatttcctatccacatgtcctcccagaatcttacttgttcaccattatttactatctaaaaatccatatttaataatttacttttgactttcataagtcctgacaaaaagggaatccccttgtttcctctcaacttgactgcttaattgattcttcaagtattttcttttcaataagtcttccagacaccttgctcatttattaactaaaacaaccatttgcttaataaacattgaaccccaagaccaccctggtcttttggttgacatataatgtcccaacttgtgagtctatacattttttttgtgtttattaccttgccaaaagaaacataatctataataatctattgtttgaagaaccccttttggaatctaaaaaaaatcataaacatgactgttggaggcatgtcacgagggcctttgaccggacctgccgaaactaccaaatccgctggacatcgactaagtccaaagggtgtgcccagggcgaagcgtctggcgaagccgaacgatgaagatcgaagggttcacccccaagctcacaaccccggggagaagccattgggcgaagctgggcgacgaaggccaaagggttcgccaccaagctcaccatctggccaaatcgccactaagggcgaaagccataaagcgaagcaaaaggccttcgcctgaactagaagatgccttcagctaagggctcgggaggccctgcggccatgggggcctttcgccattaatacaaaagatattgtatacccacactaatgtccctatcataagggtatccctgtaaatttctttttactaactaaaccctagagggtaggagtctgtactaagattataaatagccccccagggccatgtaatgggggatcccaaaaaaattttaccaattaatatattgcttttattattccatcaactcattgagtgatccacatctttctacgtgacgcagttatcttttgacaacaatgactagacttcaaagcacataattcatctaaacaaatctcccccaacagcaatatgctgacctttcccactacaaaatctcttttccatcatgtggttacttagtttccagtctttatcactaagctttctaaaatatacatagaaataccaagatatgtcagacaaatgcttataggcgctttcagggaatgacaagttatattcatttaatgattgtaccaaattctcctttcatagtagattgatttcatgaaataagagttattcatactccaacggaaacaaaattttataaatttataacgtattttggttcggttaaattgcctacgtaagataaaaggttcatatagaaaatatgcacattaacaaattaactgaatttctaggtctataaattgaactgacaaatttacatgtttcaaagttgcatctgtctagtggtcatgaaatcacataatttaattccgtgattagtataaatcatcagactatatattctactcaagatattcatgtcattctataggctttatggaacagacacccagctataactcacatttaaataatcatttgccaactgctaggtcctactcaaatcacttctaaattaaaaacacttacggttttcgccttggtcttaaacttcaatctacaaactttttttcttgttcatttatttcctccaagcaaaatttgaagcttccgcaaaactgcaaagaaaaatcgtaatgattatagcaaacaaataatattaatttgaaatcaaaagagaaaaaaaaatcccaaacctttttgtcgcaatcactatcggtgcaattatatgctgtcagcttgaagaataggtgttttgtaggtctactatcattagagctttaaagtcctggcccttcgcttcgccatgattataactatcaatgttaccatgtagtactatattataggtgcaattatatgctgtcagcttgaagaataggtgttttgtaggtctattatcattagagcttcaaagtcccggccccttcgcttcgccatgattataactatcaatgttgttgatgagttataaaactttgttgttgatgaccttttcagttaaaattatttagtatttgaaaatgttgtttgaagttgccatatttttaaattcaaattcaaactgttaaaatatgttatatagaaaaatgaccagaataaaagttatagatattgattagttatataattttattgttgatgactttttcagttgaaattatttagtatttgaaaatgttgtttgaagttgtcatattttgaaattgaaattcaaactgttcaaaaactgttatatagaaaaaagaccaaagtaaaaattatagatattgatgatttatacaactttgttgttgataatttttccatttgaaatcatttaccacccgaaaaaatatttgaatttcttatattttaaaattcaaattttatatagtccaatcaaatccgaatggagaaatgaccaaaataaaatgggtagatctcaatgagttcaacaattttatttttgacagcttttttcatatgaaaaactcaattccaaattcatttttgcctagaaagtctgatgtgcctcctcctgatgataatacttgctaaatatatatttgatccaattaacttggttttggtggtgaaatatgttatcaaaatagatgttatgtgaatgtggttgtgttaaatatattgatggttatgtatgtgaatgaatgtatatgaataggtgatggtagggtgtgacatcctagcccagagcttaataggattaatagtatacttatgctaataagttacagcaactttcttggaagctaatctccaaactgatcgggaaattcttcccaggtgcacacaagtcgggatgcccgattgagatattttctcacatcactgaccaatcacgaatccactacacaaagagatgatgctttaaacccgttaaagataaccgatcccgatcccgttctagtgacacggcaacaagagttttcgtcgtcaaatgcacgaagaaaaagtcttcagtggaactgcagaagctgcatgtccgtgcagcagcaagtcacatgacaattaggaaccgagagggtgtccagctccacgatcgtacctgggcgggcgtttgatcgaactgctctgacaacaggcagcctaggcaatgtcgtcatcgagtccatcgtcgtccgatcaaatgaggcccttcaaagtgcaccacgctggtgcattacttcatgctgttaaaaaaccggccccgaaatctcatcggaaaccaaacgcgaaagaaaacgccataggagatccaaacatgatgacaacaccgagacacgatatttgataacggagttcagccgaggcctacatctccagggcactgattacgggcgctcctccccgatccagcatatacagcgtatcagagttacaacgactcacggccggtcgccgccggcagccgctccctctcactatactaagtcgccattgtcgtcatgcagttacaacaggcacgcccctctatttatgagagaacctaggatagagtccgactcatactctagtcctacacctagtacaactccaagttctaaactgtaaccgactacgtacacatattcgacataaactctaacacatgcctccaactcaaccgcatgatgccatagaggagagagggtgtgggcccttgtgccttcgctgagcttgttgttcctttgctgagacgcgagttccacaccgaaaaaacggaaaaaggcacaaagcgcgaagccgtcagttcagttctgaaatgcatcctttgttgagacgcgagttccacaccgaaaaaatgaaaaaaggcacagagcacgaagccgtcagttcagttctgaaatgcagccagcccgccatgctagtccctcgccacacaccaccgcttcgccgttgggattgccgctgttgtggacgccgctccgagtatatcaccacaagctgccggatatgaagaggcagcgagagaggagaagaactggaacggacaagccagatctgagtagtggatcatgaggaggcctccgtgaccgcccgcggaagagctcgacggcggctgcagcctcccactccacgccgccgtggggagctcgtcgacccaatggaggggagatgctgtctgccgtggaggagatgccgtcgggattgccaagcttgccggagaagcttgattcgccgtcagcggtgaggaatagccatcgaactccatgctgcctcgatctacagctcaatccacgcctgtgagctccggaagaggagggtaagcgcagggacaggaggaagagaggcgcgacggcctgtggctaggagagatcgtcggtctcggactcgcggagtagaggggcggagcgcaatgcgccgatgggggaaggagatcgaagtattacgtgattcggggatcgttaataagtgggtccatggccttatctataagttattttctgtcctaaggggatttattgtaaaatatgtaatacgataaatgtatatggactgaagttaaaaaagggaggggctgatatgcaaaatatagtggggcccatatgttgctatatacgtgtcttcatctcctatttcttaggtgacagttggaaagatggactaggggttcggtgcactgtgaagggcctgatgccccaaatcaatttgctgcggctagccactgtgccatgtccacttgttgccggccactacatgcccccgatcgtattacatgcgtcgtcaccgttctgagtctcgaagggacaactgtagagagtacgtatctttacagttgataaataggtaatcttcagaattcaaaagtttatttggttataatcttcagcaaataatatactggtaccatttatttgtttataatcataaaaaatatttaattgattattacatataaaatacattttgtagagaaaattcagaattgttttatgagaaacacaatcaacaaatataccagtacatgaattttgatcagaggttatggccaaatacaacttcatttgggaattgatgctagcaaattacacgcatatttcatttagaaatagaatgacaaatagacattaggtatttagaagcaagcaacattttattgtagaactagtgtagataaagataaactaacagaccgatatactttatctggatacaagcacatcctccattcgcgcgcgaatcaattaagaaacttccgggatctaataatgccttgcagacgttctgctatatctgtcatctcgggcctttggtccacattattgtctaaacactctttggatatcacaacaagattatggagatgctcaatgtccttttcttcagcctccttaccaaacagcatcttatttgctcttatctcagttaagtatgtgtcaaggtaatttctgacaaagctactttcaccaccataaacagctttcttaccggtgatgatttcaaagagcacaagaccgaaactgtagacatcactcttgttagttagcagaccagtttcacgataaactggatccatatagttgttgtcgccaataacatcgttagtgtgctcggtgacatctcttgcaattaaccttgatattccaaaatcagatatttttgggttgaattgatcgtccaaaagtatattggcaggcttaacgtcaccgtgttgaatgctagttgaggtcttggaatgcatgtaagccaggccttctgcagattcggcagcaatggccaaacgtttgtctaaagtgagaggaactttgttctcaccgtgaaggatgtcttgcaggctaccattcgaaacaaattcatagaccaagatcgggacatctacctcaaggcagcaacctattagcctgacgatgttcttatggattacttgagattggataataacttcatttgcgaattggtccttctgcgtcttgtcaactttcatggacttctttaccgcaacaggatgctgttcatcaaggaaccctttatataccataccaaaggcaccatttccaagaacatgactataagtttttgtaattcgctttagctcctccttcctgaatatctttatgctctttgcattttccagtataggaccaccatttctaatgaaaaattccctcatcttttgtttctccttgcgaagaaggaaaacaaaaaccagagttgcgaggacaaggagacccgctacgactcctatatatatgtgagaaacaagaagtagtttcttagtaactagcatatatttagcaaaataattaatatagtatgtcaaaataaaataaaataataatctactagtttgtactatctctggcataaacgtttgagtttttactatctttgagttaccactttaaccatagattttactacacataagattaaaaataaaattaagacaaatctacgtattggtactaccatttttatgttcccaaattaagtaatccctctgtttcaggttataagatgttttgactttggccaaagtcaaattgctttatgtatgaccaagtttgtagaaaaataataataacatttttaacccaagacaaatttattatgaaaatacattcaattattgatttaatgaaactaacttggtattataaatattactatggccctgtttgggggagcttatagctgctgcagcattttccagaatcagaagctccccaaacagcctagcttttggtccaattctgagaatctgtagttgtagaatccagaaaataaactagaagccggaagctgggaaacccagctttttcagattctcagaagctggctaccaaccagctgtttcttagaatcttaagcttcccaacaggctctatatttgtctataaacttagttaaatttaaagtagtttgactttgatcaaattcaaaacgtcttataacctgaaacggagggagtatttttaaaattattgagaatcaaaattttgaaagtttgacccaaacattaaacgtaatgtaatctcttttaccagaaaacaggagtagcatgataaaataagtaggaaatggatgacgataacctattcggagatgggggctacacatgcgagcttacccacaatcactttggctaccagtggaaatttctcagtgcaagttcctgctttgccatcgcctttcatgccaggtttgcacggacagtcataacctcccggcctgttcttgcagatcccatcactcgagcacgggtacacgtcgcgaagctcaggaaattgtattcggagttggcactcgtcaatgtctgggcatcatgatctgctgttagtctatcaatataatatgtatgtatgtatatggtagtatcaatatttaagagagggaggtacaaatggttcacaatcaaaccttggcaaccatcagcgatgtatgggttgccatcgtaatgatcggagcacttgcagatgtagcctgggctgctggttgcgttgacgcagaagctgttgctgctgcgacaagcgtagttgtccagcggcggctggccttgcgcagggcaggagacgttggcgatggcgaagtcgagcacgaaggggacgccccttgggtgcttcctggacaaggtctggttgccgtagagatcctccttggtgaagttgtaccagttcttctggacaatcatcccgtaggagcaaggattggacgaccaaaagacgttcttcttgtgggcgaacgtgacggaggctatgcggaggccggccgtcacgttcgcctcgcagcaacccatccccgagcacgacccgttctccgccgtctcggggaacatcagccgcgacgcgcagttgagcctgtagcccgtgctggccagcgacgtggtgagctgcgcctccatgtcccagcccacgccggtgagcacgttgcgcgacgccgagaagacgaacggcgagccggagagcaccgtgagctgccgccggaactcgtggtaggtcccgttggtggcggcgcagtcggtggtgacggcgccgtacgcccgagcctcgccgcgcgacagcgtcacgtccacgagctccacggggagggaccagtagtccttcagagtcacgctgtcgttatcgctcaggtagtagccgtcggcgttcccctggaacggagagtccggcgagccccatgcgaggaaagcgcgaggggggtcgaaggtgcggttgcaggtgacctcgaagccgtccaggaagcatccgggcgccatgccgaatgggtacggtatgctaacgtcgccgcacctgtcggggcagccggcgagcgtgatcggctgcccatcgccgatggctcttgctgccaggatcagcgcttgctgcacgactactgctactgctattaatatcatcgcagccatttctctgccaaagttaagagccatataccattagttttgtgtacacttccccaaactcgccggacaagcgctagctaaatggagtatatagggttcatgatcgaggttcgtgaactttgagccagctattatcttggcttaatgtatcatttgagatataaatatacaggtgacgcagctcagaccatggtggcgtgaagttaacatttagagatttatgatcgtttctgatcattggatctaacaatgtccatcctgctcagctaaatccaacgatgagaaacgatttagtatcgtgagataccgatacctcgagatactttttgttggacggaagcaaatctctagcatttaagcccttccgatatatatggtatagtacgtataccacaaatctactcccaccactcctaaatcttctgctggtgcatgacttaaactatgaatttttttttcacgaataaactacgaatttctagatgctgagaaatgcactttttattgatttggggtacatgtccaatatcatcataattaatcaaggtctgagatattagtgaggttccccaaaaagtaagctagttgatctaagcatgactaaacatttcctaaaccaacatttaatcatatcaattcccaagttatcagttagatagggtaaacaagctatggctaagtacgtaggaaccatcccacttaacattgtaaaataatgcaatttaggtagaaatcgggatatttgcaaagtaggaataatatgctcaatgaggaatgcatgacttgccttgctctggtgctgctggaacctctaaacaacttcaaagtaaaccagagtgtcggaactactggattctacgcgacatacaaagtacacaagtaaaataggatacaagactaccgaaacatgaaacaaaaccattttttaatggagtctagttaattttatgaattttctacaatttgaacggacataaacagagatcggatgagttagttatgaattttagaagaatctctgtgtttttactagtaacagaaaacaccttaatattgatttgttgcgtattaaagcccgaggactgacgtcattggggagggaagccggtgccaataggcaggtcccactggttggtggcgcacggtgtacggtccactggtccggggagtccggggacaggtgcacctagggctggatatcgagccagctcggctcgactcggctcggctcgctccagctcgttaggataacgagctagctcggctcggctcgttatcctaacgagctaaaaggctagctcggctcggctcgtttgaaagctcgagctagctcgtttagctcgcgagctatacgctgccctcctgctcgtgtgcacattcgtggagttggagttgcaaatcaagcaaatggagcaaaaggatttggattttagatgcacatacacaccttgtctacacatatacagcagaagtggttgtcgaccaagtcaacaaagcttgtcgatttgcagatcctcgacttcacccgtcgtgtggaggccgacggcggcgaggacgccaggcttgtggtcctgaagctgtactccttgattcaaaacttggagtcttggaagcggtggatccagttgctccatgaccgagcgaagagagccgagcgacggccgacgaaggcgattgagacgacgaggcaaaggtggagtgggatggctggcactcggcggcgggctggggacctagagcggcgccacgagggcgtgggtttgccggcggcggaggggatcgggagagttttttttcttttgttttttacggaaagggatcgagagagttcggtattgatttggatggtcactggtatagggttgcttggttagtgttggatggagatgggctatgggctttttgcatctttttcttggtggattttattgcgttactaggcttgttgggccaggtgggctacactgtgctgagctcgtttggctcgcgagctgctctcgagccagctcgagctggctcgttatagataacgagctgaaaccttagctcggctcggtaacaaatccaaacgagccgagccgagccagacacgagccgagcgagctaacgagtcacagagcttttcatccagccctaggtgcaccacatgcacatgtggtgcc

SEQ ID NO: 69486 - DNA, 10235 bp, Oryza sativa
  unsure (1)..(10235): unsure at all n locations
tccatacgcgattacagaacgtgggcacgatgacccaacttacgcggacacgatcctttctcagcagatgccatcccaaatgctaggatcgtggccacgcggcgtcgtcgacgcctaggccgagctccgccgagtcgccgacgctgatctggggagcgaggctatcgtctcctccctttggatccacggcgacgagaggagaggggaaaagggagaaggaggtgccgtcgtttgtgggctggccgccggttgctcgatgtcgtccgcggcgccggcgtgggttgtcgtcgtcctccaccgccttgcccctcgcctgtgccgcggcctccgcctgctggagctgcgcgtggagcaccggcgcagtggagagggcgaggagctcgctcgttctagccgctcccttctctcccgtatctcgtcgaccaccgcgagtcactccctcctctcccactggtgccgcgcgccgctgccaactcttccgtctcccgccggcgccgcgcgtcgctccctcctcacccgtcggccgccgcgcgccgcccctcctcactcgcgcctggagagaggacaaaggagaggggagagagatgaaggggagtcggggagagaggaagaagaagaggaggggcgaggatgacatgtgggtcccacgtgggcccccaccattttttattaatttgtgtgtgaaactgacatgtgggtcccatgggttttattattttttttctagatcgaattgccatgtaagcaccacgtcagatgaagaccgagtcaaattagccacgtaggcgccacgtcagccaaaaccaccctcaaacccatcgagggacttaatttacaccggttttgatagttgagggacccgttgtgtctggtttttcggttgagggacaaaagtcgaattcgttgacaagttaagggacctcagataaacttattcctttgggaggccattaccaagctcagagtgttaatgtacaggggattgctatttagcacacacattttttactactttttttgtgaaagcttttatatgtaaaaatttcatctggaaacttcatttgaaaatttttcttctcaaacttttcataagaaactttggcgcgggctttatggattgcttataagcaaatgttataaaataaacaatgattaaaaaataccacaaaaactaacttcaaaattagtttttaaaatagattttggctaaaaaaatcacaatgaagaaaaacacaaatcaacttaaaaataaattttaaaatttaaatttaggcttataaatatgagcctaagcgaaacaatggggctagtagtatttttatgatatggaagggaggaagaagaataacgtgtgttgaactattgatcaccagatggtttcatagaaaaactactcctacctgatactattaccatgtactctctccccccaatccagatttgtagtactgagtggtttgatatatattaggacggaggtaggtagtactacgtgtcatgttcactatagaatcagtagttaattgtctaagtttgttgtagctaaacaaacgatcaattatatgtagtattattgtgtatagatatggcatgacgagattatatcgacagtaaccgtctaaacagcttttccctcaaaaaaaaaaccgtctaaacagctattcgtatcatacgggagaaaatcctataaaatccgatcgagctttgaaacagacgcacatgtcaccagcttgtggctgtgtctgcttacagatggcgatttgttgatgcatatggaatggaagccgccgtctgtttcatggcagccaacagtatacggctaaatatagcttgcagattcctaagctgatttgtgcctttatcactcgattaattaagcagagataattgtaccatgagagagcagttgccagatgataagtagccttcaaatggtgctaaccttatcacttctacttggcactagcagtgtgatgtcatcatgattaaaatggtggtccatcagaagttcagaactccattggctgaccatattattcagagcgaggtcatcatgtgtggcaacttgcaagcaacggaagaacttgatgggtaattttaaattcttcccgagaaaacagcatgatctgcactgtgtaattaactaaaacggatttctttgngtcacagacaggctccaaatgccatcctgaccaagcaatagaagggaaaaaaaaaaagcaagagcacacagatgcaagacagtctaagtcagaactcagaaataacaatacaggcccatttcaatatacaaatgccatccctcttcaaggtaaagtctttatactgaagattatatcattcagtgtgctgctagctctgactcagtttggagcacttgctttctgtgggcattgctgttttgagccacttcagtcaagctggcattgcacatccgacagcctggtccatgagcacagctcactgctccttttagaatacaatgacagccaaagcatcaccattagctagagtacgtgacagaaaaaataaagctttgagaatgtgatggccaactcactgctgcatgtaatgctgttttcagctcactttgtccatcagcatggagaagcaacaggcacaattcagaggaaactaaatctgactagatatttctttttaacacaatgctttatttgctataccttggtacaagatggcatcccccacaaaagggtttgtgtatatgaacatgaaaaagacttctactgactaccaacacaaatgtagttagaaaaatcaggcaatactacaacatgacatgagctttgtgcactggcaggaagaacactgcttaattggccttactctgctctgctagattgagcttaatcggtcttgctctgctctgccacattgagcttaatcgggcgcgcctcgaatccacctcccttgcggttctcaagagtgtaaggcatgtatgttccgaggatcttgtcccacatgacaaagaagggctgcgagaagttgtacttgttgccatagagctggtggtgaatgtcatggtaggcgctgttgttgctgaagaagacatggaggatgttgcccgggagccacaggccgcagtggtcatcgacggtcttgatggtcgcaaacgagaagaagaatatggccgtcttaggagtcatgccggcgatgaggaaggagagggcgccgccgatggtgtccaggatgaggccctcaaggggatggttgtagagagctccaaaggcatacgggactacaagagtgtggtgcttggagtggacatgcttgtacaagaacttgttgacatgcatatatctgtgcatgaagtattgccatgtgtccataacaaacatcgcaatgatgaattgcaatgctatcacaagggccggaggctgcttcctcacagtaccactttcatcaccaatgatctacattttggggaaattgcaagattgtaagtacaataatcacataagaagtttcatcaagtagaacgaaagtaggttcaaagagaaacttctattagtagtgggaaccgttgcatactatttcaaactttattgttttctagatcttcatatattagcttgcgcaaaatgtttgaaatccaatataataaatttccccatgttaaagaaaccaaccaaaccctgtttacttaacaggttagcttcagagttaactacagtttaaggcatgttcaacagtgagacaaaactcaagctcatatgctcccaaaatcaacatgcaaccccaccaattctgtttgctatcaccaggctaatttttccccacattacaaatgctacaaaaaactgtccaatttcgcattcacagttatcaagaaagctattgtttcagactagttcatgacatattctcaaatccatccccaaactgaattttcttttccctatgacaagaactaacagcagcgctaagacaaatgtgaggagagggattgttaccgtgaagaggaggagggagacggcgatctggaaggactgctggacgaggacgcccttgacgacggtccacttggagacgacgttcttggtggcctcctcccccttggggtggagcctgtagtcgtccatccccatggcgtccagcacgatgtacagccccgagtagagccagtacaccgcgatcgggacgaacgtgccgagcagctcgtcggacaccgcgaacgccatcctctcaagacactccaaatctccttcaaatcctctacacactgccatcgaaaaaaggcgcaaatctgaatgagcaatctgaatcgcaatacgcaggcattggcgggcaccgagcacaaaaccctcaaagaaaccaaaaaaagaaaaacaaaaagcagggaatcgattcggatcttaccaggaggaggaagcaaagaacgcaagaaggctctcctttgtttgattcttgtgctgctgctccgaggtgagtggatatggtgcagggcggccactccggcgagtacttatagcgaagcaatgcggagggggggcaatggccaaggcggtggcggtggcgggcgggcggggtctgagaagggcggcgagaccggcgactcgtacaaagatttgttctttttttggacggaggcgagacgcactcgaggaaggaaggaagaccggctcggagaggagaggagagaaggcgagccgtccactcctcctatctgttgctgtcttgacttcactggaatctgtgtggaaggagaggagggctcttctcaagctggacaaagggttggttgctgcttctccggtttaggttgtgttttggggttttttttttttttgaaatttttgaatatttagtattaaaagtaaactcttgtaaaagttgttttccaagatgtgaatcttttggccacgcaaaataatactgtcatgtcggtctggttggcgtggtagaataaaactgtcaagcctactacacgccagctcgttcggattttggaaataagttttagaagggtttatttttaaaattaaaaattaggaaggtatgaaaaaaaaatccactttactatcttctacgcactttttttcacatgcacgctttctgagttgctaaacggtatatatttctaaaaaaaagtctatagaaaagtttctttaaaaaatcatttaaatctatttttaaatttttttaagataatacttaattaattatatgttaataagctatctcattttttatgtgggaaggaaaagtccccaactcctacttccaaatacatctggcattctaggatttaaattatatagaaaagtttcctgtagaaaatatttagaacaaataactgattccctacaaagttctttgaaattttagtggactaggctactatagaggagttgtggagaaaaataatcatgtcttcatctttctataatttcaagctcatgtgtttttcccatgtataattgaaactgtagttttgaggcttttctaagtttttagttttcataggaatttaattagcacaatattctatttattattattattttttttagagaagggtatttttttactcggcctctatatccaactggatatatgcagcttttttttaataggaacttagcctatcgaacagggaactaactctcaaataacccaatctgaaattcgctcctatggagatttgaactcaggatattgggtgctactcaggttactgcaaacacgatattctattatatgtttctttttcatttttgtattttcacaattccacgttttaaaagaagacctataatctagataactaaccctagtggtaagtggcgaatgtgattactgttatacaattgtcaaacagaaaattatgccggctagcacacaggattacaggagattggaatggattctcagatgcattaactgttttgaaggagatagcacgtgctgggatgttttgaccaggccattattttttttactcgagttgttttatgccagcctgtaccgtccaaaagaaattatttgtacaatttaaaattttaaaacttagttttgtaactaaaattagatgtttttagttgtttttacttagttttggctttatgaaaactaaaaatagaagtgtacaagttttatcgtaaaattattttatattagtaatgtatttttagttaataagtcgcagctaaaaatatatcttcaagtggacaataacagtatcacttggcaggtttgtaggttgacacaaattagggtatttttatgttgaaaaggcacttaattatggtgagcacgtcacattttttgcttggtattttttggtcaaacttggagaaaccaggataacagaccacaggatcatcatatatactatcatgattctacatatcattccacgtgagattttgagattgacctctcgtcgcaggatgtcacattatcacatcccatcacaccaaagcactatactactcttaacgagtaattttgccccaaatcttctacggtgattcaaatcaatgatcattttgatggatgaattggacaacttggaattgacaaatggcatatgccttcctctacgcctttccattaaggcaggcgttacaaaattatttgcccggacagaataaagctgcaaatttaattactccctcagtttcacaatgttagtcattctagcatttttcacattcatattgatgttaatgaatttagatagatatcaatatgaacgtgaaaaatgttagaatgacttacattatgaaacggaggaagtagttttttaatgagttacttcgagccgcctagccatgttgtcagtgtgataaaaaatacgagccttttgttgtaaaaaagtgtacattttcgctttcaatagtgcgtgatagagcccacgtgtgcgcgtatggaatgcacatttataagcgtatggagtgggcatgtatgcatatacatctttgtgtaattagaataaaatcattttattaaaattaagtaagcgcaacttaactgattagattctttatagtggaatcaactcattcggataaattctaaaacacgggtgttcgtatttacggttaattattctttccgtgatagataacgtatatgtcaatagagagactcacatgtaaatatcaagatatgtgcgcgtgctatgagcgtatacgtctgtactgtgattctaagattaccttttatttaaaaaacaaggtagtgtttgagaaccatagtgttccacgctagggagaagtactaccgtaccgaacgaggctttcaactccaaaggccaaccagtttagaccagatcgtccggaacggaacgaaaaaacagaacggcgttgtattccgtggaacagtagcatcgcgtccatgttgctctaccggccattcatctattctgacatcttcggtgatggcttggtcagcaatggcgcagttaaaaatatttttaaaaaaatcagcaacagaagcccattcccttgactaatttcgctctgtcgttaccagggtttaaaagaaccggacttcctaactggttcgagttctaaaaaaaatcaaactggattttagatttgtgacaaaatttaaccgaattttaccaagagtcaacggttttcatagaataaaccgtcgacttgagaacggtttgataaacctggttgctagtgcatgtcaccattccataatagacttgttggccttttgcttcctaccatggcagatggcacaactgcttcacactgattacgttaagttttggacgactgatccaccactcatcaacgtgcctaatctattaattagatgctactgataaatgataatacacatatccgcacccacttttcttggctctagaaaggctagatagcatcatgccatgaatctacttctccggtctctgcacggtaggggccaaagttgaatcatagaatataagagcgtttttttggaacgcgggattctcaaaacgcagagagagattaaagtgtcatgacatctcaaatcccatggattgaaaaaacacatgaaaacatatgaatagccatttggatagaacacaggaaaaatatagaaataaggccctgtttagaggtcggctgcggctcccgatgaggaggagctctgcagcgagtgagcgaggtcggccgcagcggtggtgttaggacttgggcggcgaaacggtgaggacagccggcgatgtgagaggacgaggaggatggaaagagtgacggggtgaatgaaaagagtgacggagtggtatggttctaattttaaaaattttcagtgtcatccagtcgataacgcgaatagtagtgttatttttttgatttgccacatttgcagtggcatgggtctaattaacccaagtttttttccaaacttcacatcaaacctttcttacacacataacttttctatcacatcgtaccaattttaaccaaacttccaaacttcagtgtgacctaaacacagcctaagaagagagaccctaaggatttttctccaagaggttgaagtccatgttaaaattcctccagaattcctatgatttgagccaatccaaaggaatttcataggaatttttttaatagttattcctatgaaccaaatgaccattgaggaaaattttccataggattgaaaatttataatggtctagaatcagctactaagctctacttgaccaccatcaaaaactaggtcagaatgggactgctgtaactgctaaccgcacggcacggccatacgtccatacgtacgtcacctcggacaaaactgatgaagcacacaagggcacaagtaataaaaataattgaagaatacaatccccagcgaattagcaagggttataatatttataggaaggcaaaatgcatcaccttccacaacaatgcgattgagaactcgaaaaaaaattctcagctttcatgatgcaatcagcccaaggatatcacatatatagccttcttcttggatagggatgaaatcagattggaatcaggaggacaatatttgtaccagatcctgggtttgtattatatacactatccaatacactttcatccctagtcttggatcaagagtttataatcatccaaggttcaaagaacacaaacgaaaccacccagcctcatagccctacttgagccttgttgccttggcggaatgccaaggccaaaagaatgcggcaacacgcaaacaaaaagatgagcttaagattcatggatataactttgcagcacaattcaacagcatgggtgaacaaggttggaccaggacatcatttgtgcagggagcagatcaacgaggacagaaaatacaggtaaagcaaaccacagtgacaggaactgtgacaaccatccaggtttcctaaggtttggacaacttctaaatggcaccgatgcatctagcagtataaccggctcagggtaaaaacatggtaaattcagagtaccaatcatcgatacgctggcgcgccaggaaaggaatagagagacgaaaccgatgcaccaggtgcattaagccttgtagaggcatacctttgactgatatcagaatatgcgggattggggacctcataatgagctgttggatagggtgcgtggagagggaggtccacagcatgagtgatgcgttggtcagaacggtaaagatcctctacacgaacagcacgagcagaaatttctccaggacggtacagatcctccacacgagcaccacggataggaatttctcctggacgatacagatcctccatgcgagcactgtgagcagcaacctctcgtggacgatagagctcctccacacgagaaccacgagcaacaatctctcctggacggtagagctcctccacacgagaaccgcgagcagcaagctctcctggacggtagagctcctccacccgagcaccaagtgaagcaatatcccctatccgcctgagttcctcaacacgggcagcaccatcagatcttgtggctgggactgctgtataatctcttgaaagaaatggatcagccacagttctggcagcaacactgaagttcaaggaatttgttagccaaaagcatggtattgttctaagtaagaaaattgaagcctataataaccaaaataggatgtaatagttagtttgggttagtattcaagtgtacacctacagcaaacaaaacatgcttaatatagatgatacgctgatagaaatttattaatactatagtgcataaaacatttgtccaatt

SEQ ID NO: 69487 - DNA, 1822 bp, Oryza sativa
tatttgagatattgtagatctttagccattttgtcaagtctgctgaatgtgtaacacatttggtcaccgcgttcgagtggtttgacgggcacatctcaggctgatgttgactggggggctaaagacccagcattgtctccaatattcttctctcgagacgtcggatatttcattatgtctgcctgtgacagtaattagttttttttgtctatatttaatactccatccatatgtccaaacattctatgtgatagggtgaaaagtttttacgtgggaattaaacggggccaaagttgcattcagtattgtgtctacagctgatccggattccatctaatcatagggtgctcagctgagccagcgatggttgtttgccacgtttaattctaaacatcgtcgtacaatcttaagtacataaagatgatcaccaatcagtctcaactcccagttacttcttataattgtcgtatgataatctagtgcgcaactgaacaaaatatattttttcttttttaatatgtgccaaagctattagctatttttaagtacatacagatctctatacatcccatcagcgttgggctaaataaaaatgctactaatatgtttagcattctctcttgcatttgaatccggttaggaatgcatatgctttctactggctagttttgattccaatgtcatggtgtcaggatggcatgcagcagatacaattaatgtgtccgattcaaaaatcacaatgtgtccgattcaaaaatctctctgaactttccaaattgtatgaggacgccgagtcattgtaaatcctatttgaattctattttttttattcgattaatgtgagaatttctagcctccacagcgaacgtggtgccttctttcaagtctgtcttaataatataatagatagatagatagatactccatgcatgtgtccaaacattcgatgtgatagggtgaaaagtttttgcgtgagaactataacagtgccctagtttaactacctaaatcagttgaagagttggctatctgagtatttggagagtctaatttagagatgctgttaaagatgctcttactagcagtaaattttgaccaaacaattcagtcacattactacggtgtcagttgcatgtgtagcaatttccttggaacaaagtactcgcacagcggccacgaccaccgttcggccccgtttttcttgggaacgagctacgcaaaaccctacccccttctccgctattggctcgcgatggaggccagccggccggcgcacgcgcggcatatggagagcaatgcggcacgcgccgccgccgccgccgccggcgagggagtcggagaccatgacgacgacggcgaggaggaggaggaggaggagaagtggcgggaggcgctcgccgccgcctggggccagagcagggcgaagcgggaggcgatccgggcgtgctacgccgccgtcaaggacatgatacgcggtaagtgtgcggtcgccgtcgcgcgtcgcttgctgcgtctctctctctgcttctactttgagtttctcttgatttttgtttaatctgactgatggcgatggcgattggtaccgtgtgcgaacgtgcgcgcggtaattaattaacggcagcggagaaggacggcgccgacatgcgccggctcggcgtcgccatgggcgagattaagcagcttcaccacaaaggttttggctccctgcgttcagctcatcctcctcttagcttttgctatgcgctcgtgttcattagtcattaatctagtcccctcgtgttcatgtgcccgttgtacatttcgtgtgattaatgattaa

SEQ ID NO: 69488 - DNA, 1742 bp, Oryza sativa
tttaaccaataaggaggagggtttgactagccaaatagcttggccagtgagttggtgatattgatggagcatgttttatttgatagaatagccaaaatttaacttgaagagtcaattagagagactgttggagatgctcttcaatcaataacacgttaataacatgttgaaggtagccatattaatggagccggacgtagtactattctgcatagaaccgtcctccggtatgtatatgcgtcatgtgcgtcttccctgtcacgagtgcgtgaactggagaagatgaacgaaatagccagagtcccatgtgccgaccgatgtgcggtgcactcgtgcaaccgcgtcgtcgctggatgctgcagctctgctgctgcgtgacgtgacggatggggggacacactcgcaaaaaccccagctgacctcatcgccgggtggtcccccctctctcccctcctcctaccgctccccatggccgccgccgccacccgcgccgtccgccgcctcctcatcgcctcgcggagtctccacgcaagtacgccacctctcgcgcactaactctgacctccaccggccaccgctcgctctcacacctttggttttttttttttttttgcttcctccccccgcgcgcccagtctcttccgagggagcggcgagggaggcggccacgagcttcgtccaccccgccgccgtcgtccaccccgacgccgtcgtcggacaggtaaagatctcccccattccgattgctcccactcaccagccgcggctctggctgagttgagttgctgtatcggccaacgaacttgtcgtggagtctctgcgcttggctgttggatttggtccatgcggaaatgtcgaatgcgtgctagccttcgcctgcttggtgcagatgctcataatctgagatgattactttctgcttcataggaaataaaaatgcattgatttctggtagtaaatcattgtgcatatgtgccttgaacttgaaccactatttgtagggtgtctcgataggcccattttgcaccgtgggagcttcagcgaggattggtgacgcttgtcagttacacgctgggagccatgtcatgggagataccgagctaggggagagatgtgttgttctcacgtaagatataatttttttccccactttctgttttcggctccatcgatggatctagaaatgtttgcattcttctgatatgataatagaacattcgggtgatatcgaaattgaaaaatgatgggaaaaaaaaaacaattctccaccaatagaaattctagtgaaagtaagctactaagcttggattatcactggtgctatgtggagctaagatgttgttcttgtaggtacttttgaatactacacatcccctgttaggctatctaccaggacaatagttctaatttctttcctcgccgcatcaagctaatttgttgcaataacttttctatcaacagctgaaccatagccagcagcattctaagcttcaaatatgcaatattggagaacaatgcatcatattgcatgtttgtcaagaaatctgactatatgacatgtgaacaactttaatgtggaatttagctttctggcagtggcgctatccttggttcagacattcctgggcaaaccattatcggtgaaaacaatgtcattggacaccacgctgtagttggtgttaagtgccaagatctcaagtataaggttagaattttttttttgtttatcactggatttttag

SEQ ID NO: 69489 - DNA, 2170 bp, Oryza sativa
  unsure (1)..(2170): unsure at all n locations
attcctgcagccctgcgcatgcatgtgtggactgctcgaatttatggagaggaaaacaatcacttctttaattaattgtacacttgattaattaattgattgtcatttcatcatatttgcacctgaaaaaagaatctgatatgtccaacatgcgtaattgcgtattacaatgtactctatctacttgcttgttaaccaattaccagtgcaaaggccaaaggaacaagtcgcagatggtgaagctctgctggagctcgtcaattccctggccatcaccgccaaatccaagaagaaagatggacctaccccttcagagttcgtcacatcactgctgacgaagtttggtgtcagagcttctctcttggatgcttccatcgagtctttctcttgttctgatcttggcgccatggcgtctccattgttcatgacagcaactgggtgccaaacaatgtagggttctgtttcccctgtgacatgaaaatgttgcaagaattgatcgatcttttggtttgtgtgtttatgttcagttgctcatgaaattcttgtaggaatggtgctttgaatcttgccatcgaggaacggaggaagcgtgtcgctagaagactatttgaccggtttcctagcaaacctgcaggggtgcgtttcatcattcctgcttctgaaaactttagctattcgcttctgatttaacaaatataaaagcaaggttctcgagccatttgcttaggtgaaaagattatccttatatttagtattttagttttttttgctgacaccttattaatcagcaatggctaaagtgttcttgcagtttactgaactatttatatttgaacatgcttttgcataaatgaatgagttcaatgtgtcagatgctaactttgctcaattgcgagtaggcattggcacacctagacgtatatatgtttatcattgatcccttttcgatatgtttttttttttacttctgccatgtttaataagttttcttccaagatttgaaatcgcacttactttccagctttatgagaccacaccagatctagatgaaaggaatgatactgacaagaacatggctgtcatgttcaaactcttgaggaagaacaaatgtgtgaagctggaaaatctcatcctaaaccggcaatctttcgcacagactgtcgagaacatatttgctctctcgtttcttgtcaaggatggaagagtggagatagatgttgatgataagggaaaccattttgtcggtgagtgctcctttgatgatccaccgacacaaatttcagtttgattgttcaaattgtaaatcaaagtagtaatgctcatgaattagtagtgatttgtgtctttcatgtttgctgtgcagtgccacggaatgctccggcagctgaactgataacctcaagggaagntgatcaacangccaatatgtattccgatttgataccaaggattggaaggtaaaatacttacatatttttccctattctagatggataaatcttgagcttgatctattatttctcccatctgtatgttttctccttttctttttttttatcattttgcaatttttgctcatttacagataatggaaggcgttgtggagcctggagatgagctaatgcctcatagacaaaacaacattggagaacactacaataatgcaaaatcatattcagcttcagaaccacagagaaaacgagatgaatttgctcagggagagggaatggatgagacactcatcaagccttgcgctgaagatgtcatcctgaagaggaagaggagatcagaagcagagagcttgaaacattggttttcttcatgcaaatggcaatgatcatgtataattttagggttagttcactggtagcaaagcagattaagcacgcttttggcatctctgcaagaaattgtttaaaaaatactaaaacacaagtaggcattaacagcttctgtttcttctattattaggacttagaagtttaatttgacaatgttggaactttcaagatcctttctgcaaatgttcttgactacccgaatcacttgagctgaccgggatttggattagaattcacgatccaattctaaatgcgcaaaattcggtagcacttacaattcgtgatccaaattcgcatgggcttgataggctctaatttataatcagaac

SEQ ID NO: 69490 - DNA, 3621 bp, Oryza sativa
agtgtgtgaggaggagaaaccctagccgcgagctcatatccttcgtgtcggattagtggatttatttttttactttttttttctcggaggtgatgaaattaccgtattagccttgagcccagcgactatttgctgagctgggttttgggtgacgttagccacgcgggaggttgaaggggtagtttggggatttccttgggtggggtggtctcgagaggtgtgaaggcgctcgtggatttaggaatctggcaatctggaccgatggggttggggaatgcggatcggacggctgagattcgctggtaggagcaaaatgggctcccctgctgccacgctgccggaacaattcgatcatttccaatctcagccgtccgattattcgatcccttcaaaaatggctgccactaatgcatggtacgccacctctccaaaaaagacccagatcggtcgaaccactgctttcgatatctcgatcgaaccttcaaccctttacacctttgcatccatcgtgttacactgtcacttctctaacattcttctcgttgttagtaaatttaaatcacggtttatacgacattctctctctgtcaaaaaaaaacaacctaggttacctttcttttttacggatggagtagtatttagaacctcttttatttgtatgaaaatataagaattttgaaggatttcagttctataaaaaaaatcctataaaaacctttggagcaatgattaaatcatatcttatcttttgaaattcatatggaatgatatagatccaacctcttacaaaaatttcctttgagtatattctctcgttcaatttatgtgtttttcctgtaatacaatctaatggccattcatgtgttttgtaattctctgttttatatttacttgtcagaatcatatatttttcttattcctctatttttttccattcatgcgattcaaatgagtccttactcttctcattattagacactaagagcaaggtcaatagtatagccaactactgactccaaaacatctatagccaatctaatagcctattcatacaatagttaactataaaaatatactacaccattaatacacggtcccatctctcatacacacataacatcttggagttcgtgttgcagccggctacaaatttgtagcccgctttcttctctctcttctcttttcttctcgatatatagttacagccggcttatagcctgctattgtacctgctctaaatcatagtcacaatggctgctacttcagtcaaatcttgaagaaattcctatatagcgccactcatgggaatttccttcagtcaagtcttctcattattagttacactactttgctagacaattctcggatgcctactccctccgttccaaaataactcaactcaaatgatgtgacccaccactcatgaaaagcaacaaaaccatcagctcacaagtgcaaatagcatgaggtcctccaactaccatgatcattcacgtctcaattgatggtcgctgcaatttgaaaaaaggatggacaaattttgcatcagataatgatatatatatcgacccagtttgcatcttccacttctacaagatgaatcacgtgcaagtaacaattgatgttctgtgatgagcatatcaatacctaaacctatgctgtgatcgcccttttgttagcattgaactgtaatatatacttctatagaaatgaaccgcttatgctctctgttacaactcctatgataactagtgaaaccccgcgcattgctgcgggaatttagtatgataacaataaaaaaaataacatgtaagatagctagataacatcagattaattaagtaaattaatatggtttatgataatttaaatttaaatagtatgtagaatggtgatttaaacgtaaaaagtaagatggtatgactttatggaagaagaaaagtagggagatagtttggaccgtagattaatcatctaaaggctaaaaacaattgatgtgatatgacttaattagaggaaaaaaggagaaaaataatttggaccatagattaatcatttaagcactaactaaatgaggatgaactatataaatatataggatatcataaaacataataaaaatatacattgaaacattatgtgaactatgttggatgataatttagcatgcttgtatttgaaaagctcttaaattataaaaactataaagatatagcatgtttacatgatgtttaaatgtgatgattgttagtgaataataatgtggcatcttgttaattattggatgatgatgtaatatttttacatgttaagcttaagtagttagtgagggataactttatagtaagataggattacctttacatctttggtgcttatgctatgtactgaactctcttgtacgtataaaataccatctatgcgtgtaactttcggtaaagaccattaactattagtagacataatataatattaatttcttttacatttatctgcttttcttgctttctgactctatttccaatccaactgcatataggcggcgcgccccaggctctagtgttcatttaggtgcgaactgatcctggctgtggaagcctggattttagcgtagtttgttacaacagttaatatcacatgcggttgcaagccttccgattaaatgattaatggacaagatgttaaatcatccatatgtggaaggagagactgacgagtgtgtcccacaccgattttcacctagaattaccatgttggtatgccacgtagacaaaaatgataaatagttaagatatcacctcttaaaaagggcaaaaaaaaattaagtgcaagtgtaagaggggcatttaaatagtgacgaatagttaaatttccgtttagtaaaagaggacggttttgtgttaaaaagcttatttctatcaaaaaaataaggttagttatctgatctatctcttagattctctgggtactcatggagcatctccagcagtctctccaaatctctccaaatctagctctccaaatatctatttggccaactcttcatttaatttggcaagtcaaactcttatttactccaacagcctctccatctatcatccctattacaagtctatgacaaataggatccatatgtcactcaacaaaccttcttcaatcttgtttttttcccacccatactacatctcccttttctctcccgtgctactgccccttcctcacgcccctacctcggtacggcgccagcggacggcgcccctacctcggtgcggcgacggcgacgacgacttgcgtgccgaccggcggaggcggggtgacaggtggaagcgggccgacgggcggaagcgaggccgcggggcaggcggaggcggggcgacgacggtggcgagcgaaggccggcgcggccttcaacgagcggaggcggcgggctgcggcgagcgaaggccgcggcggggcgggcggaggcgggacgacggctctggcaagcgagggccacgattgcgacgagcggaggaggcggggagaggcggggctgcggctgcggcgagcgaaaggcgcggctgcagcgagcggcggggcagacggaggccgacggctgcagcgggctggggcgagcggcgg

SEQ ID NO: 69491 - DNA, 22549 bp, Oryza sativa
atgtagtaatacaattaagaaataatagaaattcggaattaaaaataagaaatattagaagtagggtatagagtccatgtagaaatacaattaagaaataatagaaattcgaaattaaaaataaggaatattagaagtagagtatagagtctatataggaatttaaaactaactaaaattagtaataaatataataaaattaaaagtagagtttagagtttgtataaaaatacaatttacaaataactaaaattcaaaatttaaaaaaacatgggaagaagaatctaaagtcaatacataatacatgaatacaatttagaagttactgaaatttaaaattaaaattaaagaatattgaaagattagtttagagtctacatagaaatacaattagaaataataaaaattcagaaataaacataaataatattggaagaagagcatagagtctatatagaaatataatttacagaaaattaggaattaaaaaaaagaaatattaaaagacgagtctagagtccatataggaatatatataatttacagataaataaaatttgatattaaaaataattaataactaacacgtatataaaatacaatatgaatatgacacattagtagttttgtaaagttattgcaaaatttaaaattatgtttaaatataaagttttaatatatttgaataatataatgagaaaacatatatgctattatatgagagaaaatataacaatgctagccgcgcaatctgcgcgggccaccatgctagttatgtagtaactcgatcaaactaacccatgcgtgacattcatattgaactatatatatatatatatatatatatataaaatatttattatgtattttttaattttaaattttagttacttttaaattgaaattctatatggactctagacttctctttcaatattccttatttttttaatttctattttccattatttataatttttattcctatgtggactctagactcctcttccaataatcctttttcttaattccgaattttgttatttgtgaattgtatttatatatgaactctaaatcttcttttaatattccttattttttaaaaaaattctaattttcataatttgtaaattgtattactatatgaactctatatattttctcaatattccttttttttattcagaattttagttatgtacaaattgtattgctatatggactctagactttttttttcctaatatttctttttttaaaaaaatgaattactgttatttatcaaatgtattcctatatggactctaaactcttcccccaatcttccttttttttcaatttcgaattttagttatttttaaattatatttttatatggactctaaattcatttttcaatattccttattttttattctaattttcagtttttttctaaattatattctatatggactatagactcctctttcaacattccttttttttaatttggaattgtagttatttctaaattgtatttatatgtggactctcacctgtactttaaattttcttattttttaattataaattttaattagctctaaattgtataccttatggactgtagtctctttttataatattccttattttaaaattctgaatttcagtaatttttaaattgtacttctatatgaactctatcttttctttttttctccgattaatatgagaatttctagaccaatgagagcgaacgtggtgactcctttttctattactatactaataagttaatagatagaaggggtgagttttcaaacccaggtcgactagcccaccaccttgtatagctagccgaaagacccctagtcttttctctctattttgacttccatggcacctaagtttcttgtcgttaatgtacaaatgagaaaagttgcatgtactttatacagatgattcgttgtagagatgactagttctgtagtagtatctgcccctcaactcattgacttggttaaaacatttttgtttggaaaaagtatgaattaccactcttaactatcgcggttgaccgaattaccctcctcaacccgaaaagcagatattactcacactgaactttcaatactggacgaattaccctcttgacccaatccagagcggttttatcctatttagcgtacgcgtggtaatccggtcaggattttcttttaaaataacggtgggacccacctatcgtacctcctcttcctctctctcgggcgcaaggtgtcgtgcccctcttcccccccccctcgctctctcgcgggcgcgcgggggcgggcaaagggagacagcgtgagacgcgggggcagaggccggagctaggtggtgagcggcggcgggcacggctgggtggctccgaccggcggcaggagagacgggcgtggctaggtggctccggttgatggctaacggcagcgtccgcccctcttcctctcttccccatgaggtgatgcaaaatccgacgaggagcctcaccgccgccattgcctcccctctactccttgggcatggcgggggcatggcggagaggcaggcggtggctgggaagctactgtgggagtggcgagggcacggcgggcggatctaagagacacttcacccgtcccccaccgaatctcccatcgccaacgccttctctccattttgcttccacctccaccgggccaccgtcgtcggccgccctacacaatatttgaccccgccggtgcgccgcaccctcctccgactccttctctaccgctggcctccctcgcccgagcctaggcagcatctccaccaccacctccctaggacaccaacgacgttgctctagctcctccatcccaaactcgagtagggatgcccgggtcatcgacggacgcctccgctcctccctccacgcctcttcatcagagttgcgactgccgccgactcctcctctccactttgcctcccaccccttcccggtggtgcgacgacgatgtcccgtggcatcaagatgggctcaagctcctccgccagcgtcgtccccaaccgagagctacccgccgtctccagtaccttcctcaaggggatctcgagctcctccccctcgtccccattgccgccgctgacggagaggccgcctcctccagtcctcaccgacgacggagagtccacctcctcctcctcatccgtctctcccattgagcattagagagagaggtagagatactatgaagagatatgacacatgggcccattaaatatttttattatttttttgttgatcgggtgccatgtgtacgctactgagatcttaaaccactccaatctatgttagggggtaacttatccggtttagaaagtttggggtatggaatattcggttttatagttcaggggttaattcgtactgtcacgatagttttttttagggggggagttaattcgtactttttttctttttgtttctacctaaaacacaaaaaattggataagactatagcatctccaccaatttcgtcgtccttttgattttaatgacaatcaggctggatggcaatggagagagtcataagtttctctcctattgtaacaagtgcccttcactgcaaacttaaattcaactccgcgttagccaaaaccaaaggtttaataggttgagggataaaatgtaactaattaatttgcagaggtggatgatcagttctaacgtgtttggaattaataacgaacagaaaattttaactcaaacaaagtcatgggatttctttatacaaatccttcctagtaaatgttttggcataatctaattaagctatcctctatatcttttttatcatcgttaatatataagctggtatgaaggaaaaaattccagaaaaatccttatgcaactatacaactatgttttacatagaagaaatcaccacatgcacattgattatgtgtatccttgattatttagtgcatagtccaaaggttatattttcttttatcataaaacaccattacacacatacacacatatgttacaaccagagttgcaagcagggttgtatcttaaaattttgggccccggtgcaaaatagacttgtagttaaaaaatacgagatagaagagtaaattttatttcgggctactatattatatatgttcaccaaagttgcacaatagatcatgccagactcgccaagaagaattatatatgtcctgacgtaatgatttattatttttaactagaaaaaggaatctattaacttattaaaggaatagaaaaaggagcctccacgttcgctctcacggcctagaaattcgcacattaatcggagaaaaagaaaaacagagtacatgtagaaatacaatttagaaatagttgaaattcggaattaaaaaaataaggaatattagaataggagactagagtccatacagaaatacaattgagaaacaatagaaattcggaattaaaaataaggaatattagaagtagagtatagagtccatatagaaatacaattaataaataatagaaattctgaattaaaaataaggaatattagaagtagggtacagtgtccatgtagtaatacaattaagaaataatagaaattcggaattaaaaataaggaatattagaagtagggtatagagtccatgtagaaatacaattaagaaataatagaaattcaaaattaaaaataaggaatattagaagtagagtatagagtctatataggaatttaaaactaactaaaattagtaataaatataataaaattaaaagtagagtttagagtttgtataaaaatacaatttacaaataactaaaattaaaaatttaaaaaaacatgggaagaagaatctaaagtcaatacataatacatgaatacaatttagaagttactgaaatttaaaattaaaattaaagaatattgaaagattagtttagagtctacatagaaatacaattagaaataataaaaattcagaattaaaaataaataatattggaagaagagcatagagtccatataggaatataatttacaaataatattgaaagacgagtctagagtccatataggaatataatttataaataactaaaatttgatattaaaaataattagtaactaagacgtacttcctccgtttcatattataagactttttagtattgcccacactcatacagatgctatttagattcattagcatctgtatgaatgtgtgcaatgctaaaaagtcttacattgtgaaacggaggaagtatataaaatacaatatgaatattacgcattagtagtttcataaagttagtacaaaatttaaaattatgttgtcattttaatatatttgaataatacgttgagaaaacatatatgctattatatgagagaaaatataatgatgctaaccgcgcaatttgtgcgggccaccatgcgaccatgttagttctttagtatttttagtattttgaatgcacgttcatatcatcattatgagctacagttctttttaggtagccatatatattaccattgaacacttatcaaaggtgaagaaaagaagcttgttttaaccaaatcggtaagtaagagagtgaaactttttaaaattagaacgagaggcctttaagcacgtttgaacgcattagcatggattaaaatttaaaaatactggaaccttgttccgtcgtccaactcgcgcgcacgtgcttatcccctcccctagatgcaatataatcgtgcatgcttttatcagctgacaatcctatatatgatcgacacaaatcacacacacatatatatactcgcaaaattgaaacactgggcgaacggagaggaaatatttctggaagacacagtggtaggcgttataagttggagaggaaaacgaaagcgcatgacaatgccaccaccacacgtgtacggcatttgtgatcaagtccacccaattaaagagcacggcttgttgctaacactgcagtggcaacaagtagtcttggccatgttctttcctcacctttcccaactcacctctggttttccacgcgcacgcttcccaaactactaaacggcgtatatttttttaaaaaaaattatatatgaaagttgctttaaaaaattatattaatctattttttaagtttattttagctaatacttaataaatcatgcactaatcgttgctccgttttacgtatcgggaatgagggttctgaacttggggtgcttggatcgagggactatacgtgtccatgtcacatcggatgtttggataataatttggagtattaagcatagactacttataaaactaattaaataaatgaaagctaattcgcgtgacaagttttttaaatctaattaatccataattagcacatgtttagcctaattaatctataattagcgtatgtttactgtagaatcacataggctaatcatagattaattaggctcaatagattcgtcttacgaattagtccatgttttgtcaatagtctacgtttaatacttctaattagtgtcaaacatccaatttgacagggactaaatattgtctcatccagccaaggtttattagtgggtacacccaaagcattttttcccctactgaggttgacccaaagctgctgaataaaatatatgaggaattgtgtagtgtactttgaaagcacagcgctcaatcttttaaccgaataagatcgagatagatgcagaaaataaactactgaaagtataattaaatatcattgttttaaaaaaatatgtttgttatgacttatgtttaaattaggcacaattaacgctagtttgatatacaccaaactctaatagtcagatataacacaaccttcacttcgagacgtgcgtgcatgtactatatcatttttcaataaggcgccagaaaatggttcctaatgatctagtaggaagaaataccacaattataagtggaaaaaaaggagaaaactccaaacagtccatcatagctgaatcaaattaattatagcagtataacattgatttttttaagtagcaaaaattaacatagttacatctctagcctttgacttcaagcatgcaaccaatgattctatgttaaaagtttaaagaaaacataacgaaattctaacttcctctcacaagccaaaataacgataaaaaatcacaactgcatatatagcatgctaaataccaaatattaccatcgttataaaatttagtaacctaatatcaaatatgatatatcacagtactacaaatttagacagagactgtacaaatttatagttctaatatatatctcatttagtattaggttattatattttgaaatagctagagatggtataattctttttcaggaaacctcacacgattatgtgtgggaaattcaaccataaatatgtcctcacaagaaaaagggcatccatatggtgatcaacatcatcgaattgaagtatttcctgttccagagttgaccggctagtgcagtccaatagtaaacacacatgcatatgcaggtcgcacatatctgcaggtccacatgaggcaaagggacaccaagacacaggaaatctcattatctaaaaaaaaagacacaggaaatcttgccctccacctaagctgggttcctttttgataggactaaaaacccttcctctctcgatatgtaaaacgaaatgacaacgtatggttaattaaaatttttaaaaataaatcaatacaattttctaaagcaatttttctatattattttagaaaaacatattgttcaaccgtttaagaaagatacaagaaagatagtccctccgtccaaaaaaagataacgtttgatgtccgtcttatatgaaatttttttataattagtattttcattgttgttagatgataaaacatgattaatactttatgcatgacttgtctttttaatttttttatatttttttcaaataagacggacggtcaaacgttgaacacggaaacacatggtgtattttttttttatgaaaggagtacgtgcagaaaacaagtgagtagaaattgagaaagtgtcccaacgaacacagctaggctccctcacaagtcacaaatagctcccacctgcacctgcacctgcacctgcagtactggatggccccatgcgtagccaaccattcatcgtcccagacaaaggagctagctatagcctatagctgactgagctgagctgagtgcgccgaggcgtcacacaccgccatgccgcgcgcgcgagcgcgagcgatcgatcaaccgaagtgcgcccggctgggcgccgacccgcccgaaacactcgctgtcaccgatcgcgcgcgcgcgcgccgtccccacgccgccggagggggggggggggggggtcaattcaatcatgcgcgcgcgcacgcacgaatggacagaagaagcagctggatcgatcgagcgagcgagcgacctgcgagctagcgcacatcattcctttgcccccggccggctgccaacatcaccgggttacgtcgcaggagggatacagggtttctggtcggggttacagtgacggggatgtcgaaatgtccgcccaataatatccacattttcgatttcaggatttgcatgaaaacggtcggcacatgattttttttaataatatttagtacaataagaaatgaaattacttctggcctttgcacattaatggtaagggatgcacacgacttggaaaaaaaatactccctctattccaaattgatctacatatagtttttttaggttattcctaaatgatctatatatttgtgttcatttattaagtctattcgttatttgtgtattagagtaaatggacattgatgcatgcatccatgcacacaactatttataatccacatgcaatatcttgatttgctattggctaggaaatattggggatggtgaatgcatagagtttgttgatagagtaaatatagtatgagggagttattaacttttcttggtcttgatgtacttatgaaatatgtagatcaatttgaaatgaagggagtaataaatacaacgtgaatatatcatgttgacttatgctcctacatccagaactataacataatgtctatgacactaaacaatacggactactgcagaaaaggtcataggtgttcggagaccctcataggtgccggtttcgggtccgacatcaatgacccaagtcataatcgtcagaaccaacttaacggtcaccactagattttcatccatagatttctatgtggcaacacattaaataaagaaatgacaaatgaacatcgatatgatattgtcagatccaactaactggatcaaagttaccaatagaacaccatgctaacggccacaaccataaacataagtggtagtaataccaccagcggttgccatcgaccaagaagcaaacatccaaaataaccaatgcatgattattttagcaccaccaagacaccttgaattgtcgctaaacaattttcctgaccataacaaaggtcactacccatgtagcatcctcagtctgatcaccattagttgaaaccctagcgggaccagagacaccatcatcatcggacgaatagttgacctcttcgatatgcctccaccatgtggatggatggcgaaagccttgttgtcatgtatgtacggagcatatataccatcgccacccatcttgaaatcacaatcctagagaaggccctctctttgaagttacagagctatcgacgtcatggagtctatgatccacactcgcaattttctcttgaaaaacggaagctagacgatggtttatcgctcgctagtcacacacaaagagtgcatatgcattaattctcctacaccacttgaactctcgttcatatgacagaagcaccactgtagcaggatgatgcatgcacgatccatcaatctaggcttgcaaaccatgttgagactatgataggagcgccatcgcaaccacttgatgtagatatgtgcacagtccacgtgatgacatgagcgcatcgccaaatctccaatcctcaattgtcgatgagtgcgtctctaggtcacataccatagctagacagccccccccccgggggggtggtggtcggtcattgtgtgatccaacccaaacttccaatcaccttgtcgatctatgtccagttctttttccatctatttggatcttgcaagttggtggacaagagttgccgtgtctatgagaatggcattggcaacggttagggggagggaatattgtgagaggcatcattggggttccgttatcacgtagtgtttgttctacatattttggtctaaattttaccagtctaaaacaattattttattaagagttagatgaattcgatagtagtttttacaacattgtacatatagtccactatgacacattcttattattttttgttttcttggtttaacaatctcagaaagttgattaaataaaatgcaaatatatggtcttaattttagtttttttattgatttaataaataatgtagaatagatgcaaagttactatattttggagtcttagtttagtatttctattatttacttatttttgatattcagagttaaaaagtacccaagtgatattgaatttaaactcttctgttaatatgaaccatagtcacgttaagatggattgataaacgttaagattctttttcctcattctactaagtatgagtatgatgaggacacaactagctcagatatgaccatgactacctcatgtattcatcaaccaaaggtgcatatgttttatattagattcacttgttatatatttgaacaaccgttgctacacaatgagtttcctatgttttctttgcagcggtacatgcttgggtgatgaaaaagagaccaagcataaagaatgcatggatgatcaaagaagttgattggggaccaaatcaagaccttctccaaatccacttctacctcaccacgtcacttttggtccatagaaaacaagagataaagtcctacacgttttggattcggattcaggcctcctaacaacattaacttcgaacggatctaactgctgatctagaatgaatttcggagcccatgagtatttgttggaaagcttatggagtatacttttagatggttttggtccacatctaaattcctaccgagctgttgggaatatgaaaaataagccacgtacctcatccagtctgaatctgatttgggtcttgagccttgtaattgtgtcgtgggataagcccaaaggggtgtgcgccctaaggcaaccctaggacgtctctaatcatatttattcagaagtcgtcatcatttagagttgggttttgcttagattatttttgccattgcagtttcgccgctagatcggtttgtggaagcccaaattcgagtgcttaatcgttcatttgcaattgtgttgctatctatcttgttattgcttgtgttctttgatttgcatgcagtgattagccttatcggtgaggtcaaccgggtttcggcatggttgataaccagaggaaacgtggtgctgcgattgcagggttcgaatcggggttgatcggaagctggatcatgtgtgtcaagtttccaccaaatcgagagttatcaatacctatcggaatatcaggacctagtattctcatcaggtatagaacagagttacaattgaggatcttttaccttataagttgttgccaaaacttaattttagaattgattttgaggcttttttcatcataatagtgttttaattagtgcatgatacaaatatgatagttttttaaccacaaattcttatttagttgcttatatgtcgttttacaacttatcagctgtagactaatgatcatgctataagtacaaagcaacactattatataaaaaagtacaaagaaccattgaatttcaaactagtaatggcgagaaatatagttattgcctccatcttgtagcttagaactatcatgtattatctggcattctgacgcttgatcgattatatttccatcgcacatagggagagtgttatgtcgatctccactatctttttttcgtggattagtgggctctttcagaccccaatattctattgtccttgctcatcaccttgatgaaaaaaaagaacatagggcatatgcccatgcagtatagtttatagatgtccatcagcctcgtcaaccacatatagcacattctatggtccaagctgactcctcaaaaaatctcttacagtcgcaatttaaccattaacccatatttttattttaataattgcctcttgggtcgccttcctgcgactgtgggacacggggaggggagggaggagttacgatggggagattgcactagttgttctagacactgccgtcattggttgtaggttctcatcaccaagtggtagatcagtgctttgccttcatcgcctggtatgaccatgcctattgtaacgtctcgcctcccgcctctcccaggcgggcccgcttacatctgatagctttcataagtcataggttgccctcacagaccaacacaagtcttttctgcacactttgtcctcactcgtgcgcacccgggaagaatttcccgatcggtcacccatccctaaattgctccaagccaagcacgcttaaccctggagttctttggagatcggcttccggaaaaaagttgcaacttgttgatatgagtattctattaatcctattaagccctaggctgggatgtcacatcctcacccccttagaagatcgacgtcctcgtcgatcaaccccaggccaggaacgtcccctcttagccacgtccgacgtcctcgtcgatcaaccccaggccaggaacgtcccctcttagccacgtccgtgtgtccagtgccagcgcatgtgccatgctctgataccactttgtaacgtcccacctctcccaggcgggcccgcttacatatgatagctttcataggtcataggctgccctcatagaccaacacaagtcttttctacacactttgtcctcactcgtgagcacccgggaagaatttcccgatctgtcacccatccctaaattgttccaggccaagcacgcttaaccctggagttctttagagatcggcttccggaaaaaaaagttgcatgttgatatgagtattctattaatcctattaagccctaggctgggatgtcacacctattgaccaaggcagctattggaagagggacaaattaaactagtgggaggaatgcacaattttgtagactggtgttgtggtgcggaggcgcttcaccataatccaaacgaggttggttagcctggtcaatgatggagaatgctcctcataaatcaatgaatgactttctttgattctccaaaactaggagtttgcctttcctaaatcaaaaaaaataggaccttgtcctatatgacaaggttatcctatttgcccaaatggagacaaatagagaagactggtgttttatccatggtctttgcacattgttactgatttgtgtttgttattggtgattagataagggatgatgacttcccttttaatcaggaagattggttagtgacagccgaagttgtttcagcggctaagatcgatcgtgtccatgtaaacctttttcgagatagttttggcgggcaacaatcgatatatatggacatttgttttttctgacttgctagctttaagtagctggacggtagcatggagtactagacgatggctctagggtgaaaacactgatatagttcatctagcatatttgataatgtcaatgcttttctagtcggctcctttgttgaaggtgacatctcgtactttggatggaaagctagtccactgttagaggatagtagcagacaagtgttgggtcattctttaaagtgttgttctatagtaaacgtctagttagtattttttatgttttgtcttagttttatgagtgaattgatgtaagacaatatgatatgtttgtgtttatcttagttttttttccccttttcctttctagtttgtgtacattcatggtagataatacagaggtaggttataatttcattttagtgaaattctttcattgtataaaaatgtattaatatgcttagacacccaataactttagttgtagattcgccactggcattagcctaagttgatatgacaacccattttccttgtaccaacacgcacttccatcctacccttcaactagcacatataatacacacacatagagaaagagatcacaataatgcatatatttatagagaaagcacaacttttgacctctatgccaactaaggatccatacatctctatttgtgaacacattcttacgtacgtatctttctttggcctgtttggggaagtttaagattctgagaagcagctagttggtagccagcttctgagaatctagtaaattttgatcaaaagctgaattatttggagagcttctgattctggaagaaactgttgcagcgagaagctaccccaaacaagccctttatattccgatgaacattacggtttgaatagtagagccatgcacccgtacacccactactccactctcacactatattgcttccctgataatgcagatagatgatagaggaatatgctaatgcccatgcaattaatcactacatatatccatatagtatctaaaatatttgtgcacgttgttgtttgattgagtctcacatcgggtatccccggccgtcccatgcgctgccggccggcaggaggggggtccgcggccatgagcccataactaacgcatatatatgcaactgccaatatatccaccgtccgtcgtcgtcgtggtcgtcgccctcagatttgaggtcacggtggcgcgcggggcgccatttgcatatggtcgatcgcgtcgtcgccgccaatggtggtcgaccgaccggcggtcggatcgacagaccaaataccaacagtcgccatgacagggagatggtgcatgcatatcggattaggattaatcgatctagctagatgacacttctacaaaacgattttccaaacggagaaaactcatttttccaaaccgttgggcctctcgtctgtccgaaaagatctgcaaaaacagtgattattttttcatgcaggtgacgcacccgtatgtaaaaatcggaagtttatgtacggaactcgattcagacacaatcagctatgatccgtttacaatataaaaggagtcttatccagaaagaaattcttttttagtagtgcgataaaatgcaatgctgcacagtggccattgttgtgtagaacagtagtgcctagtcttttgggacgcatgcagtgccgtccattattagctagtcgggcgtgtggtactacgagtttggaataattaacagtagtgtgtgtgccactaattaatccctgttctgattctgacgatcgatcgatatatatcgatccttagctggtgcatgcatgtacgactgactggtcatgatcgatcggggtttaattttctcttcccagcaaaccatcattattccctcggagaaaattggtctatagactttagattccccacgtttttttattttttttctttcttgttatattttgaaaagtagtcatgttgacattgactatattcaagtatatatatgtctatagaagaaacatgagtgttactctcttccaaaaagaataaatctaatacgagatttgacatattctaatactgatatatcacaatttgcactaggtgtatttcttataggacggatgaagtatacatactcatgtgagaagcacttgctagggcagtagtaggggtgcttggatttaatttcaatggaagtgtcgtgtgttcgactccgtggacttaccggtgtctatgtgtttcctcaatattttttgagaatacgtcaacttaatctagttcctctagggcactatgttttttcccaaaagacactccaaatttaattaaacatattagctcaatttaaatatttttaaaatatgtttattttcataatttaaacattttttgaatttaaaaaaaaatatgttgaaattcaacaaatatttgtttaatttaaatcttacatggtggcctaagggtaaattcatcttttataaagttttatctatctaatagaagaagatatattataattaataatggtaagagtgttttttctttagcaaagaaccataaaactaaagtttccttgaacaaagatacaaaattgtagtgtcttagagcatataacgaaatttagaatccctatagcaaatgttgctagaaaattaaaaagtactctctctctctctctctctctctctctctctccgtggctttttctggaatagaagaatttttcaagatttttaatgaatttaatttaatcataaaatacccctgttttacaggagccctaagaatttttaatgtaaaatgttagcaattatctgtccaattatgaagacaaattacctaagcaatttttacactctctcttttttaagaaacacgggataaacgcaagcacctatacacacgctcgcgtatattcaccccatatgataacctccaagagactggatcaatatattttaaaagttctatagttgccgcactatcgatgtggatatcaactagtatagaaattaattacgagtacatatgataggcttaggatttggactcgaatggataggttcatatgtatgataaacaaaccatgcagctcacttcgcgtggcattccctctttcgttatgaagtcaaatcaatactcacttcgtattgcattctcttttgttatgaggtcaaatcatctcaattacttttacctttgtatgatggattacgcatttacgggtgcgaaaatgtataaagcgcataaagtaaaactgtctgactgtaaaagttaatccgctttgcaaatcatatattaacatttttgtcttgcattcttgttgggcaatatatatatatatatattggcggggtttcatctgatatgaccctcgattgtctctcccgttgagggggatcaaaccccactatatatgcttcactgtgatttgttatgtcgcatttgccaaagcaaatcaaaatagccctgtcctgcaacgtgaatataaatggagacgtacactttttttctttcattgcttgtaggcaacgcatttcagatcaggatcaactggccatcatatctcttgcaaattttccatcattcaggtatggtcatatctgaatgcaatgagctataattcagtgcaattacccctttgaactttcatgcaacagagtacttagtgctcaatcatgcattgcacaaaatgaatcacgctgagctatgaaaaagtacaatgcatatctatctcaccgcaggaaataaatactctgccagctgctggctgtctttgtgatacggtgcagagttgtcctgttaaatgtctagtttgccttgtcgattggtcagaaatgtgtatgtacccaaagttgcacacacataatatcgcatcttgtaggcaaagtgcaatgcacacacactttctttctcttgcgtctagtatattgcaacgccaaaagatgacgagactactggatgttaagcttgtctacttgtataattttaatctatccgttcactgttcattttgagaaaacatatctaaatgtgtgtgtacacaaaattagctagcactcttcgatctttagtttcttaatttctttctctttccttctttgtttctatctgaaagaaaaggctagctcgcacaccccccaccatgataaactctttgatcatgaacctacccacgtgcacctaatcttttaagagtctatttgactcacaaatacactattccatccaactcgtgtaagccgtatacatgtattcgtacatgtaaacagggaattaaatttgaaaagatattgttcattcaatttctttttagaatattcgggatgtaaatttttttcagaaatataccgtcggtctcgcccaaccgttgtgtgaaaatgacatgagagtgacgttgcaggcggtatcgcgagatgaaagtgtgagaccgcgtggtcccgctgaaagagacagcgacaccgtcccaacgctaaaacagcgaacgccgaaacagtgactaatgacctagttaactattactccatgcgtcctaaaatataattatttttgaactgacacggtctccgagatgctgctttgaccaacaatatctataaaagtaagatgttttaaataaaaaatagttgcatattatgatagtttgtttaatgataaatctagtaacattaattttacatgattgctcttttttatatttttgttattaatagtcaaaatttaaaatatttgacttgtcactatgctaaaaatgtttatattttgggaccgatggagtaactaataataattagtgattaattatcatgattaccggttaaataataatggctaattatgataattaatcactaattaactattttgaaatccggtatcgctgattggttcagcaagacctcgctcttccattccacgagagcacatggtctcgcactttccccgcgcgataccgcccacgacgtcacgccacgttattttcgcacaaccagtatatttgtgcaaagaaaatttaaatcccgaatatttctaaaaaaaatgaatgaacaatatattttcaaatttaattctgtaaacaggagagtagcttgttattttctcaaaaaaattatattttactgcctcgtactattttagcagagcacttacccaacccactaaattacttttaagttcattgtaggtacaccaggttcgttttacttctaaatggtatttctcttctctctctctgtgcgcgcataaaattgatgttttgcactgaaattcggtagaatgaaaagacacattacaacttatgtcgtggtatttctttttagaatttttattagtgtttgcataggttggaaacacctcagattgatttaacatcgagattttagcttaaaatatttttaaatttgataatagtcacatatggctctaaaatatttcaacttaaaatacaatcataagaaataaaaaaaattattaaggagtaaagtgaatattttcaatagttttggggtaaaatgaacaaagcacgcacagaaccggaagcaccccttgtttcaaagagaggaggacgggttattcacatttaaattgatggtcagaggcgaattgaaaggttaaccgatccagtaaaatagttcgagtggttaaaataaacttatttttctctcatatactctctctgcccccaaaaatataattactacgagttgttcatggagatttaattaggagagaaatgaaaccaaatgaggaatgattgttatcgattcagataaaatagtagatgaagaaattaaaataaagatggttgttattggtttagatgagaaagtaggtagagacattgttattttgagacattctgaacgctagaagttaaatgtattttagggtggagggagtgatggttaatttcctaatcatccgacgtggattcaatggtcgaaacaagctctaacctttcatgatcctaataaaacacatccatgcacctttgacacacagtcatccttctcctacatcctccgtcacatccaccaccgcaattttccgtagcacactttcttcacgtctccatctctaaatccatatcacggatgaggctcctctaacataagtaagagagacatgtgtctttcacttgtgcgcccatgagtacaggccccacctatgaaggagctgctttcctaccacaccatcttcaacttcccaatattaaagagtagtactagcatgtgtccttattgtggcatcctaaccattggaacttcctcaaccaagctattatctctggccaccgcctttccataaatacttatctagtagccacaaccgcaatgctaaataataagacgtcgctagtatgtggatctgaggtgcttgcagtattgtagactataaatagttttgagtaaagtacacgggcggtccttaaacttgtagaggtgtgttatttaggtccctaaactctcaaaatgcatatccaattccgagaacttgtcatagtgtgccatctaggttccaaatcaccacaacccctaaggatcgtacatgtcgctgatgtgacatggcacacgaatatgacgtgacatcattttgacttacaaatggaacccatttaaaattttcatttttcttcttttcttctctttttttctccttcttctattttttttctttcttctcctttttctatgacccgagcaaaagaaagagaaaaaaagaagaatgagaagaaaacgaaaaagaaaaataaaagaagaaaaagaaaaaaaaggacacgtcacgtccatgtggcatgccacatcagcgtcatgtaggttcctcgaggggctgtgtcgttttgggacctatatgacacaaccctacaagtttaaagaccgccaatgcactttactcaatagttttttagtctttgactcattgcggaaagaatcaaaatgaccgcatgatagagataagcctactattttagagggttctatgccttcaatcaacaaaagtgtacttcagaacaatcaaagactcgttcaaaccatatcaaacaccccttcgaaccatcgaacacattgcacttgtagaccacttctttgacccaccaaagatccatattctaccatccaatacctctccagccagcaaaaaccgcacgccacggatcatcatagccctaaaagaatctcaagtagtgatcaataggcaaggaccgtaccaaaaagactccatgaatgtggtcgtactcctagagggcctttatttgtgttacacattgtacatttttttttctaaattttggtacacatccattgagagcacttttcattgtactactgtatcttaacggagtaaggctccgtttgaaagaactgtttggcttagctttttttttggtacgcgaaacaagaaatatcattagtgtatacttaattaagtattaagtattacaattatggaaaatgggtttgtttgattttttattaaaaaaacttctatataaaaagttttgtgcaaaaatacatcatttatattagcagttagaagcgtgctcatgataaacgagaaaaagttgtattgcaatagctaaatgagctttcaagctgagcctaaaatacatgaatcatcttgaaaggcacatccatatgatcacttcggcacgccacgccacgcatgtatagtcttcaccataaactcgatcaaatcgattacatacatatattcgtcccccgaaagctacatgccaccatggagatctatagctaataaaagctatagcagtaggcctctcgcgcatcactagcaacgcaagcacacgcactgcgcccaaaaactaaagaaacccacatggaaaaaacacacacacacatcgatcgatgcatgtacagtcaccgtcacgctcgccggccggcatgcacacgcaggcgatgatatgatccgtcgccgtcgtctacccgccggccgcgccgcatcgaactagctagagctatagctagtgcaaccccgtccaccaccatgatcgatcgatcgagctgatcgatgagagccccgctaagaccaagtttaatagtatagccaactgctagctccaatttatctatagtcaatttaatagctcattcacacaatagttgcatactatactattaatacctagtctcacctatcatacacacattgcgtcttagaatccgtgctacagctggctgcaaatctgtagcccgctgctcttctctctccttatttatctcattaaaatatgtttgcagctagcttatagcctgctattgtacctgctctaagagcaagtttaacagtatagcccactactagctccaattcatctatagccaattcatacaatagttgcttactatactattaatatatggtctcacatgtcatacacacactgtctcttggagttcgtgctgcagctagctacagatttgtagcccgctgcttttctttttcatcttttatatcattaaaatatgtttatagctggctaatagtatgctattgtacctgctctaatagtggtcacgatgtgtgtgttgcacttggaaagaattatgtgggctcttcgtcgatcggtgtcctgttcaggtgttcgtgtgtcgcgtttgtgtctgcactgttgatgtgtgatcgatcaccggccggggctggacccatgcactctcaactgcagattgagactctcgatcggatgagaggtgtactgttgatgtgcgtgtgtgcgtgtgctgccggatggatggatgattgtggtagtattgtgtactgtggtggaatgccatattgaaaggtttacaatgggtcccagcttattggcaggggatgacccccacaacaaatgagtgtatgttaatttatgaattggtatgaaggaaa

SEQ ID NO: 69492 - DNA, 25008 bp, Oryza sativa
caccgtgtccttgataggaagaagcgtcttaggcagctggttacatgaaatgaagctgatcatctcgtttcatcttgtcatggtgtatgtagatccgatcctctgcagcggctgtgcgcgaaattgtacattgcattaagttgtggtcccacgtaatgtgtagttgaatcaaactcctccgcctcccaatgcaacctgtggattgaaactgtggcgccaacaacgaagttgcgccaaatagcatcctgccatgcttatgaccgtatgaggagtttttttttttaatcgtaccgtgctctttattaacaagggactttacaaactccggaaggggatcagcccaatggacatctgacccgggtacacacatcgaccttgtcaaaatccacatagatcatcattttaatttgcctgaagatgacgcccgcaggagcatgatcatagtcagttgacttcaaagcacccaccaggatagaacaatctggcgttgaagaacaatctgacttcaaagcagccatcaggatagaacaatctggttgcttctgacctggcgaacaactcctggatctctgacatccgtgccctcactgtcctggtcatgtcccagtttcttcttatttgggatgcggtgcttcacgtacaactctcgccgggtgtcgaggatcgtctcgtttggcgttggacctctaaccagcgctactcagcgcgttcggtgtaccaagcattcttctatggccagcattcctttgcctatgccgatcttctctggcacgaaaaagggtattgctaaatgcaggttcttcctttggtttgcattccagcagcgctgctagacaactgatctcctccagaagcgtggcatcgataatcactcggtctgccccttttgcgctcaggatcttgagacggcgaaccacatgctcctcgactacgtgtttgcttggcaggtttggctctgtgttctgtcgcctcctggctaggctaccctctctcacccctgtggcaatcggttccaggattggtggctgccctccagggcctgcttacctaagcatctccgtgccggcttcaaccccttagtgctcctaatctcttggcaattgtggaaggaacgaaactctagggttttcgactctgcactctcttcaatctcagtggttctggagtctatccactcggaggaccatctgtagtctttaacaggcgttgccgtttttggggacttgtttggagtgtagcgtggctcggccccttcccgctgtttggagttttgttttagccgccgtagttttctaagcttcagccttttattttgctttttctcccttcccttggcataagctggtttggctaattgtgttgtgtaactataaatcttttaatatattgacgtacaattgttttgcgcgttttaaaaaaaagatagaacaatacgttcctatggcgaattggcgatgtgtgagattccatgacttgttgcagtaagcagagcatacaagcaagcttcagcttcgacactctgagcatcatgcacaaattcaattttccctgcacctgctggcacgccatttccgtcatgatcccgaatcacaaatccccagccaccagttttgctagcttcatagaaagcaccatcaatgttcagtctcacctcaccttgaggtggaggtcgccagttttcagtactcgaggatttggctgggttttatcatatctgaccgtatgagtagttggcattacatctcgcttgcccatccaattatgaacatgccctccgtcccatattataagggatttttggtggatatgatatctctatccaaattcatcgtattagaatatgtcacgtccacgaaaaatcccttataatatgggatggagggagtacttctcaaaaagcacgattttttcaggaatttgttcagttactaaaaaaacccttcaatccaaaaccccttcttggcgtggtattcagcccacgaaccattaaaaatccaagcccacaatttggtccacaagctgcatctattcccaagcccacccgtcactcaaaggcccggttggtctctctctccctcgccgcgtcctgctgggaaatccggcgatggctgcgggcgctatctccgccggcgggcgcgcggcgcgggcgtccgcggcggcgctgtggtcccggcgccggcagtggttgcttctgcgcgtggagtccctgccgcccatactctccgcccgcgcgatccccgccgcggacctgcatgccgagccggtttgcgccgccggccccgtcctcctccccgccgcctgacttccacgccgccgtgatgggtaaatagcatagctaggtaggtagccgttggttggtggatttgttgtgatttccatgttctcatcggataggttgattggatagattgattttgttgtcctaaatgtcgtgctctctaaacgcttagcatgtagggagatctcctgacgagttggctatcgatattggggatgaatggctgcttggggtactttcctcagtaaattacaatatgattcgatgtaactgttgagtagtccaggtctcagtgccgactgccgagtgtgggctgggtttgggggctgtaattagtaacattgttgctgactttgtacatgtttaccctctactcccccatcccaaaaaaaggcaacctagtgatttgttgtactaggaggtcgtctttttttttttaggacggagggagtatgacttaataaaaagttcgattggtgcactagtgtcggtccagtgagattaggccaccaagctctcttgcagtgctaagtggtaaactgctaatacacgttctgaaatccacaatcacttgccctcaatgccccggcctagcagtgcctttgtagaatcattgtatctagatagcagcctccaatgatttcaatgtgtccacatcacaattccttgtcgctaatctatttaagaaacatgcctgattgccgtaagtcttgctcctgcagtacggcctgaaacacctcttttccctctatgatttataacagttcaccatggagaccttcctttctgcagttcttggtgatcttatcagcagatccatatccttcctcattgatacttgatactactggaagcaacagggtgtggacgagaatctgcattggctgcagtgcgcgcgtctgttgatccaaaccgttgttgaggaggccgataggagacacatcacaagctaagcaatgatccttcaacttcaaatgatgagaaaagcgatgtacaaaggctactacatgtctgaatctttcagttaccaaatcatcacaggtaaatcccaaggtgagttggttgacctcttgatcgctttctcccatttagttcagcaaagtggttttatttatccactggaacaacggaaatactctgtaaggggaagagataaaagagatgcaaaagatggttggtatcttgaaaaaacatagaatagagcagtcttttctactacaaatgagcataggtagtatgaagtagaggattattgataacctatgttaattggttgagtctgaatcgagttgatgtttgctaattgtaaggtatgagtcgtgttctgaaaatcaccttctcagccttctgaatggcccactgtgtaaggaaaagaaaaaaaagaagccaaagcattgaaatgttttgaaggtgtgactcgttctctgaaccttctcagtcctcacgaaccttctgttggcgacgggccacctgtcgacatgactaattgtgcagtcaacagctgaatgtctgaaacggacaatcatatgtcaatgagtgatccactgtgtaaaacaagccaaagcattgctcctagcagcggtcttgcaatgcaattttgtttttgaagacacttgcaatgagttcaacagcaacaggacaacttgtttaaattgccagcctgattgctctccctcttcctatcacaaaaatctcaccatggacaccatcttttctgctgttcttggtgatctttttagcaggtccatatccttcgtgattgatatataccatcaccatcaccagggcggtgtggaggagaatctacagcagttacaccgcatgctgttgcgaatcaaagccgtcgttgaggaggcagacagtaggtgcatcacaaaccaagcgatgctgctgcaactcaggatgttgagagatgtcatgttcagaggctactatttcgttgataatttcaggtacagaatctttcaagctcaagctaaagacgaggtgggtgatcactctctcgacctgccccctttcaatccattagaacgattttttatcttcactagagcaagtaaaatcgcatctgaaatcttggagaaaaaagagctgcaaaaagatgcttggtcacctggaaaccattgtttcagacacgcaagagtttgttgtgcttgcgagcagctaccctcgtataactcgccaaccctattgcagctatgtgttgctggaaaactgcatgtttggtcgtcatgcagaactggaaagggtcatcaagttcttgctagaacaacatcctctttgtggtgcaaaaggtattgatgtgcttccgataattggaccaggcaaagttgggaagagcactcttgttgagcatgtctgccgtgatgaaagagtacgtaaatgcttctctacaattgttttctatggcccggatagcattgataatggagacatggtgcttcttccagacaccagggcaatcaaatatcgaaatcctgcctcaggcgaacagtcattagctatcattgaacttgtcgatgagatggatgatgaaacatggagaagaatattacacagcttgagaggagaccacataacatctgtgagtaagatcataataacgagtcgatcaagaaagatagcaacttttggaacaacaaaagcactccaattagattttctcccaaaagaagccttttggtatctgttcaagacggttgcatttgggagcacaaatcctgaggaggagccgaagctagcatccatttgtatggagatcgcagacttggtgaatggatcattcatggaatcaaatgttgttgggagcatactcagatctaatattactgctcaattctggtacaattttctcaaacgcttgaaatatttcactgacagacatttccgtctgctaggtgaacacccaagagactcatacaagtctaaccgtgggcgtacttacatatggatgcataaaaactactatggtgacggtgacgcagcgacatacaatctttaccatgcaaattctgcaggactaaataatctaccaatgatacgaatgagcgatatgcttatcggaaatgttaagcctcagaagaaatgtgaagccctggaatggcaatccagcatacctccatactatagctatatcgtgcaatacgggatacttgcacggcagccgcttatgctacctaaaaggaagcgatcccgggcgctcttagaggagttagtttgatccaaaataatgttggttgtcaaactagtttagctccatccatatggcacatcaaacaaatatggattctataacagcaacagtttataaaatatgtttgactccattcttatccagttattttgatgtaaacttactattacttgtgtacatctttatgcaggaatgtcgtgccatcttccgtcatataatcttttagtcatatggttttgttttttttttgtaaggttggacatatctttttatgtttatatatttataaaattttatgaaatttgaatctgtatctctatatcactccctttgttctcgaataacattgacatctgactcaccacaaattatatttgaacgattagattttgatgaatgaaacttgtatggttatatttgtgaagcatagcactttaataatgtaacattaactaacatatttaggtatttatatattttttaaaaaaagaagtggtctaagtttgaaattgaacagtacaaacatgactaaaaggagccatcatattcattctcaaggcttagaaattattatgttaaatgaaataaaaaagaaatatctatgctatccatcaaagtggaacattatatagtatagatcgatagccacagatgtataagaaacagttttattttaaaaaaggagaggaagagtggtgtagaacatgcaaatttacttcaaataacactgcccaactggttcgttttatgtttagcttagataattcttcattcaaccttttgtcaaaggagggattgttttataaagaaaaagtgtggagtgacagtgactgaaatgtagcaaattttcagttgcctcaggatgaacaagaaatccctctctttttcttttttttttttggctgcagtaaaatgtgggtctttgttcatttcttaaaacagagacaagttggcttttaaatttctccctcgtgcattttttttgtaagacccaatttgatttgtcatggtcttttatgttgaactttgacattaaatatatttgtaacaaaatgttacttcctccgtttcacaacgtaagtcattctagcattttccacattcatattgatgttaatgaatctaaatagaatgacttacattgtgaaacggagggagtactaagttagaagagcatgaccatatgaaagcgtgttgaaccataattccagtggcgactcaagtatcaagcaatacaatgcctttaccactcagaatctcacatcatctgtttgtacgtttttcgtcagacttccatgcttgttttctctcatgagttctgacactgagagaacacaagaaggttcctcatgcttctatggcttaatctgatgatcataccatttcttctgttttctccaaatataagtaagaaacatattgcatcacattctctcgtatgacacctgcatggattttttttctaaaataaacaaaaacacatattgctttctccagcattccaagagtcaaggaaacatggaacaggacagtcttttctacgaataaagcaaacaataatatgaagtggagggtaatttatcaaagagtaaaatgcatggaggatcacttaacttgtttagttgtgtcaagtaggtcactctacttttaaaatacacatctagatcactaatgagtcaagtgagtcacttgttcatctaactatccatatgagcataccttgtacgcatgacatgctacctatgattgaaaaaaatgctttgacatatgtagaaaatcacatatgtatttttttcccattctcacagcacgaccacttgaaaatatacgaaattaggagaaccaaatcattttcactttgcttttttatgagttattgtacaatcttaaacaacaacggaggcaaaatcctattaggcaatggcggcggatgctcaaacatttttttcaaccctaggtgacatgctatatgtatgaggtgtgctcatgtgaatagttaaatggctaaatgactcacttaacttacattaatgatccagatgtgcattttaaaagtagagtgacctatatgatacacctaagcaaattggatgaccctccatgtatattactccttatcaaacgcctggcttaattacctaattctgaaaacgtaagggagctgacgtttgctaattctaaggtctagcacgtgtactgaaaatcatcgcctcttatgagcccttcgttgtcactatcggcgactgaatgtgcagtcaacactcaacaactaaaacgtttgaaaccaacaactcagcaagaaatcgctgttaagggctgacctggagcaattcaacaacaacatgtacagctccctgtggctaggcttcagtataagttgcatgcctgccctgattatacccttgttccaatcataacaaaaatcttaaccatgatggacactttcttttctgctgttcttggtgatcttctcagcaggtccatatccttcatgattgacagatacaaacagcaacagcagagcgtggaggaggagagccgtctgcagcagttacaccgcgtgcttctacggatcgaagccatcgtcgaggaggccgacgggaggctcatcacaaaccgagcgatgctgcaacagcttggcatgttgagagagatgatgtacagaggctactacttcctcgatggtttcaggtatcgaatcgctcaaccacatgctcaagatgaggtgggtgatctgtcccctttcagtccattaaagcggttctgtatctccactagagataggaaaactacaatatccgaaattttggagaaaaaagagctgcaagagatgcttggtcgcctgaaaaccgtagtttcagacatgcaggagtttgttgtgctcgtcagcggctaccctcgtatgaaacgccaaccatattgcagctacttgttgctggagaactgcatgtttggccgccaaatagagaaggagaggatcatcaacttcttgctagcaccacatcctctcggtgatgaagaagatatcgatgtgcttccgataattggaccgggcagagttgggaagagcacactcgtcgagcacgtctgccgtgatgaaagggttcgtgaatacttttctacgactgttttctatggcccagatagcattggcgatggagacctggcgcctcttacagacaccggtgcaatcaaacatcgaaatcctgcctcaagcaagctgtcactagcgatcattgaacttgtggatgagatggatgatgaaacatggagaagaatattgcaaagcctaagatcaggagaccatgtagcacctgtgagcaagatcataataacaagtcgatcaaacaagatcgcaacttttggaacaacaaaagcactccatttaggttttttgccaaaagaagatttttggtatttcttcaagacggtcgcatttgggagcacaaatccagaagaggagccgaagctagcatctatatgtatggagattgcagctgttctgaatggatctttcatgggattaaacatcgttgcgagcatactcaattctaatctcagcgctcaattctggtacagtttgctcaaacgcctgaaatttttcacatacaggcatatacatctgctaggtgaacacccaagagacttgtataatgctaacagtggacgtacttacatttggatgcatgaaaactattgtggtgacagtgacttagtgacatacaattattaccaagtaaattctgcaaggttaaatggtctacaaacggtactaacaagcagagatattctaaccggaactgttaagcctcaggcagcaaaatatgaagtcttggaatggcaatccagcatacctccatacattagctacatcacgcaatacgagatacttgcacaacagaaacttatgctacctcctaaaaggaagcgatccggggcgctctcagaagagttagtttgatatggaattagtgttgtcaaactttagattaggtccatcaacggactgtttggtaaacatgttccatttcgttccaatccaattatttttcaaatggtgttactcatgtgtgcccccttctctttcccaccctctttgatgatgtaaactaactagtattaatcaattgtgtgcatcttcggtatcaaatcttttagtcatgttgggacaaaatccaacaagtatgcgtgtatttctctctgtattggatgcctcaaccgcgggcaacgtttacacatttatatggagtgtacaaagaggaaattacattgctacccacattgctggctaatctaagtggttggccggtgggccagcctgacggccatcgggtaaattccctggtgacaggagggctgcgcccattaaggaagcggcgcatgttcccgagggtgcccgctattacccggataaagccatgctccgggtaatagcgtgcgccatctcgccatcgtcagtggtgtcagaggtggttggcggcgtgtagtacgtatttatgccatcccactgagcgtccagtcctccatctcaagcctagggctcttgaagccctggtttcctccggggcagcagttagccctggaggccttgataggcctccgaagtccttatacggcttcggaggccacggagcgctccggaggccttggtcaattccggagcccctgggtagctccggaagcctcaaacagctccggagcctacgggaggctccggatgccttggctgcctccggagcctcaagcgggctccggaagccttggttggccccagagcctctaaattgctccggagcctagggtagtagccatctttagtcattttcctagggtggatggctccgttgaagctcggttcgtctttcggaggcttgctcctttacccggagccattcccccaacaagtcatatggtttttttttgttgcacatatcttttgtcttgatttattttctaaagagttcgtgaaactttgatctatatattttaactattagattttttatgaatgaaagttgcatatttatatttgtgaagctacatacttcaataatgtaacatatttttcaagtatttatttatttttgctaaaaagagttcaaaactaaattatttcaagaacagagatatctattaacttattaaagtaacagaaaaagggaaaactattctaatccctcgaggggatgttccctcgtttgcttaaaaaccatctaaacggttatgaaaaattctggaaaaatttgacaacattcatacaacacatatatacaactccacaaaatattaagtccaaacttaactcacaagtcaagatataaaaaaaggcaaatttagcgtatgaatagtatcgtactgtttatatctaaatttatcttttatgtttcttgatgtgtagatcgaatttgaacatgaattttggtggactagtaggtaccattatactctatattgtcaattgttttcagaatttttcacaactatttgcatcgaatttaaaagaaaaaggtatacgaggggatatcctctcgatggattagaatccactccctagaaaaaggagcctccacgttctctcacggcttagaaattctcatattaatcggagaaaaagaaaaacagtaaggaatattagaagaggagactagagtccatatagaaatacaatttagaaatagttaaaattcggaattaaaaaataagtaatattggaagaggagactagagtccatatagaaatccaatttataaataactgaaattcggaattaaaaaataaagaatattagaagaagagtatagagtccatatagaaatacaattaagatataatagaaatttggaattaaaaataaggaatattagaagtgagtattgagtccatatagaaatacaattaagaaataatagaaattcggaattaaaaataaggaatattagaattagagtatagagtccatataggaatttaaaactaactaaaatttagaataaataaaataaaattaaaaatttagtttagagttcgcataaaaatacaatttacaaataactaaaattcgaaattaaaaaaaacatggaaagaagagtctaaagtcattataggaatacaatttaaaagtaactgaaattcgaaattaaaaattaaagaatattgaaagatgactttagagtccacatagaaatacaattagaaataataaaaattcagaattaaaaataaataatattgggagaaaagcctagagtctatatagaaatacaatttacaggtaatgaaaatccagaatttaaaatatatatataaagacgagtctagtgtctatatgaatataatttacgaataactaaaatttgatattaaaaataattaataactagcacatatataaaatacaatatgaatattacacattagtagtttcgtaaagttagtataaaatttaaaattatgttgtcttcttaatatatttgaataatatattgagaaaacatatatgctattatatgagataaaatgtaatgatgctagccgcgcaatctgcgcgggccaccatgctagttataaatatggctaaaaggagccactatgttcattcttgaggcttaaaaaaattaccatgttaaataaattaaaaataaatatatgtgtaatctatgctgatgggactaaattatagtggattgattgatcgctacatatgtataagaaataattttaaataaagggataagtccgagttaccatctaatatatcatattttgccacttttgtcttgaaactatctagggcttgttcagattgtagacaaaataaatctatgccaaaatttagtaagttggcaatattaccaaaattttagcaagatttcttatgtatttaccaaatttggcaacaaactaaacgcatacattttttttacaactttaaaataaaataatatagttgaaaatagcatcaatctgaacagccccttactttacccatccccttggttcaaaccaaccctataatttttcgtctatgtgatgcttacatgatgatccagtcagccaataatattttaaagaaatggtcggttttcatctacgtggtgcttatatggtggtccaatcaggcaacaaaattttaaataaatgataggacccatgcatcaatctttcttctccttctagcagtctagatcctggggcatttgactatttaccacccacaatctatgacatgtggattcagtagtaaattcttaattgccacttgtaaaaatggtaaatagttaaatatctctattgcagttgcaacctcaagcgtgcttgccgccctccaagatctccacaaactaactgcctcgggtgtctcctccttgatcttcggagttcagtggcttgttagctcaggttgagtttagctccaaactttttttttcaaactttcaacttttccatcatatcaaaactttcctacacacataaacttccaacttttccgttacatcgttccaatttcaaccaaacttttaattttggtgtgaactaaacacacccttcaatagttttgaacggtaactgccatagagggttagttttatctgcaatatctattgatattgtaaaactcttgcctaaaaaaaatatcgtcaacctccggcaagttccaccttccatttccgcacatccatgtggttgtactactgctgttttggtccagatttttgttttaaatctttgtagtcctcaggacctctgccactggacatgcatctcttctacaaatacttcccctttccacagccttctcgacatgtgatgatttctatatgtcagtggcatctatactccaaatttaaaaataaccgatgtaaaatagaccacgaatttattatcttgataaagtaatagaaaataaagtcaccaatgtttgctcttatagcttagaaatttatgcattaatcagatctaagtcattgattaaagtgtgtgtcaagagtatgacggactagattaaaactgagttcaagtaggaatataatttaaaataagattaaaaagaatccatattgatcacaatgtataatccaagttgacatacaatttaaaatatagaatgcatgaaaaatagtgtatcagaaaaggagtgttaagtatatgagaagaggacacaaaattcttatatataatatcattcaagtttttatgtgtatattatatattattctcaagaatgaatttattaatcatgtattatcgtcaagttacatctaaatataaactttagctttcaaatcatctattaaaatatgtttatttgtaaaatcatggtgattaagttacgattaacaattggtcgagatgttgataaaatgctattttttaatgtttgtgattttataatggtttacgtatgtaacatgtgctcgaaaatatggtttcttagttgttaatgggcaaccgttgcttgtggttggaggggcgtacgttgttgccttgttggtgatcactctcttggcctgtcccatttctgcccattgaagcgtctctgcatctccactagaacatggaaaattctgtcacaagtcctggagaagaaagagctgcaaaagatgcttgatcacctgcaaagcatagtttcagacatgcaggagtttgctgtgcttatgagcagctaccctcgtatgagtcgccagccttatggcagctacttgttgctggaaaactgcatgtctctcggcctttgtacatttactactcccttcgattctataataattatgttttaaacaaagttaagatcaaacttttataactttgaccattaataattttaaaaatatttagtttaaaaaaactagaacaacatatatagatttgtctttcaaaacactacaataaaagtaaacatacatttatttaatatatgtattataatagaaaaataaggtagaccgtattaattgtttaaaacgttaattaaattgaaagtagtaattctaaggtctagcacatgcactgaaaatcacctacccataacgagcctttcgttgaccacctaccgatgactaatactccatccgtccctaaatatttgttaccgttgactttttaaaatatatttaaccattcatcttattttaaaaaataagtaattattaattattttcctatcatttgattcattgttaaatatactactactactactcaagtttttcaataatattcataaaagtttttgaataatatgaacacttaaatatgtttaaaaaaatcaacgacgtcaagtatttaggaacaaagggagtactaattgtgcagtcaatgaacgacctagacagcggccttgcaatactatgcaattcaacagcaacacggcaagtggcaactccttgtggctagccttttgtataagacaacaggtgcacctaattggtttcttctaatcacaaaatctcaccatggacgccttcttctctgctgttcttggtgatcttctcagcaggtccatatccttcacgattgacagatactaccggcagcatcagggtgtggaggagaatctacggaagttacaccgcatgttgctgcggatccaagccatcgttgaggaggcacatgggaggcagatcacgaaccaagctatgctgcttcagcttaggatggtgagagccgtgatgtacagaggctactacttccttgataatttcaggtaccgaactgttcaagcgcatgctcaagatgaggtgggtgatcgctctcttggcctgtcccctttcagccaatttaagcggttttgtttctccactagaacaaggaaaattgcatccgaagttttggaccagaaggagttgcagaagatgcttggtcacctagaaaacattgtttcagacatgcaggagtttgttgcgtttgtgagttgctaccctcatatgagtcgtcaaccttattgcagctacttgttgctagaaaactgcatgtttggtcgccagatagaacaggagaggatcatcaacttcttgctagaaccaaatcatcctagtgcaaaaggcattaatgtgcttccgataattggaccgggcagggtaggaaagagcactcttgttgagcatgtctgtcatgatgaacgggtgcgtaaatacttctccatgattgttttatgtagcgcagatagtattgggggtggttttcttacagacaccggtctaatcaaacatcgaaatcctacctcaactggacaatcattggttatcattgaacttgctgatgatgatatggacgacagaacatgggcaagaatattgcacaacctaagaggagagcacataacacctgtgagtaagatcatattaacgagccgatcagacaagataagggcttttggaacaacagaagcacttcatttagattttcttccaaaagaagcattttggtatttcttcaagacgattgcttttgggagcaggaatcccgaagaagagccaaagctagcatccatttgtatggagatcgcgaccttggtgaagggatctttcatggcaacacacgtcattggtggcatactcaggtctaatcttagtgctcaattctggtgcaggtttctcaaatgcttcaggcattacacagacatgcatatctccgtgctaggagaacacccaagcgacgcgtatacaaaaacaagtggacttacttacatttggacatctagaaatatgagtgttgtcgcagcgacatatagcctccatcaagcaagttctgctcagctggctgatctatccccaattctatcaaatgatgttcttaccggagacgttgagcctccggagaaatttgatgccctggagtggcgatctagcatacctccttactacaactatatttcgcattacgagatacttgcacaaccaccggatatgctgcctaaaaggaagcggtcccggtcgctctcagaaggtttggtttaatctagaatcatatgaggtttaagcaacagacggagttggcaactttgttgattcacttagccagttgttttagcaattagcatggagtttgtccaatgtaatttccctttctgacaatgtaaactaaactaaacttctatgacttttgaagttgatgtgtagtactccctccatctcaccatctcaaaatacaggactgaagcacaaccccttttttttcatgtcttatattggccactactaaaatggtatttttgcatgcatccaaaagctatttttgcatgcggttgaaccgtccgtctgccaggagatgattgcaatcgctattttttcatgcgaatggcgcacccacatggaaaaattgttttttggcaagcgggtgcttgtcgtcgtcgtagtctgccactgctcgtcgtctccgtcgtcgagtcccgccagctcatcgttgttgtcgtcgtcactcctccttgcgcctctaccactatccctccgcaccccgatggattcactggatctgcccatcatggcgccacattcaccactgatcccttgctgcccggtcccactcgagcccgccgtcggtcgctcctactcaaggtccccgttgccgctcgctccgcacgaggatgccaccagatatactcatcaattattttaagtagaaatacaacttaaaataactgaaatttggattaaaataaagaaaataaaaagaaccatattgaacccaacatataatacaagtagaaatacgatttaaagtatctgaaatttgaataacaaataaaaataagaagagtccatgtagaacataatatgaaattaattgaaattcggaataaaaatataataaaatcatcaattggattacagcaccaattccaagttaaaaattattaaaactcaaaatgaataaaataatatgtaacaagtgtccttgccaaatgtggagtatataattggaagaactatagtataactatttttttgtcggcaattttttttgggaatcaacacctaaaccctaactctaaacctttcgaattatgggccattgaatttgctccaagattcatgcaaatgggggcgtcggaaaaaatgcaatggggcagccaggaagaatagaacacgcaacctaagatttgcgtgcgtgcgccttcacaagtgaaccagcacctcgttttgatttcttctgtacaagttatataccggttacaatataactacgtacaagttatatatcggttacaatataactataatcaagttataatgtaattatactagtttataattatagttacatttgaaagtttttctattgaaagttatattggtacttcaatttatataagaaactaggactaaatataaagattttgtcaaatgctcaacaagttagcggcgcataaatcatgttagtcaaccaagtttgttcagtggtcgttggtggtgaaaaagaaatttagtgtttttttgcctttggttatatattgagccttgctggcatttgtatgtgtaatgaaatgtggtcaagaaaaacatgaaacgcaagtggcttttctggcagtcaaggaaacatggagggactggtcaaattgtagctaaaataaatcttacctggtaagatggtaatattatcaaaattttggcacgatttcttatatatttaccaaatttggcaacaaactaaacatagatatttttttggcaactttactaaaaaatagcatggttgaaaatggcatcaaagtgaacaggcccgaaacatactcctccctctcatttcaagtgtaattgtaggtttccgtatctaaggtttgaccatccgtcttatttaaaaaatttatgagaaaataaaaaaagtcacgtataaagtactatttatattttatcatctaataacaataaaaatactaatcataaaaaaattcagataagacagacggtcaaatatagtacacggaaacacacacctgcacttaaaaagggatagaagtaaatggtaggaagtagatgattatttatcacctaaactagataactgcttacttccgaagtgagctggtatttgctactccctccgtttcatattatatatcatttaatttttttattagtcaaacttattaaagtttaattaagtttgtaacaaaatataataatatttttaatacaaagtaaatattatattaagttatattcaatatcaaatttaatgggactaatttgttgtcgtagatcttcatgttttttctataagtttgatcaaagttaaagttaaagaaatttaacttaaaaaaaagtcaaacgaacggagggggcagtaattctaaggtctgacacatgctatgaaaatcagtggccagtctaacaggacaaattgtgcagtcacaatggaaagtctgaaaccgacattgcaggcgccgtcaatgatgaatgaacaactgtattgcatatactccagagttctagaccgcgggtcttgcaatccacttcttcttcttttttttctttttcttctttccgactcttccatcaaagactcttgcaaatgcagttcaacatcgacaagatagcatgtggctagcttccctgcctcactgcacaccttcttccaatcacaacaccccaccatggacaccttcttttctgctgttcttggtgatcttctcagcaggtctgtatccttcctgatcaacagataccaccagcaacagaaggatgccgaggagaatcaacagcggttacaccgtgtgcttctgcggatcgaagccacagtcgaggaggccgaccggaggtgcatcacaaaccaggcgatgctgctgcagctcaggatgctgagagacgtgatgtacagaggctattacttcctcgatagcttcaggtaccgaaacatccaagcacatgctcaagatgaggttggtgatcactctcttggcctgtcccatttctgtccattaaagcgtttctgcatctccactagaacatggaaaattctgtcacaagttctggagaagaaagagctgcaagagatgcttgatcacctgcaaggcatagtttcagacatgcaggagtttgttgtgcttatgagcagctaccctcgtatgagtcgccagccttatggcagctacttgttgctggaaaactgcatgtttggccgccaaatagagaaggagaggatcatcaacttcttgctagaaccacatcgtcctgccggttcaaaaggcattgatgtgctcccaataattgggccttgcagagttgggaagaccactcttgttgagcatgtctgccatgatgaaatggttcgtaaatgcttctctaaaatacttatgtatggcgcagatagtattgagtgtggagaattggtgcctcttactgaaatcggtgtaatcaaacatcgaaatcctgcatcaactggacaatcacttcttatcattgaacttgtcaatgatatggataatgaaacatggacaagaatattgcacagactgagaggagaccactcaacacctgtgggtaagatcatcataacaagtcgatcaaacaaggtagcaacctttggaacaacggaagcacttcaactagattttctcccagaagaagagttttggtatttcttcaagacgatggtatttgggagcgcaaatcctgaagaagagccggagctagcagccatatgtatggagatcgctgccttgatgaatagatcattcatgggaacatacatcattggtgacatactcaggtctaatctcaatcctcaattttggtacaagtttctcgaatgctttaaatattatacagacattcatatccgtgagctaggcgaacatccaactgaaacatataaaaggataagtggacacacttgcgtttggacgcctgaaaatcggtgtgttactgaagcgacatatgcattgacatacactctttatcaagcaagttctgaagatctgaatgatcagcccatggtgctagcaagcgatgttcttgttggaaatgttcagcttcaagggaaagttgatgtcctgcaatggcgatcgaagataccaccttactactgctacatggcacatttcgaggtacttgcacggccgctgcatatgccgcctaaaaggaagcgatcccggtcactgtctggacagttagtttgatctgaaatcgttggggtcactagagtctagagttggttgatccatatggcacaggaaacagtatggatgccgtaacaacaactgatagtttagttcaacagagagtttgctcacatgtttcccccgttttgacattgtaaactaaactattagctatgtacatctctttgcatggatgtaatgccatcttcccttatctaatcttcgttccagatggttttttcagtcgcattcaagtaatgaaccttaatttaaccggtttcggcctgtgctttataaatagctttggcagaaaagacaaaacagtccctccaacgtataaatagttgtgacttcacgttttcatcgtctttagtaaaatcaagtccaccacatagaaactcatatcatgctctaccatattttttttgcagataatctcaattttagtttactaatacattctaataaaggacaatcgtacttgttgaacttatcccttgcaacttagataccatgaggtggtccttgaaaagtttttgaataagtagagggaattcgtaatcctctggacgtagagcactagagcgcgtggggctttgaaaccaaatacaatctccgttttttaatagatgacgccgttgacttcctgtcacacgtttgaccattcatcttattcaaaaaatttacgtaattataatttatttcgttgtgagttgttttatcactcaaagtattttaagcgtgatttatatcttatacatttgcataagtttttttaataagacgaatgatcaaacatatatttaaaagtcagcggcgtcatctattaaaaaatgaagggagtatattacccaaatggaagagtccctcttcaaaataggtctaatagataagctatataagcgatatattgattttcctttccaacaatgggcttgatgtgatagcataagcctttgtagcaatcaagactagtaagtccattaatccaaacaattgtccatgtaccagtagaagatttggtagctattgtagcctctcctttgggcggaaccccccgtctgaggagttactcggaatgctgtcgatcggtgtcattggtttcgtactctcgtctcgggtgtagtaagtcaatttataattcttgacaccagcttgaaatttaacattttctttagtttctgtttccggtgacatacatccatcccacagttcatgaatttatgctatagttacatttgaaagtttttctaaaaaaaaatattgaaagttgtgtatagcccggttccccaccttttggaactatcttgatacttgcatgggtttgttttgaagtgttttcagaacatgtgcagcttctttatcttattttgagaaaaaaaaaaggaaatttgaggccttgagggggaagcactagcagaaggacggtatgactattcagcccgcttaagattaaaagcccaaccttaaaactggcccatatatcttgggctcttcccttcctgcctcccgttgcaaggctcggttgggttctctggccgcgtcacaggctcatggtgacggcgtcaggtccggcgatggccgccggggagatcttccgccggcgcgcctccaccatcctctggcaggtagagtttcctgccgcacaaactcgccggccgcgccgctcgagctcgtccgcgtatccacgccaccgccgcccgtgctgcccctggtttgctgcgccggattaatcctcgctgcctgacttccacgacggcgcgattggtagggtaaatatcttgggtagatagatgcatattgggtgctggatttcttgtgatttcaatgctttcatcgactaggccgatacaatagctagggttggctttgggctttggcgcggccctaaatgcgttgctctctaactgtactgagtgctatagcacgcatctatgaacctttcccattcttgatgccatgaattgttctcttcgacaaagcctcattaaaattatgtatgatcatggcaaatccgccttgtgctcttccaaatgttcctattcaacagctgaaatcaacaagcactcagttagtcctcagtgacccacgtgcctttgaagaattgttgcatttagatagcagcctgccatccaactatttccatggatcaacatcatagcatttgactaacctgcctaattgtcacaggtcccactagttcttgcaatagggcctgaaataccacttttacaattcccttcacaacagttaaccatagtgacattttttttgcctgcacttcttggtgatcttataagcagatccatatcctacatattcctcattgatatatactactggaatcaagcagcggtgtggagggagaatctgacatggttacattgcggcactgctgtcaatggaagctttcaagctgtgctggttccagatgttggctaattctaaggtttgacacgtcctctgcaaatcgtggcctcttacaagccttttcattggccacctatggctaattgtgcagaaatcaactgagccatcaataaatgacccactgtgcaaagcgttctgtgcattgcaccttgacagcggccttcccatgcaattcagcagcaacatgacaactctttactccttctcgctagctttgtgtttatagagttgcattttactgttgagttgccttcctgattgatttaccttttctaagcacaagatatatcactatggataccttcttttctgcagttcttggtgatcttctcggcaggtccatatccttcatagttgacagttactaccagcagcatcagggtgtggaggagaatctacagaagttacaccatgtgctgctgcggatccaagccatcgttgaggaggcgtcaagtaggcacatcacaaatcaagctatgctgctgcaacttacgatgctgagcaatatgatgtacagaggctactacttccttgataatttcaggtaccgaatcgttcgaccgcatgctcaagatgagctgggtgatcgctctcttggcatgtcccctttcagtccatttaagcggttgtgcttctccactagaacacggaaaattgtatctgaagttttggagagaaaagagctgcagaagatgcttggtcacctggaaaccattgtttctgacatgcaggagtttgttgtgtttctaagcagctaccctcgtatgggtcgccagccttactgcagctacttgttgctagaaaattgcatgtttggccgccaagcagaacaagagagggtaatcaacttcttgctaaaaccatgccgccctggtgcagaaggctgtgatgtgcttccgataattggcccaggcagggttgggaagagcactcttgtagagcatgtctgtcgcgatgaaagggtacgtaaatacttctctacaattgttttctacagcccagatggtattgggggtgaataccatgcgcttcttacagacaccgttgtaatcaaacatcaaaatccttcatcgactgaacaatcattgcttgtcattgaactttccaatgatatggatgatgaaacatggagaaggatactgcacagattgagaaaccacataacacctgtgagtaagatcataataacaagtcgatcaaagaacatagcaacttttggaacaacaggagcacttcaactagattttctcccaaaagaagcattttggtacttcttcaagacaattgcattcgggagctcaaatcctgaagaggagccgaaactagcagccgtatgtatggagatcgccgtcctgatgaatggatcgttcattggagcacacgtcattggtggaatactcaggtcaaatcttagtgctcaattctggtacacctttcttgaatactatagatatttcacaggctggtatatccacctccaaggtgaacatcagagcgacatgtttaagaaaagaagtggacttacttacatttggtcgtataaaaattggtctgctgtgacggcgacattccatctttatcaaataagttctgcgaatctgaatgatctgcccgtgatacgaacaagcgaacttcttactagagatattaagcttgaagggaaatttgatgccctagaatggcgatctagtgtacctccttactacagctacatggtgcatcacgaggtacttgcacgaccgccaattatttttcctaagaggaagcgatcccggccgatctaacaagggttagtttgatctagaactagttttgagacatactccggagtatctccatcagtatggcacaggaaacaaccatgatgttataacagcaatagagtaatagactgagtttagcaattttgttaattcacttcttagcaagttattctagcaattagcatggagtttcaactatgtattttccctttttgactgatattattagctgtgtccatctatggt

SEQ ID NO: 69493 - DNA, 1854 bp, Oryza sativa
gcaaagcataggtaaaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttctaccgacacaaatataacgaggggccatgaccgttcaaaagccatttccacataccgtctccaagcatcagtgctgtccatcggcattagttcccaaaaataaccttctgttgcacgactcactacaactgacactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacttgtgatgaattgagcgaaccagcagggcttcgccgctccccttctgctgccctcccctctctctctttcgttttttttggatttttagtgaatataatgaaatttcacagaggagggactgggctttatagagggagaggcaaaaatcgccctcccccagggcggcaagggggccgcctgcaaaattccatgcccc

SEQ ID NO: 69494 - DNA, 5107 bp, Oryza sativa
ctcccccaatcgggagggccagttattaaccgccgcctcccaatcatccgatctgcccaaagatggatcggggctgtccaactagccgcctgcgttgcagccgcatcggcaccacatgcacatgtggtgccgatgcggctgccacgcaggtggcaagttggacagccccgatctgcctttgggcagatcggatgatagggaggcggcggtgactaactggccatcccaattgggggagagagagaggggggtgggtccaggtgaatcgggggagagagtcaagggagagagatagggtcaccacccacaacgacagtgcgctgcatgtaaccctcacgagcaagctgggttcacgcggtccgccagattttagacgatcagctcatcctagatatcataggaatattcgtttttggatccaacccaaacccacctagtcctccaaccaaaaacatataaaaataggatggaccctcccaacccaccaaattcctccaaccaaacacatgccaagtgttagtaggtgggatggtaaagagatcttggatggagagaaaggccttgagttcaaatgttgcttgagacatatctatgaatatcagttgaaaaaaatcatatgacttggggaagtgaagtgtaaccatataggtgcctaataaactatcaaatatattttttcggtttttttttttggcttttgggtttttctggagtagttctttacgaccggggggcggggggcaaactgaagatgacttgactttccgtgataccgacaaatgacgaagaacagagaagtgctatatatcagacactatcggtaagtttatatatatgattatattcacggcacgcatcaacgacgagtacgtacgtcagttacgtatatataggtttttaacgaaatgtgccctactcggctgtgtcgcctagctggtttcacactgaggtgagctcagatgctttctgtctctactgataatatatgcatgactcgttagtcagtcctgtatagtagtagtatttggagttcacatacactgactgcattcttaattatttttctaataaaataaatcgtgtttctgccataaaagttaaattacaaaactgcatacattgtttaatttggttcctaccctatcttctagtcatgcgtcagggctaaactttttttcaattaaaagaaaagactttgcccggcgaataaagaaaagacttgcccgacaaataaagatattaatggacttgtttgaaagatcgacaaaatttccccgcttgcattgcgttggttcacaccttgtgtttcagttaatacgactcgccaagtcttcaaatatatatgttcgacaggtcaattactcccctccgttgttttatcatgcccgtgcactgggtaatggtagagcggatgaagtttaatctcaatgatttatcagagcactccagcatgatcatgagcatacatgacatagacagtgacgacagaggcatatttctgtattagatttcgctctatgagtaatgtatatggacgacgcccttaatatgtgagcccgatgattatagcatgagaggaattgaagtgaggaacatatgagtaaatattgctatcgcctctgcacaagagacgtctgatggaatattatgcgacaaatttatatctatatctatatctatacctaattaaaaaataagcaagacttctgggtaagaaaactttttcgtccgtccttttctttttcaccgctttcctttttcttttctttcggtttgttttttcgttgtttttccctttctttccgtccacttttttcccccttttttctcgccctttttccatttttatctctgtccgctttttttttcccgtttctctccatccgtctattttttccttcatctttttttcaccttttttcctttttcggttttttcgtcaggccaaaccctagcgatgtcgtcacgttgttctgtcttcccatgtgtttcctactcctattaattacaaaaatcgattcctcactactctctcgtcattttccccatgattttcaattccgctttaattcactgaatttaatctacatttgaaagtcaccttttttatccgagttttgcgaattcactccgatggtgaaacgaaaagaggagatcgagtgtatgaaaactcctcaaccaattttagaagatcaagaaaagattcgatcggatctatttgaaagtcactttttttatccgagttttgcggattaacttcgattttgataaaaacaaaaagaggagatcaggtgtataaaagttctcaactaattttagaagatcgagacaaaactcctcaaccaattttagaagatcgagaaagattcgactagatttgatggagaggatcggttttggcatcgtatgaagagattatcttttggaggttgaagactgtaagttggctatgtgagccggaacactacagctccacttgtgggttaggtctaaaagaggcaagccaaacagagggagatagcgggctgggctaggactgaaaatgaaggaaggaatgagtttttgtccaaaaccaagagtaaaatgtatagcgatccaaaaatattctcacccgttgcaacgcatgggtattttttctagtaaaaaataaagtcaatattaacttaaatagaaaactctctatgtacccctaaatttatccaaaccgttatatgcccataagttttcctcatttccttgtatactctcaaatttaatttggatatcttctataccctttccgtcaattgaccgttaaattcatgtaaaatagtctattttaccctttgatacaaagaaacatacaaattcatagagtatattgttggtgtgtaaaaattttttgtatgagactattatatttatgagtttgttatatgagattatttttaaaatttatgggtttttaagataggagcgctccctgccgtccaatcttcattacacttccccaaaccgttatcttggaagcccagccgttcgttacctgaacttcacttctccccaactactgcttatctctgaacattcgtcaggtcctcacactctgcaccaacgccaagctggccgacagccactggcgctgcccggacctgcacacatgcaaaaatcgataccacatgtatgtatgcatgtaatgcatgctacgctacagtacgtcgagtactgtagtaacgatgcactccaacgtgcacgaatatctgattccttcacgaacacgaacaccttatgaagttcattgcgaagatctcctcacatgtatgccaattggtatccaactatatcacccgatatctttgatcgttttgctttgcttcttcctgagtttagtcccgatcacaccattgaccgaagttgatcttcaagtatcctgactctagtcacattcttacattttttttctcgattgtaccagatctctgctcacccctaaacacaatcccagtcttcaccattatttaccaagactgacctcaataactcacgtgtacacaatcagacaaaacaaccgtttatagatacagatattataacctgaccaacattaatcacacacactcacaccctgggctgttcctagggcccatgaaatcagggggccccaaaccatgtacacatgtatatacctgtaaaaagaatgggccaaaataaaaatactgggcccatcagcccaggagggccggatcgcaggagtgaaggagcgtagttgtcctcagatcgctctgtaattcgcgatttcttcttttcacgaaacgcagccccaaacgtcggcgccgacgccaataatggagggggagagctcagttttgtggattcccaagaaatttgtctttaatttcatcgatatgcaacagatcctctcaaaattccctcataacaaagttgtatatatggtacttcctcaacttttccccatccttcctcctttcttatctcatcgttcctgaatcaggggcttgttgtagcttggctttcgtttgttcgcaagattcccattagctgttgtcaaaagaaggtgttcagcaattctttatgaacagtgttgaatagaataggaggagaggaatactgcgtaacgcggattcattgtattgaacctcaggggccggtatatataggttacatggattggatcttaagtaaactcagagagatagagatggaaactaatcctatcctaccataacaaaccggatacaatacgatcctatcaatatactctaacatccccctacggtccaagcgtgaacagcgcgggcacttggactggagaagaaaccagcaagatgctcaaaacggatgatagccctttgtgccgtagtcgacgtagccaaaacaaagggtgcgagaggacaacacagctgcagctccatgctgatgcagcggcaagaagtccatcaatgatgtagccacgctgaggagggtgcctgcaacaaccagtgaaggtgtggaccacaggcagcggcactgcggctcgaggggggcaacgcagcggcaacccgaagcttgatggcgtagtagatgtgctcacagacgatcaattgcagaaatcatcatgtttgtgtgcttgatcgggtgatcaggccgaagttgcacacagcggaatgacgaaatcgaagccggatgccgatgtcggagacgcatagatgtcgacgaggcggtgggcgacgcagttttcacgttacgcagtatttctctcctcctattctattcaacaaacagattagcttggttctcggctcaacccctcacggcccgtttggttggagggagtttttaggagggattgggagtttagagggatgaggctattaagtgttttgtttggttgggaaacataggaattttggtgggatggggatggggaattgaggaaggaactccctccttttcaatacctgggtaggggcaggtaattgggagggaattcctcctttactttttctaagcaaatctcagccatccgtttttattaatgacctaatctccaactaaactccctatcaatttccatcacctctaccaaacaagatattagaattaaaaatcaaattctcatcttaatttc

SEQ ID NO: 69495 - DNA, 4763 bp, Oryza sativa
tacagtgcaccgatactaataactattattactccgagcatgtctaaattcgtagttcttgaataagtcatatgttactatattttagaacgggggagtacccgttatgaacaggctctgatgagtcaccaattaagcgaatagacactagttgacttgcatcactcgatgatgtatatatatctcatcaatattaagtctaccttatctaattatcacaagctaccgtctgtgccgccaactgattggtggatttagcggccattcatttgctgacatagtttactgtagattgtacagtgcaccgatactaataactactattacctccgtgcatgtctaaattcgtagttcttgaataagtcatacgttactatattttaaaacggagggagtacccattatgaacaggctctgatgagtcaccaattaagcgaatagacactattgacttacatcgctcgatgatgtatatatgtcacatcaatattaactctaccttatctaattatcacaagctggtagcagcgtcgccaactgcttggtggatttagcggccatccgtttgctgataccactactacaaaaaccatctttcgtggcggccattttgggtttccgctggtggaaatcgcagccgccacaaagcaaaggccagtgaaaatgtcgatcttcgctcgtggttatttaccgccagccaaaatacatcttcgctggcggctgacaaaggaacgtccaccagcaaagacatgtcttcgctggcggtagccttaggattgctgccaaagaagacatgtctttgctggcggcagacataacacagccgccagcaaagaaatatctccgcttgcggtagccttaggtcggccgccagcgaagatagttctttgctggcggctcacattattttaggccacgtggcatgctaggaaaaatgaactaaggcttctatagatggacacgtggcccgacagcgaagatatggaccgtccttgttccgacacatggcccgccagtgaagattctattttttttaaaaaaaataaaaacaatattagatatactttttttttctattgtttgtgcgcgtatttcagagtcacacgtggatgatataactaatcaagctatcgatagagtttgttatctttcacgtattttacagccacagagtatgaagcagaataatatacatatataattcggaagcacctatatatatgtacattgacaaattaaattcgaccgacgacataacatttacaagtattttgaatgaattacaaaaccttagctatattaaacgcctgctccagttagacagggattcgttctccggcaaggccaaaactccttcgttgtcgaaaaactgcccaagctggtgtgcgcactcacggtggatgaagtagcacatgtcccgctgaatgtcttcaatggatctatcatcgagctctctttcagacttggggaattttggaagctgcatcagatcatgacagaattaaggaaattaattattcacaataatacaagttagtgactaatttaacaagtgtgtattacttacctcgtcgtaattcgcacaatatttcccattaacccttaagaactcacaacagtaatatccgcatagtattgttcccaccggttgcttgtgacactttcaacatcaaataattataaggtctattatgctattaaatggaaacacacaatcatttatgaaaattaactatcactagttggcatccatatgtacccaccgaccacttattgaagacaaatattccttctcttgagtttctgcgttatccacctcactgataatacctcttttaaatgcactgtttacacatataattaattcacattcatcatatattaaaacacgtcatgctaatatataacttacagatcgataattcttagaaattcctgataggtcttgctatctttatcgagagaatccaagacgttgacttcattgtactttggatagagaagaaagactatcaaatggtcactgcaaacgaaattgttagtcgagccatgattatatgtatatactcttagtgcatattacaacttactcaaaggcatatggggcataaacacactccttgtcctgcgtagattcaagcgccatagctatgtacatagcgacatctagcaccttttcctgatgcctttgtgctatgtaagatttcctctcatcgggagtcatcgccttgatgtgttctggtagcttcttttcgtctagcgtgtatgtgtggttcggcttacttatcctgtgtcacaccccaatccagcaccgccgtacaacggcacctgataggagcgtgtcgtaggaaaaacagcgcgagccgcttcctacgaaaccgcgatctcagtaccagtcccaggatgtagcgctggtacccacggtgacaaatatgaatcattgcaatccttaaaataaatagtggacttatttaccttaacttaggttgcagctcagacagcccgagaatgcaaccgacgacacggacgaggcaaacaccaacaacagcggcagcagcggaaccaacggtctaacacccaacaccacaggcagcagcagggaactaggacaaaccctaatctttacttcacttcaacttcatcttcagagctggcagaactatatttatatagagcaagggtgagtacttacgtactcagcaagccatgggaacttaggtggttaatgcaagcttcaagggaaggctggttaatttagcaatcaattttgttttcaagattttcaacaatttaagtgtgtgctttccacaactagagcgagacaagtctcagctcggtcggggtgagaagtaacaaatttatttatcaagatctttcaaatctggtttattttttccaaaccaaaccaacttttccaaacttcccgataatagtggtccccaaacgaccaatcacttccagggactcccggtcccgctgtcttccggacagctaattgcttcccaagcattaggtttccctaaccttaacaccttttcataaaacagggtaaaacaaaaactacgctaaggaatcacctcacatccgcccatgaccgtgggcacggctgttcgaatagtttgttaacctctgcagagaggttacactttacccacacgacattactaacccgaatcacccagcccgtgcagaatggccacgtctggtgacctaagggctttcatgacaaggcatttcgagagcatacacagggttgccatatgccgacgagaggggtcccagaccaacaacaggttaggtcccagaccatactatgccaggaagcccgggggttctccccgacaccaccccgttgaatccacatgtctctcggcatcaaggctcccccgattagcaatttactcagccaggggtgtcccattccacccgtgtggtcgcactattgtatgctcggatgtaattccgaaggaatcggtccttaaatgcgaccacacatgcattccgcccaggaatggccttgtgtcgcgagttttatttttaaaactcattttctttcacaaggcaccgactcaggcgtcgggttttccaatccttttgtaaactaagatttacccaagaagttactcaaattttaagtttgaaggcgaccgtcgatactcgcacagagtgcacgaatatcgaggcgcaactagatggttacaagggaacatgatataacaatcacaatggaaggatcaaatgcaacaagttaggtaggcccgccaatctgccttgcagacgggcaagcagattgagtgcaatcctatcaatgcataatatttttcaagcaatataattaaattcaaatataggctcaagatgttcaaaggtggcttgccttgctcagggtcttcacagagcttcgcgaatctatacgcaaacaatcaaaaacctaaacaaaagaccaagaaaaggatcctatttagactaaataatagtgccattaaatagatctcaattttacggaattattggaagtggaacggggtcaattggagttacggatcgggagatatggattttggaagtttaattgaaatttatagaaataatattctcaagaatattattgagtgtcactggtgtgcgagaccaaggaaaatgattcatgggattttggaatagagaaatgatttatggaataggggaaaaagggtttattaaatcccttgaaaaagaaaggaaggagggatgccatatagacttcctcgggcggcttaggcgcggcccgaggggtttatgcagcttggccagacctaatgggccggcgcgggcgcgggaggggcggcggctccacctcctcctccactgccttccttctgcgcggatctagccgccgctccgccccacgcgggcagatccgacaatgtcgcatcagatctagcgcgggtgacggtggaaggcgcggtggcgggcaacggttgtctcggtgctgccgccatcgaggcggtggccaggagcgggctggcgggaggcgtggctccgtcagctcgctgagcaccgacggcacgcgtgcggcgtcgtcggggaggtagaaaagggctagctcagtgatgctgccagactccttggagcagaagacggcgggctcccaggtgctgcaattggtcgatggctgcttgacagggtcgcccagctacgcggggcggcgaggacggaaagaaggaagaagaagcgagaagggcttggccggcatcggaggaggaaagaagacgggagaaaga

SEQ ID NO: 69496 - DNA, 2957 bp, Oryza sativa
ccacgcgggccggcgggaggaggaagaaaggggaagccgagatggatggcggacggcggccgagttcaccgaagccttgcgcgacggatttggtcttcggggagcacaccggagtgacgatggagtcaagagggagcgacccaacggctcggattcgccggagggaggtcggcgacgatgaatcgcggcggcgcacgccggcggcgagaaaagggggaaaatccaccggtgcaatgggagttcgattcggcggggtgggagcatctccggtgttcaaggggtgcattcccggcatcggatggggcagaggagtaccgaggagggccggtgacgagcggcggcctccgggatcggacggcaatggcagcggggctatgccgggcggcggcggggcttggggcggcatccacgcgcgttcgggagggctaccgagccactacgcaagctagaggggaagaggaaaggcggggagggagaacggggctaccgcgttgggatctcctcggcctcgggccgggaaaggggaagaagacggcgcccggaggtccccttcggctccgcgcgcttgccgactttccggcatgcgcaacggcgaggaaggtggtggcggcaaggcggcaagaacagaggaagagcggggagcagcttggcttttataggcggagaagaggcggtttaggagggggaaccgacttagatggtcaagggagctcgaatgtcgcgtgtggtcaaggtgggggtggcgaacttggcagtcacgggcggcagaggggggggtcgatggtgccggtcggggaaaaaagcaaaaaggggagggaggaaagggggctctgcccatgccattctgggagaaaggaggagggagagagagctctgcctccgggagttggacgcacatggcttggagcggccgggcatgcggcaacagggcacgggcggcgtctggacggacgcggcgacaactgagcgcggcgaccgaccgagcgtggttagccacgcgcgcgcgcgcgggaaaccgacgggcggcggcgaaaatcgaatggtggcggtttgaatcggcggggcgctggtggggagcggtttgggcgcggcgagggagagtgagagagaacgagagagagaacgtccgagagaggggagagagacggcgctctctcttggtggtcacgcgcggcgcacgtggagagagaggaggaaacggactgagagagagtgatgggccgagggagaggaattcggcccacaaaagcagagggaggcaaaatagacttttttagatggattgaatgtggagacaatttgaattggagggaatttaaccttgatacttggactctaggaacaataaggaagagtcgaagaaggattcaaaacgggaattgaatatttttgtagtcggagcgaatattcggcaaggattcaaaggaaggatcgactttctggattgaattcaaattggatatttgagctcaacaaagtttggagaagccaaggaggggattcaaagagcgaatttgatactttcggaaatgggaaggaatttcgatgaggcatgattctcgatgtcgatgggaagttggagttcaaagcgagaattgatattctagggatatatttgtatttggtggctcaaggattattgagagggggggtttaaagaaatcttgtaccatgggacaaatatttgggaaggagttcaaggatagatagatagacagagagataggttgataggtagaggaacggatagacagatggatagataaacagatagataggtatagtagatagatagatggatcgatagatagatagatcgttaggtagatcgatgtatagatagattgataggtagataggttgataggtcgagacccagagagagacgggatggaagagaaggaagaggtggaccggaaaaaggaagaaggaatccaacctatgggggaggttaactagacttttacagagagatttaattggaaggttttagggttggagtctggacttgaatttcgaagtcgatactcggtcttgggagaatagaaaggagtcaaggaagagaacaatattcggagacgagtcaaagggagatggataatttagagaaagagagtgtaacttgggagtttgagtttgactacttgacgagatatgcgggtgaggattttgaagagaagtctgaatagaagggttcggacttcgagattatttcagaacggatatcattttgggaagagctcaaggcgaaagggattgactcttggggtttagagttcaagggtggaagtgatctcgatttgcatattcaaacttgggtcagaagttcgagaaagagaactagggtagattgacgaaccaatacagagagaaagatagatgaatcaaaacctgagaagttgaattcgaatttgagaatcggtttgaaggaaccaaggagagagtttatgacgcgaaggtgaatccttggacggagttagggttcgggcattcgacaaagttcacagatggggttccaggaggggattccgaatagaaggaatcgagcttcgggactatattgggatggaaattttgaggagacgatttttgataacagggtatcgggaccagggagggatttaaattgagatctttggcacaacttagacttaacactcaaagaacaaaattttcgcaattaggattttcaataaattagcttttaacgtcccgcagaaagcggagcgttacatcctgcacgggtttaggtaggcgacaggttttttcatctcttcagcttccacgtaattcatcctgccaacaatggatgatcaaatgagctacgcatataggtgtagtgatttattaacatgttcaagtctagaacttacagacaccagatggcaattaaattggcgtccagcctcttcctacggtagaggggatgcatatcggagaaatggacttggagtaga

SEQ ID NO: 69497 - DNA, 742 bp, Oryza sativa
  unsure (1)..(742): unsure at all n locations
gcgtgccngttaggtctcctatcatatagggcgaattcgagctcggtacccatggttagtaattataactatattgtaaccatataaataattataactacataattaagtaattaactacttagagctcgaacctagactcgttgatagccctactccattgggtctttaacaatttctcaagcgtggatagaagatacatactgaaatgtatccatatatctctataatctctgtggaaagaaagaagagaagagagaagcagtcatttggattattttccgttcacaaactcacacagccacattgctttacgcggaaactagcttgcggaaactaattcgcaagacgacacaactttatactacgtcgctagtcttcatgcatcccatcaacacgcgtccacttctgatcatggaaaaaaatgggaatacggccacacggttgtccctttgcttttcttccatattaataataaattaaaaaactatgatttgaaaaaagcttcggatcggtcgactcagcaattagattctcatgcaaccacgtgcttcctattacgcaaattttgctatcggatatcggaacttcacggttgatatagtataccgcacaaagtaacttttagagaagatattgtataaacgtgataatttgtcaatagacaccataccgattaaaataataattcgcggttaatgaggagagaaaaatcgtgtgaaatgtcagatatacccatggc

SEQ ID NO: 69498 - DNA, 23744 bp, Oryza sativa
agctccagccaccggaacgagagatcgatacagctcgatcagctagccgcattcgccctcgccgccgccgacgatgtcgagccggaggtcgtcgcgctcctccgtgtcggaggaggagatcaacgagctcatctccaagctccagtccctcctccccagctcccgccgccgcggcgccaaccaggtactacatttcaccgttctcatcaccacaagttcacataaccaccatgcacactagcggcatgaacaagctagctacatgagtgatcgacgatgtgtagatttgtcggggttctaaatcttcggctacagctgtttgagaagggtctagctatttaaccactatagagggtctgccgttaaatgtgttagcccgctatttaaaactctctaattaattattgttgttaatggcggatgcaaaataaaatgcaggcgtcgacgacgaagctgctgaaggagacgtgcagctacatcaagagcctgcaccgggaggtggacgacctcagcgacaggctctccgacctcatggccggcatggatcacaacagcccaggcgccgagatcatccgcagcctcctccgctagctcatctcttctcatctgttcttcctcctcgatgatcgatcgatctcgtgttattctacgtacatgaaggatgatatgaatgcagctcgtgccctgtagctacgtataaatatacacatatgtatacatgcatacagtacatgatatgcatatgcctagatctgatctagctcagtagaaaatctactcatctcggtgtactactgatgatgatgatgattaaggcatgcagctggcttgatgatcggtactactactactacttcacttcagttcagtaggggcattagctagctagctagggccggctgcctaattaagtaattaagtaatttattatttgtagtagccagcttgatctcatctctcctcatgagccatatgacatgtggttaagttaattaatccttgatgcagtagagtcgtcccagctgtttcatcgatgatcgtcgtcatatgtgtgtatctcttgatctagctttgctgatctcctcttgtttcatttcctctttgttcttttcatgtgtttttctgtgagcttaattattgttgttttggcggttttggatcgagttgttttcctccagacaaccgaccgaccgctagctacccatcgatacaccgccatcagcgcatgtactactgtgtctgaaactctgaatcaatctaatcgaatttttgtgctgcgtacatgacacattctgagtatcattataccatgtgattagtcattactactgctcgatcgcttgaacacacacattaaaagccaatcgaaatcagaagaattatggtgttcacaccgttacgtttgtcctcgcgcgagtatgacctccagcccagaagatgtggaagctagctatttcttttcgtgccaaataacgacgatgctgattgatcggacactttaatttctatatagattgggttaatttgcaaccgtacggtagatgagatcaagtggctgcctgtgtggaaaagggaagaggaattgaccggccattggtgcaggactgcaggctgccagtgcactagttgtctactgctacatccgtctcgtaatataaagaattttttggctatacgacagagttagtacttgcccgctatatgttacactacggttacggttatttgcacgtgtcgttttgttctggcgaaagaaatgaaccgtttaaaaataagaaagttcgcaacaacggtgaccttttcgcgctggttgttattgttgttattattgttgttgccgttattgttatagtcgttattattgtttagcaatgtgcgtgtggactagactatgccgccttcttctgtacgtgatggggagcaggcacgcatgttatgatgttaccatcttcttttgctctcatctgtactgtatacgtgatggagagcaaagcatatgcatgttaggatgttaccatcaacggccacacaaaacgccagtacgttaattgacaggatggccgacaatgccgtcgtgttttcaactgtcgacgttttcaatttttgggccttttacacaatttttaagggtgttttccgatgatcatgttagagcaagtacaatagcaggctataagtcagctataactacatatcgagaagtaaagagaagagagaggaaaaaacgggttatagatttatagataactattgtatgaatgggctattaaattagctatagatgatttggagctaacatttggctatactattaaacttgctcttaggatatgctcatactgcacacaaaacggaatggctcattagtatatgataactaagtattagcttaacaaactttaaaaataaattaatttgttttttaaaaataacttttctatagactttgttatagaaaacactccattaaacagtttggaaaataagggagcagaagtcggaaatggcagtgtcaaaggaagcgaaagttcagcttaggcacagtaagagatgagtgaagatgagctaatgggaggatgctgactagtgtcacctgctgaaacagagatgaaaagaagaaagggagaaagttcaggtgcttggtgaccgatctgatcgctgacaggttgcagaaatgcagagatttgttcttagcccagacccactggaatcagattcgaatacttgatgaacagcttaccagctgtttatgttgtacaatgtgcacattgtggctctgtttggaaacttcatagggaagtcttaaataaattcaacgcaaattgagaactgtaaatcgggctgagttgaatgcaactgtctgtagtgagcttaacaaccaaacaaaatatgtcagcatccacctgttgtacagagatggaaagctgtgattaacagccaactccgtgtcaccgtcaggcatcaggcaagagttgatctagctgtactcaggtgaacaatgtgctatgtaatgacagagtagactgatcatgcaggggatgtcaacagctcctctgccttgcaagcagtagaatatagatatcaggactatttttgaattctggcccttctccaagaagggaaaaatataactgccaaccaagtccagaggttgtcactaccacgcaaggcagattaacagaattacataacatcatttaagaactaagggatattgtcaacactagcacctatttacaatagttcagccaatgcacaattggttctgggaactgggactgaatgacattcagtggatgcatgatgcatcaaagtacaaatcctgaagtcagatacatggaaagctttatcctcaacccagataagccggcaacctgggaagtagaggtgtaactctgtaagaccacatgtgatcctagattttgccaggtaccacaagtgcaaatactataattggtggtaaacgttatgctaacctgatgagtatgtggtcgtgaacaacagattgttctagcatcgataatttttatcatagaatggattttcgccccatgattctctttcagccctggccatgtgttcagattctacctcctccaagatagattgctttgtgcttcttttggaggttgaaggcctcgtagactgcaacaagagtgaataagcataggttaagaaagaggagcaacgtaaagatgagataaaccaacatgcctaacgaaagtaaaaagtatgatatctgtagcaattatacagtgatggaggaacacctaaaaagcattcctggaaaatactaaggaaagcactcagaagaaaggaaaattgacagcctatgttacaccaaataataattgcttgatgttaccaatgatcagattagaatgttgacaagcagcaagcactagaaaatgagaccatacatagaagtacagctgccttgcattgattagaggtaccgtttagaaatatattgctgcataaaagataatatatgcaccatccctgtacatttgttttccttgaggttgatgcaaactttcaaattcaaatcaacatctcatgttatatttattttaaagtcctcgcatagacctcaaacactttggagggatggaataaagcatgaacatccatatactagagttgcatttccctaatagttgtgatgattttagttttgaacaagaataccttgctgatgagtttctcaaatgcttctggtccattctgttcaatatatctctccgcagctgatagcacatcatcaggtttactcaggttttcttttcttggaacataccagacatttactatttgacgattcacaaacattggccgcacaaagtgatcataaacataagcagcaccatggaagcaaggtaagaccaaccagcagttgaagaacaactttgcataggaccaaaaaggaagcctgcaagcaaccgtcagaagtaagcatatctaatcctttgttatcctcttgatgtgtgaacatgtttatctccagcatcaatagtaaaaaaaaaatcacaaatattaccacaaaaaacaaggaaaacactagaccagggccaatcctgttttattggtcttctatattatgaactccctgctgcaagggactcacaggctatgttgctaaatctgaactttttgagggaaatcaaatgctaaacaaaaggaaatgagtaagacaaaaaaaaaatctcctgacccaggaaaatggtcattaccattcaattactggagcaaaagtaagctcaaacaaagtgataaacgagtacagcacccagtaagtgagccattgctgatcatcaacaggagattttgtttctattgctctcacagaggcatatctgcagaagtgcgaaaagtaaatatatatatatataataacagaaataatcaaacaatcaaaatggcaaaatattgaattacaacaaaataatacttacaatggataagcaagtgaaactaatggcctgcaaaggtaaaacaacagaattgcctcagaaccaatagcttcaaatatataattaacaaaaacaatatgttttaagttttttcataataaagaccacctgctctcgaagttttttcataatctctagataatgcatgtcatgatcactgatcacattgcactatagttaaccaagaggcattttttctattactttctcaaaacaacaaattacaatgcacataaagaccccagcttaccatgataataaaaaaaataacagacaatattgtagttcacatgacagcagagcagatagttcaatgaagctgcttttgcagaaaaataggaattcaaatttcatcttgtctgctacccaacatcaactaatatcactgcagaatttcctgccatgggcaagctaatttttggattttcatgagacccagcagtcgacaaacaattagtaaaaatgtttatcttatacttttttcctcaggaacatccatttctattatccccaactgcatggtagcacagcatgtaagccaccagtttgataactaaccaagttgtgcatatcaaaactactgactcagcaatgcatgatagtactactacacaaataagattatttcatgcttccagaggaagcatcactacaaggatatccattccatgttgatattaggacattgactgttatgatactatgctgaactctgctccattagtcacccataaaaaaatggcctttggattgacttcataataaacaatggagcaatagtatacacacaaaaaaaaatcttataaaacctttaccaatagtgaagtttcattcagcatcgtaaataggaactcagatgagagtagctgttggtaaaatttttgtaacaaaaataagcctaccatttctccaaataatcatattctaacttgctaaagttccacaaatcatacgacaagttctaaagattggtcgctttatgcagtgaagttcatttccattccacgaccaccatgcactgcataatcatacgcagatacgaagaatctttccctcgcaactctcacgcctaataccaatttcacatgtaccataacacctactgccatactgtcctacaaacaaattcaaaggaggatcctcaaatgaataacacgccccatattccatttctccgaaatatatttaggcctattttctagcgccagaaagatccctaaatgagtcaaacgcgtcctcgatcctcccacgacgacccaaaaaccgcccaaagattctccccccaactttccccacatcccccctcgttcttctcccaaatccccacacatcatcaaccaagaaccaccaccaaatcgacatcgacgagccacagccaacgaatcggcggcgaacgaaatcaagaagaggaaggaagaagaaaccccgcccgtacccggcgaggacgtcgaagttgttggccagcagcttgaggaaagatccagaccccatcctctccccttccgccgcctcctcgacctctctccctccccgatggatcgaccagctcaagaaatggcagagattcttgggagctgtgggctagtagtggagagccgttgctcgggagactcactcccccctttcctctttactacttttctcctcctttctctccgctgttcatggccatggctggtcggtcaggtcagctactctgccgctggtggtgtcagtgacagtgagattcgctgggccaaccatggaaggttccaggctgcttcttcttcttcgggaccagatttctcggcccatctaagaagtgggctagttgggccttaggcgacgtgaagcgggtggtccaaaggcccaacgatgatgtgctggacctgcaaatgctagcacaacgctcctcggcttccctccgtgtggcggcggcggcggtggcgccgtggcggtggtggcggcgaagcaccggaagccggcgactagcggagacggcgggcgcggacgatcaagcggcggcggcggcgtcggccggagaaccatggcgcaggtagatgagcgctcttgaattttttatctatatgcttgagtatttttttcccttttttcgtgttaaatatcttaggtcggcctgttgaatgtttgaatattgatttctacgagctagatcagatgtcgtcatctcgatcagattgttcatttggttgatggctgcggcactgccttccaaggcagaggttatctgtatctgacaatctgctacaagtctgaatatttatcgagttttcagacgtgaacagtgacaccccttttgaatttcagagaaactacatatcggctgtgtttagatccaaagtggatccaaacttcagtccttttctatcgcatcaacctgtcatatacacacaaattttcagtcacatcatctccaatttcaaccaaaatccaaactttgcgctgaactaaacacagccgataatgcattggcttggctggttgccgtccaaaaagttgatgacgaccaaaataggcaagaataagttcagaattcagaagcctcaggccagccaattcagccgcaaatctcaacgaacgaactaggaaattaaaccaaacaatgtgaagagcgagaagatgaacaagagccgaagattgtatatatgtcataagtttaattaatttggaagtcttagttagtgctatcaacaacgtgaaagagcgagagacgatgatcattactgaaacttgatggactctcagtaaactaatcgaagacagcctctcttctcactagtcacaagctgcgatgattagcatagcaccagtcgcagctgtgcttaggagatttgataagatatctccccctatccgtaccagaagaaaagggcacaagtcatcatgcacactcattagggcatgcagtatttacctatttaaatcctgcacaaactaagtacctttttcccatcagaacagctgatgcatcattaagttgttgtgctagctagtttttcaatcatttgaatgccatatgctcttgctttaacttacaatattcttgcttggcattttattggggaatatgaattatattccgccctgttgttatatacatcaggattaattacttttcaagctttgagatcatgccatgcatctcaatattatttttagatatatataatcatcactaggaacttaatgctagatcattaaaaatagtaatgctctaatgcacctaattcattagcttgtgcatcagtgctgataattaagcaacttgctgagccgattaaggaagctggtttccgtacatatgtgttggtttagtgagctagctgcagactgtttgcagcaatcatgctgttcaaactttgatagtaatattgttgtcgcacccagcaatattatgctgcaagtggcctttcggggacctaatttaagagagattccttctgaatttctgataatttgtacaggtcaaagatgtgcgggtgaacacttcttacaagtcaaagatggtccacccactcacccacaattcaggtacatgtccaaacctaaaataatgtggcactcagcttacaatattgctgccatttgcttgtagactatgtttttcctttttggaggctttggcaacttgtcttcctaattaagttttttaagcaatgtaatggagtatcaactatgctgctgctgctgctgctgctgctgctactattacagactgatggggtatcaaaagctgagaaactgtacatgtgtagattgcttccctcatcttttcctctttaccacccttttccacaaaagtgatatggaattcaaccctttaaaggctttaaaaattggtggccatgcatcaaatcttcaccccaaaaaaagtggaaaccatgcagtgctgctataagtacaccaaggcttgcacatgttaactattaattgtttacaatgctgagagctctttaatttgtcttaatttgtgactttcttgtttctatgggattaattactgtgatagttccttaattatatgtatctacactcaagctgtttggtttgcattaaacatgtgaagacgataggcagtctgcatgtatgatagattgagcactagtagtgggagaaatagctctgcctacctgtgaggctgtgacaactaacagcttttgctttttatcattcctctccatgttaggtcctatacattcacattaactaatcgatcagtattcatggcaattcaggcatggctaccttgtgtttgtctagttagtttactctccctgcatgtggggccggccattgattagacaagtgaactcccccggttaattttgataagaaatgtcctctcatgcatcaattagtcattgctaacaacttaatcaaactgatattattatacgtagtgtagtgagcaaacaattgattgtccagacaagggtgaagagacaaattgcaaatatatattatgaatgcttgttccagaaggatacatggtctatctatgaagtcatccatatatgaatacatatgcctcaacctaattaatctcatcacaaacaaaatgcagagctttcaagttaattaatctcatcacaaacaaaattcagagctattcaagtggttaaccttcttagtgatactgaaattctagtaatacacaaagatgtgacaagactgatgttttttataaatattcacatgtggcatctgctgatccattagaaattaatatggattatcaccataagcgttatagtgaatgtgaaacaatcacaatatagtaactctggaacatatttgtattactagtgttgtagatcagatgtcggaaattgtttccattatccaaaaggagtgctagctcattaaaggctagaatgtggttagggggcttccttaaatttactctaataagtaagaaaggaacatgtaggaggtttatatatctaacacgatggagactcatggaccacacagcaattcctgtggttcacaggaaacaccagaatcacatggcaccgcctgtttaaaagacagaagtgatttcatatgtctttcatcgtgtcctttttctcctatcgatcaattcttgttccaatttaccacccctctccttggtcctgactcacacggtcacaccttctccttaatttaattaattattttagcggcaatacttttcaatccaatattttggaagagtaatattttctgttaactaactggattttgtacggtcttcaggaggtaccaagaaattacgctttgattaatcaacaatatatatctatatccaggtatgtcaaaggattaacactaattagcgctactagttacaagtgattgtgaaaaatctatgtttgaaaagtatgtttatggcatgagtacacatatatagcatatctatttgccactcctcttgggcgcctaaaaatgtgcattggcccctggttcttgcttttggtggacatgtagttaaattgtttggcctcttcccctccatatatatagctactcctagatgtgtacaaggccaagaaaacatgtgaggattcacatagctactactccataaatcagcaaagacatcatggatcgatttgatggccggtaacacgagacacgcaaagaggatatactgacgctgcacacatgaaaagcttaccagttgggctcacggcatcgaccgaccagctttcttacaggtaaaggcaaatctacaattagctactatacgaggaaatatatatcggaaacaaaaacttgggtgcaaacttgaaaatcatcgcatacaagtttttaattttttttaaagagtctcatgtatagctaaggttgtattagacaaccatataaaatgtgcctttgattaatggggattttgaaccacctcatggacttgtgcctagtacgtagtcttatgatacattttaatctatttctatttactagcaatccatatccttgataaagagagagaaaactagaaaaaaataacttatctatagtaaaacagtgggatctttgtagtagaatactcgtttttttttagaaaatgggataaacccggcctctacatccgatcggatgtacacagccaagaatactcgtttttatacgccgacatgccaccacgacatcatagaaactgactatggaaggatccttctagtcttccctaaccattcaaaccaatctaaggttggagatcccgcacatggcacacctatcaggtaggctatcatccttgtgctacgttagattcggaagtcgattagcattgattctcgttcgccctaactccacatccatcctcgccttggtgcctatgagagagctgagctatactataagtctagccattatccacactgacttatggtaagtacaataatttctcacaagagttttcgtgaattgtggtaagtgagatagtatctcaaggccattccctatgagtcttaggtagcccggcgttgcctccccctcaatggatgccataaatcccctttaatgcacaataattcgatttagggttttttgtttataataaaaaaatagtgaatattctaaaaatcatgactaaattcatatgaactccagtaaattctaaaaatgccaaaagtccaactaattataaattggtttcatgtgttgtttcattatattctaacgtttccgaagcgccattgtacttcgagatcatcgcaaaggtccaagtgtagagcaaggcaagttatactattgttcttgactctattctacgtgaattaagcaaatgttttgcttacttgaagtaagcattcattgtttcacaatttcacatgggatgtcaatgacctatatgtagttgtaagctatagttcgaatactatcatttcctcgatgacttgggtaacatgtgactagatgtttgcctaggatggttagatcaactagctcactattgggataattacctctctattttatacctaggaattaattaatggtgacactttgcacatggttcatgaggatgactaatccaactaaaagatgactaaatggtgagttttcggtgcatggttttgttgacgcatctatagcaattaaggactaattcgtcagaaacccttgtaaaatattattgtacttagcacgccagcgtgatcaatggttgggcttataatacagctcgctcctctcccaggcaccaaggtgagggtgggcatgatggagttgcgttggaccagggaacaagtcctgtcaatttctatgttcggcaatataatttatagggtgcacaagatcaaagagagatggtgacacagatttatactggttcaggccctcgagtgaggtaataccctagtgcagttggtgtagattggatctatgtcgagaggtgcggagatcagcaatggagtggctgatggcacgtgtaatggagtgtgtgagtaactcttcagggttcttgccgaagccctttatataacgttagggcttccggcggcatgcatgtcacaatatcccttataatctgggtacgtgcaatctatttacatgggattggataatatttcttatctcttatcccttcctatacatttttttttgtggggacccttcctatacattaaggatagccgcatggacctggctactcggcctgctctatgtgacacggcacaaaggccttccgtgaggtacccgggtatcgtgccctccacaggtgttgatcgacttttaagtccacagtggtgcaagggatatttcatttactttgagtcgttatatgcatgtggtagcttgatagctacttagttaaagcagtttttatccatatcatctcggaacctccggagaattgactgaaacctaaggttccaaacaattgaccggagactttgagaaataatttaatccgctacaaaagtttgtttaaatttcagttttcgcctattcactcctctctaggctttacaagggactttcagcatccacacaataaaaggtagagttgagcctatcggttatatggagaaaacattaaaaaattgaggatgatgtagagaatataaacaaaagacaaggtagaaactaactgcaagtttatatgcaaatatagcatgtctaattccctcctcatatgtgcaccacacattataatcaacatccaacttggtatgatcatccaatcttggttcgcaaacaccagaagagattgtgcatacatgagcgttttataagtttgtacactaaattacatccaactaacaaattcatatgccatcaatgcaatttgctaacaatgagtttaatagcaaaatgctatactttctatgggtaaattgacactcattttgatgtttgtccattgacaatacaggaaactattctaaactctcgagagaatatcctctcattgtttgcatgtcatccaaatgattataattttctttttaaaaaataagcaagataaattaatatgtgataaatcactccacaagcatgcaaggttaaatttaacttcaacatgttgcaatgagaaaaaaaacaaatttgactatgaatatatgttaactagcttttttttttgcagattgtggaagttaaaatttaacttacatgtttatgcagtgatatatcatatattaatcaattttcttaatttttcataactatttgtatgacatgcaaacaataatgggatatcctttggagagtttaaaatccactccattgacgatatattgtaatactagcataatgctcatgctttgctccatgtaaaggaatatatattatgacagtattatagataaaacatattttttatcgaaaatatatcagtatcacttgtttgcttattatttacatatatggtattcacttatttaaaacgagaaccctagccctagcaaaaccgggccgggctgggccgggcttcactgctttacaagagccagcttagtgaacctaataattctgctcctgtcctccttatcctgatcagtcctcggtcggcttttcctctctctctctctctctctcataaaacagagacctttaatgcgtcgtgatctctcccctccaatcccgacaaagtacacacaccatcgtctccccctcctgcctcgatgctagctctcccattcccatctctccactctccctcctatcatatgctcctcccttctccactcttcttctcaaatcctctctcttcctcttcgtcctcctcctcttgcaaccaaaaaacaccataaaatagtaatcccaatccacaagctcacctctctcttgcacacacacacacctgacacaacacttacacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatataccatggcgtgagagtagccatggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacccatcatatattcatgcaaggatcatacagttgcattccatgccatctgcataaaaatatcttattgtgtgctcttaagaatggatcaccaatttcaccatgataaagctcttgcaagttgcaagtggtagggtttggttagaatgctagagaaccttttttttaaaaaaaatgaaaatgagaatgctagagaacctagaatcattaatcaataaatcattgctttggtatattgatcgatcgatgaggattatccaccaactaatcctcatccaatgcatgcatgcaagctagctagcatccattcgatctgccactctaaataatttcttgttggttatctattgcgtacacatttcatacatcttttctctgtcaccgtatatagcttttgcaagacaaaagtttttcattcgaattgtactaccggcatgcatgcatataacctcgacaaagttcctttcatttgaatgcatatgcagtgcacggttctactagctagctagcggttggccgggcggcaaaggttgccaaaaaccaagacaaggtagcacggtagcaatcagggattgcattgggttaatccgagggtaagcatcgacgacgaacttcatcaatcaaatataatttttaaaatagtttaacagtgaagaaaaatagatctactttctacaatccagctactaccagtggcccactcctttacagtcgtgggaacacacgttttcaaatgtgggggcactcttactaatttgcagaatatgcttatatttatagtcacgtgtcaaagttccagtgggcataacactattagtatcataggagttagatagtgattttatgaagaaaaacatagccttaagttaaatagtactacctctactagcggtgacaattagtcaattagtcatccgctggtcagaggatgggttaatccatcgagagctaggaatatccttgacttgtttttaatcacctgtcaaacttgatacaaatagttaaaaaagttcaaaaacaacattgaaatatagacttcagcaaaattcaagtttacacttaatctacctacacatcaagaaaaatttgaacaaatttctgtgtgaatagcagctaggtattgttcatatatatgatgtatttgtttttttccttcctcggtgtgtcatcagtctagtttagacttgatatttttgttgctagcatgcatgtatatcttttccgaaagggcgccaaccctttttttaattttttggggaggggcgcccccatttttctccacttctgtcatgtacaatagagtttgaaccgggggtaaattaatgccccccacgggctttccgtgccacaccaggggtcgcccccaccataaggaaatatggtgtgtttcctccgccgtcacacaatgtaagtcattataattttttctacatttatattgatgccaataaatttagatagatatatatatatgtctagatttattagcatcaatataaatatggaaaatgctagaatgacttacatttgtaaacggaggggagtaccaaatatttcaaaaacatgtggaaattgtccgcgcgtcgtatctttggagtggaggaacgtacgtaggtgggtggggattttgtaatatggagagctagcttaggttatatatccagtacccccgatcgaggcaccaaccaccaacaccaagccatccatccgactatccgtgagcacaccgaggcccccaacgccgactgatccccaccccccaccgcgaggcggcgcgcgtacgtctcaccgatcgagcgaaacgaaacgaaacgctgcctgccacggtgcatgcgcgcccggcggcccgtgcgcccgcgggatggatgggtagatgcgggcggccccgcgcgtacgtacgggacgggaggaagagatcgtacatcgcgcgagcgagcgcgaccggcccacgcgcgcctactggcgctggctggctgcaaaccgatctcgcgatcgatagcgcgcggggagatggagcgggaagcgcgtggtccacgcctttctccgccagcgcgcaagcgcaaacggagcccctgtgcccgcccgcctgcaggtgcaggggggcactgtcgcgccggtctcccccgcggctagctagcttcatcaatacaatcgcccgcctgcgcggacgtacactgcaggtggagggccggagcatgtaccccgcatcgcatcgcgcatgcatgctatgctatgctccaccaaagggtacgttacgtatatatatcagccgggcgagacacgtacgtttgcatatattttgcggacaattattacccctttggatcgatggaatttaattagtactgttttcatctcagaataaattaatatatttatagaagattggagatagattagcaacacacacacaaatgatcacaatgaacctatttaataaccacactgcattttctataatatatatacgtaaacttcttttattaggcgatgggaacggaaagatggtgggtaggagggagtatatcttcatctaattaatttgttgggttccacactttattaaaaaaataacttttttttataaattcgaatggtagaattcaattattccgggatggagctagtagggaatatgaaggaattgaatctgttggtaaaaaaaattctttgagaggcttttggatggtagggttccctcatagaaaattttgagaaactattactatatacatatatacgactcaaaccgtccaactggatttgatcaatggttgcagtgtatataaacatatgtttctttgttatttgcatatccctaattgtacatgagttatacaactaggttgtacatatagcagtactcgaaattttatatgttaggaaaaattctttcacattttgtataaattcttctagcaaattaattgctttgaaagtttcaatatacctatctctcccttctctctctctgataaatgaacacataatcttatattttctccacttttcgatcgtacgaggcatccaaataactattttgtgtaatacttgcggttttgtttcctgctacaagaaacaagttataacattttaatcatatatctttttatactaattcctgtattttaaggaacccggtttcttcgactagtgtggttggcactagcttgaccagctaattgaattggtgacacgtttgtgcatggatgcggtcattgatgaacatgaagacgatcgatcgagagactacgcgtcgttgcctcgttggggttggccacataatgagctacaatgtggtgactgcacaagtgcacagtttatgtgcgtgcaggtgggagggaggaaagaggggagagaggtgagaggatgaggccaataacgtgcgtgctggagctgtcggttgttctctgcgccaaattggagccgtcacatgtccggctgattggccgcattgagtggccttgcctagctagtggccgcagcacgtagcagcagcagctgctgcagcgccctaaacacaccagtgaagcacatgtgtcgtgcctcgccttgtctccctaatactgccactcgtttcgagctagcagcttagagctaacacatctctggaaaagtattagttcaaaaaaaaactctagaaaagtgattatgatcccatcaattaaccaagagttggttataaatcaaaacgggtggacggtgatggcaacacacccagggacatctaggaaaggagtccacactactaccctaatgttcctacttcctagtgacatgggagatctagaaaaaaaaacaaagggtatttcagctcaacgaactctcaatgctatccctctctgtgaagataaaagaagaggctagcccagatcatcccttagagcatctctagcagggacactaaatatagcccctaaacagattttgggtgttgaggctaaaaaactcaatccagcagagcccctatcaaggatcctaaattaggtaggcacccaaataacctttcctagcccctagtctcaggggctctactgcacagcccccatccacggttggaaaagcgcgggagccgcccgacgtggtcttggtccaccggcacctcccctgcccagtgctcatccccggccggtgcggctcctccctgcctaccatgtcatccctcaggtgcattcctctacccaacgctccttcccggccgacgcgtctgctgtacctggagtctcctctagcctgcaccctctacctgaactcgatgaaaaacatggcccagtggccgagtcatgcgatggcgtcgaggcactggatgattcaagtgttgttgcaggctgcgaaattgagaaagtagtagcagggtagcactagcagctgcgattgtgggacttagaagaatggggaaagtgatacatgcgatgtgctatgcagcttttttgttgctttgcttggttgttgcttcgtgagagaagtagctggtctattggtggatgagaagacgggaaaaatcaacacatgtgagaaaatgcatggaagcgccacagcagcagaagctcgtttcacccgagctatgaatacatgctactaggatttgtatttccattttattttttttaaaagaatcgaatttgaattgtaaatttaaatatggttggattattatggttttatactaggagtagcgtagagtatagaactatagatttgtactttaaagtatatgttaaaatagaagatgaaatgaaataaggggcgagaaaagggactgctgctggagttaaaggtattttttaggtacttagaaaatggggaaagcccccattaaatttttaggggctataaaataggagctattgctggagatgctcttagtcttctccatgtgaatttacaattctttactttcgtacggttccttttcttccgctatgtttaatatgaaatatgcacattcgggtgccgatttgttaaaaataaataaatcaatacggtgtgtttacgatataaaataatttgtgagtaaaatatttacatatatactcttacccacctaacagtccaaattaattttataattaaattttaaaatttaaattttgactgcggttgatttctttaaggtaaacgacgagtcacatagcttagacgagatgagtgcactgtttgacgcaaattaatgcgcatgcaatcgtacacccgtacgagagggagagcatgtcatgtgatttcgagaggcctaggaacatgttggttcatcagtcatgccggggcgcatgcagaattagtactgctcggtaatttgtgcgactttatggtaatttagagagcagcagtactgcagtagtagtacgacattactacacttatttaatcgtctgactaattaaactagtgtcagtttattcagtatcagtatgatactaatgatagtatctgatctcaaggtcggcattactatgttgggagcatactccctccgtactcgtaaagaaaatcgtttagaacagcgacacggtctccaaaacacaactttgacttcttgtttctataaaaatatttattaaaaagtgatatatgtatacttttatgaaagtatttttcaagacaaatctattcatatattttttacattttcaaactcaataacttgagagttattcatgatttatatttccaaggtttgacttaaacattgtcctaaatgactttctttacgagtacagagggagtatatactttctccatcccatatactatatctatatatcctaaaaaagttatttctaacatgacagtttgtttcaaaataaaactatttctccatagcctctcctttcacccaactataaccattatttacttaatttcttcatctactttttttcttaacgaatcacaatgtttattcattattttaacttctttttaatatccgtgtttatctttaaaaaaaatacgtatattttaaaacagagttgtatatatatttttggagttcttcctaggacgtaagcatttctaaagtttgtcatggtacatgactaacgaggagagatgtgaagttaaattaagatcaatattgtagttagttaaaataggagatacagggagaaataaatgaaaaatgattgtgatcgattaaaatgagaaattaagttgatgaatatattacatagtactatatatttttttgataaaatttaaacgctagccgtagctatattttggaacgggcgagagtatttcactcactctgaatttgacctcctcatgttgcactaggtggcttttgtcaggactagctgtggcgcgcattcctcttttgaaaagataggcagggtcgacgcaggcaggcaggcgcatgtgtgcgtctctaccgaggtgacaacaaaatcacagggaaaattctcccctttcatagggatcaatgagcttaagcacacagctctcatgccgttgctgcgtccagtccttttcctctcctctgcatcatttcctttctctctgtctgcgtgagtgtgtgtgtgtgtgagagagagaggggaatctgcagagaggccacggttgggtttgcaaaacgcagacacggctgcttgctccctgatctctactgcatgcagtagctagcactgcactgcatgctggaggaacaggatgggagtaggaggagctagctagccgaggaggagggagagagaggagggcacagctttccctctactcccgtcgcttttgtggccagctgatcgatgagctgagctgagctgagcttaagccgggaagaagaacagctttatgtgcgtggtgaaatacggagcattcacacacacacacagtgtacatgtgcatgtcagtgtgagatactgagggcatgtttagatcagtttgttgtggaaaaattattttggtaaaagttttggtggtaaaagatttggtattgaagtttttctagttggtgtttagatgcatggtaaagttttatcattttactagtaaagagagatagcacggctcccaacatattttttggtaaaatttactactctagacacccaaataacaaatgttaaattgctaaattttctactagtgtttagatccattttaacaaaaagtactccaaaacagtaaaacttttgccattttagaggaactaaacaagacctaagggttgtgtgtattgtgttattgcgtggtggcagtagtacaacttctactcttacctcccctttccagtgcgtgagagagagtagagatggatactaccccacccattcatattataagttgttttgttttttctaattagaatttctaaagtttgattaagcttatagaaaaatatataatcatttttaacataaaacaaacatattatccaaatatattaaatattagttttaacaaaactaatttgatattataaatattgctaatttttatatatatatatagactaattaaaataacttataatgtaaaaaattataacggaggtggtactacactagtactcctatgttgcttgctcctgagctagctttcgacttgtcggccgctctgatcgatgctgccctttatccctctcctttctgcctcgatccgggccatcgcatgatttgcgtttgatgcaccggtgatgaccgtccaacagcaaattctggcgggcatgcatcacaccaatcgtccatggatcacttcccccctcttgcatgtcttgactgctgttcgccggtcacaagagctcccatgctggccctgttttagggaactttaaatagctacagttacttcgagaatctctaactccgtaaacaatctaagaacctgtttggtacagcttcaactcctgaatttagctccatgagttgagtctggagtggagt

SEQ ID NO: 69499 - DNA, 1062 bp, Oryza sativa
tccaccaacgaggtggacgacgccgccgccggcaagggcggcggctccacccgccggaccttcagccaggcctacaagatgaagcaccggacgccactggtaaatacgcagtccatttccgctgatttcatgcgccattcttggtgttcttctcctccttttgtcgatcgattcgatctgcggtttgtggttgatgtgatcgatcgatctgtggattgggatttggggaaaaaattgcaggagttcacgtggaggcaggtggcgttgctgagcttccagtcgctgggggtggtgtacggagacctggggacgtcgccgctgtacgtgttctcgtcgatctcgctggacgaccccggcgaggcggacttcgtcggaatcctcagcatcatcctctggaccttcaccatgatctgcctcgtcaagtacgtcttcatcgtcctcaaagctgacgaccatggagaaggtatatatctgcactatacactccgtactcgtaaaggaagttgttttggactgtgacacggtctccaaaacacaactttgacttcttttttctataaaaatatttattgaaaagtgatatatgtatacctttatgaaagtatttttcaagacaaatctactcatataatttttacattttcaaactcaacgacttgagtgttattcatgatttatattaccaaggtttgacttaaacattgccctaaacgattttctttatgagtatggtgggagtatatcactatatatagatatataattcggatctatttgccaatcacttcttttttactactagatcaacgctcaacaattcgcgtgtcaatccttttattgtcatggaataaccttttgttggaagaaaactgtattttggtgtaccttgataagtatagaagtgcatccgtcccaaaatacagaaatctaggattgaatgagacatatcccagaactatcaatctaaacatacatatgtctatattaataatcataagatatgtctcatctggttctagatttttatattttgggacgaaaagagtagtagatgaaaaacaa

SEQ ID NO: 69500 - DNA, 506 bp, Oryza sativa
ttacattggctatagaggatttggagctagtagtgggttaaactattggacttgctccaaggttgtgttctttccttcaagttgccaacctttctcctcgtttttggcgcgcacgtttctcaagctgctaaacggtgatttttttgcaaaaagtttctatacgaaagttgcttaaaaaaatcaaattaatccattttttttaaaaaaaatagctaatatttaattaatcatgcaataatgcgtgctccgttttacatgccggaggaggggttcagcttaagtatagttacggaaaacgagtatcgaccactagctgctttcgtttacattctgaaagagagtgaagactggttacgccccacgtggatgattccattccagtcgcgctcgcgccagacggtcgatgcgcgcaaagtcagggtcagctcttcaatttgagtaccaactatagataattaaatactccttatatctgaagtattattgtatcctcaaatctgagctca

SEQ ID NO: 69501 - DNA, 1734 bp, Oryza sativa
atgcaacacgaagttggaaccagcagaacgtttatgaagaagagatgtagttgtgtgctacgtttggttgttatttataggggatggcaagaagctgcgcaatctcaattattagaaagagacgacggcgcgtcggactgctagcttcagactaatcaattcaatagcgtcggactgtttcactcgtgaagttaataattacaaagcaacagcatcactttcggcggcacatgctgcataactgtttgctttattaattacaaagcgacgaagtcactttcggcgcagcgcaacggaatcttcaaagtttaattgtgaatgattttattctctgtggcatgtcccgtgattggaaagagaggatgccattttaggtgcgtatcattgcatctctgtgaaaagaaattactgggtaatttaagtcataagtgggtaatttaagtcatattagtaaaaagtaaaagtaatatgcaattttaaccgcacgagtaacatcgaaactgcactattaatttagtttgtgagactattattttttgttagctctcgtacgaaaaattattagttaaccaaaaatcatatgtgttaactggatacaaaatagggcataaaaatatgagatatttatgaactacgaaacatcgtacataacatgaagaataagcagtacaaaaaaataatgttcattgctagtaatagaaagccaaaatcacagcaaggttcagataggtttgccaggtgaactgaaagacgtaatgttcacttctactcgtcatcatcatcatggtcagtcgtagtcctagatgttccagctcgcttttttgtagttttttttcttgctcgtgcggcatgtcgagggcctgagagtcacagacggtttggctcatggagctcacggttagatctacgcgggtcattgtcgtttccttcgccaacctcttgttgtgtgggctgtgtcacatggggcgcatcatcaatttgtgaagtccgaagctcgttgggtaccgatgacgaccctcccccgaagctggacatgtcgccttatgatgcagtgtaaggcctaaaccctgacattagtttagggcgaaatgaccctacagaagcaatgtagatatcaatgaaattatcaaagctgtagcacgcaacaataacacaaaaaaaatccaaacctgttgacagtgcttgcatatatggaatttcattaggatgcgaggaatattgaccaaatagccaatcaccttgttgcaagaagtccatataaccctgtactccaccaccaaacgacgtgccttgcatccatataaaatgtcacggagttattgtcttaagttgaagtgggagtcatgtatggcatgaaagtgccatcgatatatgtgtatggagaatgatggctgagcgtaccaccgtaatccatggattgtccttgccatgggttggtgccatatgtaggtgcatgcagtggaaccgactgagtaggccctgttaatatcaggaagtaaattgtcaataagattcatatacatgcaaaattaataaattgaaataataaaaatatgaaattagatgtaagtggagactgaccgcctaacgacgtaaaccctccttaactgataaaatctgcagacaattggggtatggtagggataccttggctagtccctgtatatgcaattaattagcaaaaagtaaaattacgagtggacatatgcatgccaatatggtactgaatgtaca

SEQ ID NO: 69502 - DNA, 695 bp, Oryza sativa
taacgtcacagataaaaaacgcaaacgcacggaagatgtagcacttcacccgagagtattgcaaggtattgatttccacagggaacgtgtgtgtcagctcttcttcaggttcatccaaggacacgaagctaaggtattttaaggtagagaggatttactagcgagagacaatgtctacggaaagcccaatttaatcctaacgcggtacttcgggcgctggccagctcgctgctctagatatggctctacaacgtacccggacagggaggatttcaatgtacttaaggactgtcaccacctctacacccacctcaaacctactatgagatacgaagcaaacaacggaaattaactgtagcgcccgttccgtcgtggcgcctaacgggaaaattatctcttaaaaaccctaattgcgaaatttgtttctttgattgttgtctagtgtccgtgccatctcaagatctcaatccccgatctatcgtcgagttcaattccgaatccaattccttccaaatcgaatccctccgcaaaagtctagtttgcctcccccgagttcgatgggccgaattccgctcggcccatctcttccccggccctctctctcccgggctctctctctctctctctctctctctccccctctcccccggccctctccccttcccggcgcgctccgctctccctccccccccgct

SEQ ID NO: 69503 - DNA, 3119 bp, Oryza sativa
cggttggcaggacttctacaaagtaaaaaaaaaactccaatgataatcatatttgatttttaaaatctcaatgacaataaggagaggcagcgggcgggtcgtacaggagtatagttgcagagccgccaacggttggtgagacttctagaaaataaaaaatgaattacaacgatagttatgttcgatttttataatcccaatgacaataaagagtaggcggcggacgagtcgtagagaagtacagtggcattgtttgacgtgacttctaaaaattataaaaaaatgaaacccaacaagacaataaattctaaaaactacaaggtccaatttttaaaggttcggaacttctaaaaattaaagaaaaaaacccaatgatgatcatgtttgattttaaaatctcaatgataataaagaaaggagacagtgagcgagctataaaggagtacaatggcaaagcctctgatagtttggcgggacttatagaaagtaaaaaatgaactcgaacaataattatgttcgatttgtaaaatcccaatgacaataaagagaaaagacagtggacgagccgtagaggagtataatgacagcgtttgacaggacttccagaaattataaaaacgtaacccaacgaaataataaactcaaaaaactataatatccaatttttaaaggtttcaaggagaatgaatagaaatagtggtaaaccgagcaagcaaataaagaagaatatgacagaagtaaggggtagcagctggtgtgacttttaacaactacataattagaaatacggggatgatacggggatagctatttaataaattttaagtaaaatcatactaaaaagtatatgattttgtttgggtgctaaccgcaattgcgcgggccacccagctagttatattattaaaatagctttgaaaggaggcaccacgttcgctgtgagggctagaaattcccacattaatcggagaaaaaagaaaaaaagaaaaggagagttcaagtaggaatacaatctaaaaatagctgaaattcataaagaagtttccatataagaacccaatacgagattaatcaaaattcgaaataaaaataaaataaaatccaaaattagaaaaagagagagagagagagagttcaagtagaaatacaatttaagaatagctaaaattcggaattaaaaacaaacaatattgaaagaagtttccatataaaaatccaatacgatattaatcaaaattcgaaataaaaataaaataaaatccaaaattacaaaagaaaatgatagtccaagtaggaatacagtgtaaaaatagctaaaattcagaattaaaaataagaaatattgagagaagagtccatataagatcccaataagagattaattaaaattggaaataaaaataaaaatctgaaattaaaaaaaataaagaagagttcaagtagaaatacaatttaaaattagctaaaatataattaaaaataagcaatattgaaagaagaatccatataagaacccaatacgagattaattaaaattcagaataaaaaataaaataatatccaaatttagaaaaattaaaagagagttcaagtatgaatacaattttgaaagaactgaaattcaaaaataaaaaataaaaatattaaaagaacacaatatgatattaattaaaatttaaaaaataaattatgaaattagaaaaataaaaataaaatttcaattaggaatacaatttataaataactaaaatttatgataaaaataaagactattgaaagaaaagaccatctaaaacacatgacgagataaattaagtaacagacctataaaggagtagagtggtggcggttgatacgacatataaaaactgttaataaaacaccaaataaaatcctaatgacgattaaaaggagagacgacaggcaggccgtgaagcaaacgagcaaggcgcttcccgggacttctaaaaagtaaaaaaaaaacccattgataatcatattcgatttttgaaatctcaatgacaataaaaaggagaagcggcgggcggggtgtataggagagccgccaatggttggcgggacttctagaaaataaaaaatgaattccaacaatagttatgttcgatttttagaatcccaattacaataaagagtaggcggcggatgggccgtagaggagtatagtgacatcgtttaacgggacttctaaaaattataaaataataaaaccaacaagacaataaactctaaaaactacaaggtctaatttttaaatcacaatgacaataaagagtaggcggcggactggctgtagaggggcatagtggcatcgtttgatgagacttctaaaaattataaaaaatgaaactacaagtccaatttttaaaggttcgaaacttctaaaaactaaaaaaataatgataattatgttcgattttaaaatctcaatgacaataaagaagagaggcagcgggtgagccgtagaggagtacaatggcaaagccaatgacggtttggcgggacttctagaaattaaaaatgaacacaaacgataattatgttcaactttttaaatctcaatgacaataaagcgaagagacagtggacgggccgtagaggagtataatggcaacgtttgacggaacatctagaaattataaaaataaaacccaatgtgacaataaactctaaaaattataaaatccaatttttaaaggttccaagaagaatgaaaagaaatagtggtagatcgagtaagcaaataaagaaggagatggcataaggggtaacaactggtgtgacttttaaaaactatataattagaaacacgaggatgataaggtttggtctttaaaagtcttaagacaatcagataactatttaataaattttaagtaaaatcatataaaaaaatatatgattttgtataggtgctagccgcgcaattgcgcgggccactcaactagttatagatgattacagaactgagatgttgcaagaggattatgatactccatcctgatccatcaaggcaacagcttctcagggtgatacacaatacacaatagtagtgtcaacaaatgcttgttcagcacaaacaaaaaaaggagaaagaaatg

SEQ ID NO: 69504 - DNA, 4741 bp, Oryza sativa
tgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccacaccacttcactgtagccaggcccactctccagatcgcgtaccaggacctctcctggactgcgcttcgtcgcctggcccacgactacagccaccgtctcggaggctcctccttccggcagcttccacgccttccttctggccactcagacgccaggtacccttgtccatacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctgcccgcactcccagtggcccgcgctcccccaactcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccactgtgttccgtttccactacccagctcccctaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgcccccgccgtgcagctcgtgcaccagcccgctttggttttgaggatggtagagttgagccagaagaaaatcatggatcagctaatgagcagtctcaccacagcaaccattcgcatcgtactgtttcccgcaatgcagaggttgagcaaccccgccacagcagccgctcgcatcgcacagtttcccgtgatgcagagatgggacagtctcaccgctctcaccgcactgccagtcacaattctggagaagaacgcctcccttccccacctcatgtggaaaccaacatgcaacacttaatggcagttcagacacaaatcttgcaaggactaaacacagccatagccagttttcagcataatgcgcatggaaatggccaccctcacatgggcaacaacagatccaagctgacagactttctgaggtctcgtccgccagagttctctcagaccgtcgagcccgtcgaggctgacgattggttgaaagatgttgatagaaaactcaacttagtgcagtgtactcctgttgagaagacgctctacgcctctcaccaacaaagaggacctgccgcagattggtgggagaattactgcaatgcacaccctgaacccactaacattgcttgggatgagttcgctacggctttccgtgcagctcatgtgcctgaaagcactattgacatgaagaaagaagaattcaacagacttaagcaaggcaacagcagtatcaatgagtacctaagtcagttcaacaagttggctcggtacgcccctgaggaagtggacacagacaagaagaagatcaggaaattcttgaaaggaatcgcagttggaatgagactccagttgcttgctcatgacttccccacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgtcctcagataaaccgtccggcacctcagccacagcagcgtgcccctagtggcaatactgcgcctaacagtgttacctctttcaagtcaccgcagggaccgtcagcagttcagtgtttccggtgcaaccagatgggtcacctgcgtccaccgcggaccgcgcgcatgcaccgcgtcccttccccgcccgcgcgcgtgcgtcgcgtgctccctccgcacggtgagctgagccgctgacaagcgggtcccacccgggaccgcgcgtggtgagcccggtccaccggctctctctctcctccctcccccgcgcgcgcgagtttgggccgccttgggccagccggcccatttagctcggccggaccgctccatttctcttgggccgcgccttagccgtccgagaaaagtctatattccctccctcccttcttttctttttcttttccaaaaaggatttaattaaatccttttcctttagatcaaaaattcaataatcttagaaattcaatatcttcccaaccgtgaatccgtttgactccgttcaacttccaaaattccccaaatcttgagatctatctaatggcacgcttagaggtctttaatagggctttattttcgccgtttgttgagttgtcccgtttcgcgtgtagtttcagagcccgaagacccgcagtgcgaggatttcgaggatcaagctccagatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggctgtttgaaatgttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatccccccccagttgctgaagaagatgaagtggatcctgctgacgaggagttcttctaggagcaagtcggctacgatgagttatagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcggaactagttcggggcgtgacaagagatggtatcagagcacaggcttggccctagggcgaaacccgacacttaggacaaccctaaggataccaagttcaaaactacttgcgaaaaggtaaggtttgttttgtcttctttattttcaatagtttgtttctaaaatggttactgatctttctccctctttcaaaattgtagatggc

SEQ ID NO: 69505 - DNA, 3320 bp, Oryza sativa
tagtttctaacataacaactgttgctagagtaccagaacgtatccattcacgcgcatgaacagtgtgcacaggtagtgtatcatgcatgtggcagatggcctacttaacattatcaactggtcttaataattataatccatggacgacctgataccaagtcaaactcccctatgccaaaaaccgcttcctcttgaatattatatgctgctgtgcttgtgcttcacaactcattacgaactcatggtagggaggtatgcgtgatctccatactaggacctcaaattttccatgagctttagaagttccagtatggacttcatgtagcattaccttaggatcatcatccctgagacatgttttatagccattgactagaatgaattttggatccctaaaattttcaacaagatatataccgtgatttttttgaacaagagtgtatggatgttcaccaaatagaatgacatgtttttcaacgatgtttctgtgacatctaaggaacaaatgccaaaactgggtgcaaaaattagctctgaataatgaagcaacgaaattagcagctacaaaacatctgtactctgctgccatttccatagctgctgattctagaaatgggtgctccacagggtttgtgcttccaaaggcaagcaccttgaagaagtaccaatgggcctcctgaggcaacaaacttagctcaagaggttgagttgttccaacattcctgaacctttcagatctacttgtaataataattttactcccatgtggtatgcagcttcttgaagagtacaatcttctccagttttcctcatctacatcgccatcatcaataaattcgatgatgataagtgaccgttcatgtgcaacacaactttgatgcttgactatgccactatctctgagatcagcaaagcttttgcttccgatatcacttccactacagaaaacaatagaagagaaaaaactgcgtaccctctcatcatagcaaatatgctcaacaagagtacttttcccaactcttgctggacctattattggaagaactcccaaactttctgccccaagagattctcgcaacaagaaattggtaatcctctctatttctgcttggcgaccaaacatgcatttttccaaaattaaatgttggctataaggttggcggtgtatgtgaggatatcccttcaagaaaacaagaaactctttcatatcgtcagtgatactcagtaggctacaaagcatctctcccacctccttcctatcctcaccttgaaaagccatggtgaacgtcctagtggagaaacacaaccgcttggtaggtctgagtttgggaaaggaaaatgagtgatcaccaacctcatcattgaccatctcatgctgaagcactccattcttgatagtatcaaccaagtagtatcccttgtacatgccttctcttagcatctgaagctgctggagcatcgctcgatttgtgatgtgccgcccctcgacctccaggacagttgcctcgatccgcagcagcaagtggcgcaggcattgcagatccacccccatgcccatcttctgctggtagtatttgtcaactaagaaggatatggatctactcacaagatcaccaagaactgcagacaggagcacctccattctgaagctcccacagtggaagagggacggtttcttgctgggggtactaaattaattcagggatcaggacacagctgatctctggctggatgagtttaaacactcgcgtgcaacatttcaacggacaatgtggttttttttttttgaactaatcaatgtggtttattcaaccccgtgtgtttgactatagaaattttgggtgcagcctaaagagaattctaaaccatcgtgaccgtggataggctatttaatttacgatacgagttgtcaactaagatgtgcatagtctacaattaccgcaagcttacgacatcgttcgaccacatttgcgttccccgacctcattgtgtccatcttgacttgttaaggaaactggaggattcgcaaaactcaaatcgaatcaggaggagttcgttgcttacccgcaggctagagagtacggacgcggccgcgcggcgccgcggagcagtgtgccgcacccaaggcccgcgcgcacgccaccgcggtgggagcggcggccgtacggcggggtgtgatgtccagggcgccgcacgagaagcccacgcgagaggtccgcgtccgcccgcccgcccgcggcagcatccgcgaccgccacgcggccgagcatcgccgccgcgtcggctccgcgcggaagcctttggtcgcgaagtggggatacggggaagagaaagacctgagaaagcgagcaaacgttgcacgggacgggggttattagcgaaagaaaaccgttcgttggtgggggattgggagggaatgcactgccttttttcacgcacacatttcccaaactattaaatggtatatttgttaaaaaaatctataaaaaagttgatctaaaaaacatattaatttatttttaaaatttaaaatagttaatactcaattaattatgtgctaatagctcatctatctcgttttgtgtatcttctcaatcttctttttttctctcctctcaaacacttaggctgcgttcggcagctgaagaaagtgagtgagtttgtttcgattttcgcgcgcacgcttcttaaactactaaacggtgtattttttgtaaaaattttctataggaaagttgctttgaaaattcatattaatctatttttcaaatttaaaatagttaatactcaattaatcatacgctaatggctcacctcgttacgtatcttcccaattttctcaatttcctcctcctcaaactcaccttagggtagatgagttactgaacttaattagatcatgattacagaactagatatgctccaagaggatgatgatcctgatccatcaaggtagcagctttgtcagggagaaacacgaatacacaataactagtgatactgaactgctgtagtttaactattgtagctcagatctatctattatattagtaaaacagctttgaaaggagacaccacgttcgctgtgggggctagaaattcccacattaatcggagaaaaggaaaagaagagtccaggtagaaatacaattttaaaatagctgaaattcggaattaaaaataaggaatattgaaagatgggtctatataagaacccaatacgagattaatcaaattcggaataaaaccaaaataaaatccgaaattagaaaagaaaaggagagtccaagtaggaatacaatttaaaaataactgaaatt

SEQ ID NO: 69506 - DNA, 842 bp, Oryza sativa
aacgccgccgccagccttctcatcgtcagccgtcggccgccgctagcaagcttctccccgcaaggccgcccgcacgcctctccccgcagcctctcacactgggttgagatgggaaaagaggggatataggtggaagaaactgggttactaatatgtgaggtttatgtgggttgcatgctgactcggccaccatgttagctaaaactaggagcagtactacttgggaccacccggttttgtaagattattgcagggattaatttcaaactgtgcgacaaaatgatagaccaacaaaaaacttattccttattaaattgagcgggctccatgcacaccggaatctcatagcagcctgttcaggcccatttcgcatgcaggtgagattccaagtttcggcccattaacacgttggtgcggatttgctatggaataagtccacttgcagtccctcaattttgcgtcaagtttgtttgacatcctatatctccaatacagaaatcttcacccgtaaactatacaaaaccgtgtaatttgggtcccataacagtaagatgtccagtttcactgacattgcatcctagttagcaaaaagaaaataaaaaatgtggggccacgtgtaagtgagcaaaaatgtggggcttgcgcgctctctctttctcccctgctacctgcttccttcccaaacggcgtggcatggcctcggattggccggcggtggccatgtggatgctgacgctcgggaggcgtagcgcggaacctaagcaggtgctcatctatgttgtcgaggatatggaagaagtttgcatggatgctgtcgccgtcagcgtcgtcgtccccgcccc

SEQ ID NO: 69507 - DNA, 18915 bp, Oryza sativa
gtggaactagacatctatactaccatgggacctaaattatatagtttttacaatttagggctgaagatttctactattagagataatggatgttaaacaaaactcaacataaagttcaaggacggcaactggatttattccttttgatattcccgttgctgcccaagctatagactactccatatctttatcatatcttatctcatcttataaaccaatttcagggatggaaatgtggtatatgattgggccacatggctcattgagaatttagggttagctcctccaaatatcagcaacgtgcccatgcaatctctgattccattagagtgtcagtcatgcattgttccttgcaatcgccattgaactttcagataaatctatgagtaaaaccatcgactaaaagaaaatacgaagcagtaaatatagaaaaacaccagtatgcgtagtagattatagaggtttctgaaaaattcttcttccttcgtcatcaaaatcaaggaaaaaaaattaagcaagagattccagaggttgaaaaagaacattggatctgtccctttgctactaaagaaattccttctctcaatcatgaacaaaaaacaataaaggtcaaagtggaaaaatagaaaaaaagccataattaagttacttcgcctacaaaggcacctagcacaatcgccatcttccgcttcctgttggttgttacccccatagccatgtcgacgagccacgtgacattttgagtaccgccggcatcttccaaattatttttatatatgcaattttgtaaaataaaatggcagttgaataaggtgaaaagtattaggccaagtttggttgtttgccaactttatgcccaggtgggcaaactaggttgttgctaacgtcgcccatgttgctttaccgagctgtttaggctgagttcgttcgaaactaatatctcgcgcacattaaaaaaaatagaaaaatagagtaaattattagcgcatgattaattaagtattagttattttttaaaaataaattaatagaattttctaaagcaacttccgtaaaaaaaaataaattgcaaaaagtacatcgtttagcaatttgaaaaatgtgagtgtggaaaccaaagaaagtgagttgggaaagtgaacaaatgaactcaacattaggctccgttttatacagagtctaggatgaagattaaagtgtgcatgtaaaacgagacaagcaattagcttatgattaatgaatttgaattattaaaaacttgatatatatagatttatttgatatttttaaaacaacttttatatggaacgatttcgcacaaaacacaatatttagccgtttgaaaagcgtgctaacaaaaaataaggtaaaatctatatcttaattaattgtttagtttttgacgggcaatttgtgcaaaggaaagcttgttgttaaaggagatccgggatctctactgcgatcgagcttgttctcacccggttgagctagcttgcccccagaagttacaattactttacggtttcaaacggtgggcctcgccaagccaggcctcaagctcaacctgggcgttcggtttaaaccgacaattcggttcggtttattcggttgctataaaattcggtttacaggcttcaccacccgatcggttctccaaaaaactgaaaaccgcaaaattcggtttcggttttttaattttggttttcggttttagccgaattaaccaaaagttactaccaccagccacaacaatacagaattacataaaaatgaacacaagcaacagcatatatgatattatagatatatcaaatccttaagcaagcaataaccagcagcacagctgcatagaattacacaaagtagtcacacagtacacaaatcaacatgtctcaagagtacagttacatagattcaagagttcttcattattcaaatagagaaatataaagtcccaggtagcaccgtagcaggcacccaacaggcaacaacagcattgcatacaccaaaccaagtgtccaagactccaaatgatcactgatcaggactgaattactgagttgcagctggagtatcttccttggaaatagataggtcaccaagttctaaaataatagatgatctcagttagaacagtcaatagtgtatgaatcatgaagcacattagaatttggaaggaaataaaaattttctatgttaccttcctcaagcaaagccatttgttcgctgtcctcttcaacactaacatagtttcctccacgaagccaatcattagcacaaacaagacgctcaaccattcttggggttagtgaggtcctaaagtcatctagagttcgcccaccagcactgaaggctgattcagaggcaactgaggtgataggaattgccaaaagatcacaggccaaatgagataatattgggaatcttgttgaattggccttccaccactttagaatgtcaaattttggtgtgtccggctcattatcttctgatagatacttgtctacctcagatttgatagttccacttccaccctcactgttaagttgctgagtaattactgacatccacctacaactcactcttttgctggtttcagctgtagattcagattcagtaggttgtggtgccttatcttttggggtatacatttccttgtactcttcaaacaaagcacgaaaataggtattcactgtttcccatactttttctcctactgtatccccaaacatcaccttaattcccattctaatgcaatttgatagtttgtatctaggatcaatagcaacacagaagaagacagtgaagttgagtagttgatcccccttatctttctctcctctcttctctctgtccccttgcctctcaccatacttctctccccaatacttgtagtacttcattagcattcttgtacccatttccttgctcaacttgtcttcactatgagaccattctctcaacagaagtaatacatcagcaatctcatggaaataagtgtgagatgttgtacgactttgtacagaaacacggagagtgaggtcataaaagtgttcaagaaaatcagccatcttcctagccttctcccaatctgctcttgttggtacccctggaccattctctccttctaattctaatttgtagtatgggtcttcatcactatatctttcaaatgctttttggtacttctctgcagcatttaacataagataggttgagttccatctagtgcaaatatctaagtttagaaatgctttgctctgtaccttggctaactcagcacatttcttaaattttaccaacctagatgttccacatctgataaacttaacagcagcacggacacgttgaattgatgtaccaatttccttcaagccatcacctactattaggttgataatatgagcagcacagcgcatatgaatgtactctccttcagcaacacaaccttttgactcattcaagacccttctcatatacttaattgcattattgtttgcactagcattgtctactgttattgtaaaaaccttgtcaatgccccactcagccaagcagttctctaatgattttccaatgtcctcccctctatgtcccttaaccaaaaaaaaaccaataattttcttctgtaggttccactcattgtcaatgaaatgggctgtaacacacatgaagttttggctgttcttagcagtccatgtatcagttgtgaggcaaactcttacacaattgtccttaaaaaatttcttaagcttttctttctcatcttcatatactttaacacaagctctagtgattgttcttctagatggcagaacaaatcgtggacatgctaaagtcataaatttcctaagaccagaacgctcagataggacaaatggttgttcatcttcaattatcatctcagcaaaacaccttctaagtttatctggatcaaatttccaagtggtcacagtaccaagagtactattgccatcacatggtgtcagttgcaaagttccttgattatcaactactggtttgttaggattctttttgcaaatctttagatgagctttcaaggatgacgtaccatttgttcttgagccgcaatgaaatagcttggtacaccacttgcacttggccctctcgtccccattagcaagtttgaccttgctgaaactttcccatacatcagatcttagagccattggttttctttttctggattcttcatcagctttctcttcatccttggactgctgctgctcctccttgtccttgcttgcatctaccactccagtagttgacactccggttttagtgtcttgagattgagtgtgattaatctcacaagcaacagtttcatctgtgtcccccatctagatcaaatgtttcaaatcactaaatcagaacttaccaacatagaacagcaatacaacactcattcactcaacatggactcaactagaacaaacgaacaagaagtgaagaacttacataggaggactgctcggtccgcgccgccgttgtcttggtcggagaactccacgagggtgttgccggcccgccgccagcagcccgtttgccggccgccgagttagggtttgggtctttgggcgcagggggcggtgtgctcgcgggcggctcgccggggcctacagctgctgctcaggggaggggagtgtggcgctgcggccgtgcggcgtgccgcctcgagcccgcgacggcgaggtagggcagcggcagcgctgcggcggcaccctgcgcggctggcggccgggctagcggctgcgccgagtgacgagtcgggggcgtgacgactgacgagtcgggggcgtggcgtagggttggccttgcccttgatggcctgatgggctgcgaactggtgggccgtgggctgcgctgccgcgggatatgtcggtttaatcggttgttcggttcggtttctctataaaaccgccgccgcgggatatgtcggtttaatcggttgttcggttcggtttctctataaaaccgaagctgaagccgtacaccgaatagcacaaaaacagaaaccgaactgacaaccgaaaaccgaaaaaaccaacaattcggtttggttcggtgcggttcggtttgcggtttgcggctaaaaaatgcccaggctgacctcaagctaccttagatccaaacgtcttcttactgtttcttttttttttttaccatacaacaattttgcaaactctaaatattcttccctctaaatattcttcccccaccatttcctttatccttgaccgctatctgtttgaaataaaatataaatatcaaaaaatgatgcaccatcaaaatactttgcatggtaaatataacaatacttatcaaaacatcattaaaaattcttactgctcaactagaaaatctcattggattaaaaaaaaagctaacgaataaagcatcagccattttgaatatatatatctttcgtttcaaatacgaactaaataattcctataaaaaacctgataatatttgtatgctatagaggatcgatgaatagtactaatgggatataaaatatccagcgtgccacgcgccattttctaatcataatgttagaacaagctcgaaattgttacaactcacatgcaaattaaatgccatcgactagtgaactttggtttagtgatcgtgctagtctgcaaattaagctgcatttttgttaatatctcgatggaaggatggcagccacgacgacagcaacgccgaacatgaggatggcgagaccggtgaagttgacgacgaacgcttcgctcggatagccgtggaaggggaagatgaagcgtgctaggccggtctcggcggtgcagatggccatgaggaagatgacgatgcccaacaaaatgtgccatggcgcgtagtcagccctcatcgtcatcaccgcccccgggaatacaaagtagacaaaacccaccagccactgcaaataattttagtcaccggatttagtgaaatacaaccgcctcaccatttcgcttaatacttattataagcggaaacagcttatcaacggtcaaaaaaattgtgaatttagtttaaaaaaattgtgaataaatcttttatatacgtgttattagtattttaaaaacagatgctgaaaaaaaaataaaccaatatgaaaaaaaacccttaaaatcaactctgaaaattgagtcataaaattcattgcctcaatcaatttgaaagtcctctggctcacctgaaaggcatagagtgctgcagtggttatcccaagccaagcatggagggagcggatgtcaggggcgcggagatcatggtggaacttgaaggcggcgtacaggccgacggcggcgaaggcgagggcgaccagatgcagcagcaggtgcaccgccttcttcacctcccttgaccccagcatgatcctgtacgccattatcgctgcgagcaaccatcatgaagtacttccatcactgcacagctaatcagtactactaaagctatttcttcacatatctcctctcgatcaatcacagccattttctttcatttactttgtcttctcaacgaatcacacacttcatctaattattctcatctactacctccgtcccaaaataattgcaattctatgttatttagcatatattaaggtttgaaagaaagactacggtgcccctcattaaatggtgtttatgtgagagtgggaagatggttgagggtaaaatagggagaaatttgaatgagatatgattgatggggcaattagtactctagaattacaattattttgggacgaattttgaatcctagaaatacaattattttgggatggaggtagtatttttttaattcccgtgccaacctcaaaaatactccctccttccaaaaggctaagtcctatttcttttttcaccaaaaccaagaagcaattaatttgtttctatgtgacaaaaccaatgagcatgcaatcaataagcactaaaatagcttcttgggtttctatcaacaatttaatttagcacataataactacaaataggacttagacttttggaaaaaatcaaataatgaaataggttttatacttttgacaaggagatagtaatgtatactcctactccctatgcccgtggattactagttcattagctgataataattaatttaccttctcccgtgcagatgacaaggccaatcaccatgaagagaggatgtgcctgaaaaaaagcacagcaacatataacgttggttgcttgtaattgattataattaattaagtaagctcaaggtttggtacaaacacaactacacaggtagattagacaatttgatttgacatcaccgtgtaaacgagctgaggggtagagctcctatgccaggaccaggagacgccaccccggaagtgcagcacccagacgagcgtgagcgtcagcacggcggcggccagcagctgcgcgaccaccaccaccggcagcgcggtgagccggaagctggcgctgctcttcaccggcatgactatgcctctctactcttcttccccgacccgccgcccgccggctgacacccacgtcgagctcgccgccggcaccaccaccaatcaccaccagcaaccacggagagatggcaatggcatacaaatgatacaatgctgcagtacacgggttataagggctttgttctggtgatgcaaccaaggagtgctcaagtaaataagaaccgggtcaatgcaatcgtaaatttatttgatagttttcaatcctgctaagctagctattggaggagatgaattagggtgcgacaaagccaaggaaaggatgataaaaccggaggaaaggtctaagttttggactgtttcggatttgtccggacggcagaggaaacagcttagattgaaatcatcccagctgggacagatttagctggagttactacaaattgcccattcatcagggatgctggagtaaaaaacaagggacgttattatgattttatattcgtatcaacctgcgcgtcgccggcttgcttcaagcacatactaatagcttgtccgttcctgctggtccatatgttgtgttgttgtgttgtcggtccccctcgcaagcttgaaaagtacaccacaccgggaaggcaaatcaatccatcagctcaaatgcggccgtccgtctggactactttgcttgtcattgcaagaatttctgcttgtttgcgccgagcaggttcttctcatctccagccaaactgaaactgaaattggtccacaaccacctcaagccccacttctcttcttgtagtatgtacgtccaagacctgatgattataatccatgcttctggtgagaacagaaaatggataatgtaccaaaaccggttgcatttttttttgtttcaacattcaagtatatacagtataccaaaaggatataaacgcagccaagaatatgtatgaacataccaacatagccgtcctatcttgtcctatgtcctggcatcgaccttggtaaccactgcattcaccaatagacagttagacaccacaggccctgcacataccacatcatcatgtacaggggaagggacagcaacaaacaacaccggcaagcaaaacctaagagcccaggaaaaatgctaaggtgagggctagtacaaaaaatgctgacctgggatctcagatgacaaccatagaaaccagcatccaggctgcttgcaaaatggaagagagaaccagcatcctcccaaacagcaggaattcagatatagaccaagcctgtaacagaatcacgaccgttcatcacagtttcacagcaactacacaagtaacaaacaaaaccagtactatatggctgacatacagcagacagaaacatcatgggcttaactctgcttcactggaaaggatcaaaactataacacagaccatcacacaagcactattaataccaagagaacacaaaatcacgaaaaacaaatacagcttaaaatatgctggggacatcttttgtgagcttacaatatatacacaagacagcattcgggaacccatgggcaacagaaccagaggcaaacatgacagctgaatcaaataatcaacttttctagatgcggattttgtatacagagggagcttatgtcatatgttacaaaagccctgcctatgttagcatactaatcctacaggacatatcaagcatgaatgttcgctgcagcagcaatcttgcaacaaaagcttgaaacctaacctgctctagagccagtgagagttgtttttctcccggcatgttttcaaaatgaaaatgcccatgcatgtatatctatgagatgataggttctgttaaagcatgctaaaaagcaagcattgcaatgtcaggcataatctgtccagctgacaccttgctcaattctggtcactagatatggaaatcctgtgatgtttcgaaacactgacgacatgaagcaactttgttccatgaggcacccatccaacaaaatgccatctctaggtacaggcacctgaggcttacaacccattgtcactagaggcttggtttcataatcaatcgtctggtgttgtgaataccaacaccttcccatcaccatcccatccaccggtagagccaagtgcacatcttctgaatagacgccaccttgtccatccaagactgtccagggctgcacagaccaagcaaatgtacagttacagcagtgcattctttacacttctcttcttgaaccattcgacgaattcggcctcctaggcattccaaaaggcaaattatctctagacctatcaccaggacgtcccagatcatccaaatttctgtaactgccatttctcggaacagagttagaacgttcatcctcatcaggcctcatgctaaccctggaatctggaagcatttccaaatgcctcggtcttggtccaccagtcctcatgttccttatgttatttgaagtgttccttcctggagtgttagagatcttcatggcaaggaagtccttgggaatggtatcaagatccataaaacatttcctggcctttgcatctgctatcagtaaagcccagtcctcagactgcataagagcaccggcattaccaacaacctggaacagcaaagattatcatcagtacccaaatcatagatctaaggtcatacaacatttttttgaacgaattttgaataaggggaagagacgtacccatagagctctcctagctctagtaagagcaacattcatacggcgtatatctgccacgaaacccacaccatgatttgaggcacggacacatgacataataatcacatcacgctcctgtccttgaaaagcatcaactgtgtttatgtaaatgtccttcccatcctcagtactcataacctcctcgaattcccgctgaagacatttcaactgcaacttatatggtgtgattataccaacagaagctttcttgccaccattagctctcaagaacttctgaagattctcatacaaacgcaaaacaaactgtgcttcatgaacattctggtacgaagatgacccacctctatgagattcacgaccatgtgagatgtcatagaatatgtaaggtgccattaatgcatctctataatatgcctcgtcaggcaatttgacaacactttcactatctgtaaggcgcccttgatagaagtgtcttgatggaaattcacggatctggggatgcatccgatactgcaccgataacaaaatggtagggcaaccagacaactggaacctctcaaagagactcctgctgtacattaaagtcccagctgctttgctgataacagttgcagggagctgttgtggatcaccaaccaagacacacctagctgcaccgagcgaaagtggagggaggactgctacttcactagcctgagcagcttcatcaattaccaccatatcaaagccatgactaaggcgggaaaataacttgcgaccactgcttgaaactgttgtaaaaacaatttctgcttcattggcgaaacttgcttctagactagccctagcatcttccatattgaagttgctgccaacacggaacctgctttctaatatcagcaggcgtgacatctccaccaatactttatccctgctttctactgaagcagcaagtttctgaagtagaaaatcacgactacgatctctttgagcgagcacatcagggtctactccaactgaaccctgcgatctgccagccgctgcaaccatagtaagttccctttgtagaagggctatctcctgtgataattgctgctcacggcattttagctgttgcagccacccaatcacttcatcacggcccttcattaaaagctggtcagtccttcgctcaactgaaacagcttgagcagcacgagattgcgaatcaactccaacacgggcaacatcaggacgatagaccttcatttcaccatctataaaaccacgatcaagaacgcgagcaagcagctcatctgtggcggcgtttgatggagcacatacaagcatccgtggtttggggcaaagcttgggaagagtgcggaaaaggttctgatccatactctgtaaaacttcatcaatggaccctgcagcaacagtctccgagctgttgcttgtgttaccgctaacttgcttgtaactttcaggagcaagcttcttgagcagagcagcatagtaatgttgatactgaacaagatggataacatttagcatcccccataccgtatgggtttttcctgtcccaggcggcccttgcactaatgtgaaaggccagggttcttgtttcttcacagctccgttgcttgtgccagcagctgtatgcattgcagcccaatgaatcgctgatagctgaggcccgttgaaagtacgatgcagatgatcagcaaaatttggagtgaaacaatcaggcatagcaggtggctgctcttcatacttggggaagtgctctggacttggctgaagaatagcattttgcatctgatggaaagatttttgttaaaacaactggaaaagaatattaacaaagaaagcaaaatatataaaatgcattacctgaacattgagtctgcggaatgcatgcaaggcaacatattccctttgtgttgttgctagggaaccaagactagtcagataccaggtgctccgaggttggagtttcctcaaaacattggtctcactgcttcacattcaacacaatagagtgataagataattggaagtcaagtattcagaacaaaagcgtagacaatagaaaaaacattataatattatttgtccatcaagcaggaaatcctacaggtcataagcacatgaataataacaggtctttttgctacaggctaacaaatgtagtctagcaaatgtatagttaatctgagcatgttatgcatacatgggcaactgtttaatgcaactgtgagtgtaccagtgtagtgctcaccggctcacaaatgaagagttacttaagtgctggactgaactcactaattatctttacttttgggaatttggaaggaatgcatcatagaacatttcaacatagaaggcaatgacacaagttgtggctatgatcaaggatgacacgcatgcttggaccctggcaggagtctactggatacacaacaagcctcccatcgtttgccctacaacttataagccgcttttggagttgatttttgtggtttctttgttatagtttatattccagcattggctttcaaattgctaagggcacatacataaaagttttaccctcaaatttccttttgttgctgataagccataaagcttataatcagcattagcccaaccaatggcagatctatactcatttaaagaactccgatggtggtggtggatggtgagtctgccaccacacaccaccactgccatataggacccctaaatactgagtaggtggactactctatagacagatgtacaaatacatattaaaaggcaacaacgtagcttgaaataattaatattgattacaatgggaattttttattatgacttttggggctttagagcgcatggtggggttctctagctaaattatgatgcaaagcacaggcatttacctagttttggtagatagacctgcttgtgtaggacttgcttgcttgtagtttgttccatctaatttcctacttcctccattatcaagtataaacatactttcctaagttgtttggcagagactaaaactaagtgttttacggtcgtacataacctagaacctgttgccttcaatcccgcttaaagaaagaaatggcaggccttctgctatcccccccccccaaacccccaaaaaaaaaggactcgacagtgcatgcatgtaagcgttgcttattgtatcaaccaaaacaatctgtatgtcaagcaatgttatatattgagcattgcatgctctaggaatgccatgtctaccagaattgaacaaatcctaatcagcagataccagatatatgagcattcaagggacaacacaactctaaagagtacacattcagaataataaataggtttgcaatgaaaaaaaaggtagtagaattacaattttgccaaatactagcgtacctgctagaatcaaatgaatccccaagatagaagtgaatgattgccccaatgggatcgcgtgtatcaataggcgtatggcgtctgactgtaccaacaagccgtccacactctgactcagtgtcttcatttgaaccaacattccgcctattagatctacttgattgggaagctgacaacaaagaatagataaataacggttattaaaatatttccttttcagataaaaggaccatcagggcttaatacaaatgagaaaaatcaagcatagctacctgaaccaggcctaggaaaggacaaaactgcaacttcaccttctttgaaagtccatttatactcgtgcattggtagaacaacaacatcataccatcctgaaagcattgcacaagcattgacaggtgattgcattgcaaccaagacatgtttgtataatagcttcatggaaaatgacatcaacaaaacatgctggagatcagaacatacctctttcacgcctctccactgttttcacccgcaccataacatgtgcatcccttgatacagactcaagactctcctcataggaactatataactgagctcgacattcctcaaagagcaaaggctcgaaaactctaatgtactcctcagcggattcaaaacttttaggaacacattgaagttctgcctcctctgttcaggtaaaaaattacaaaacatgaaacacgcaattagaacatagacaatgtgattaagaacatatacagcttgttggaattttagaatgaaaacagaaacaggaaagattcatcagtcatgtataagattcgtatgagcccaacaaaaatatcagagaagaaagagttctactttgagcaaacttcgaacagccttaataacaaagcacaagtgctgagcattaccctattatttaaaaatttaaaacatgtatttatagaatttcccagtccttgtggcacatggtggcacttctagttaatagaagtcactaaaaacagggtaaaagcattcatcactagacagttccacaatttcaagcaattgtatgcattttcccatagaacatcttattgtttttcaaattgagaaatggacaacaaagaacaaacctggattgtgccagaacttgtcacttgtcacctcccgtataagtcgttcaacagaagtgtcttggtattgcatgttatttgctggagtttgttttttggaaacaagagacctcttgttgactggtttctgatctacagtattctgtcctgttacaaccgatctctgagaagaaatttgtctgccctttaactgtcttggcattggttgttgataaccatctgcaggggcttcttcagcattcattttctttggccggccttgagatcccgtctcagcatcaccattggattcagaaatttgatcgattggatctgcagaattacttcgttccgaaccaagcatttcagattgcctctgatccctgatggttggctgactttgtctttctgcagctctttcagcaataccaccaccactgcgaaaagcttccttcacagtacgtgtgacaattggtgctggaaaggatgactgtcttctgggtgttgatgtcttcattgtgccagcttgctttgcatcctcaacattaatgaacacagtttgcctggctctctttttacctagcattgcctctttgtgttcatccaacttaggtctctttgaagggttacttgcaaacttcaacgcataattggcttctacacctctaacatcctttgacttgttggacagatctgaatcatccccaagctgatttcctttgttttctaaatttttcgtgctctcaagtcctgtgggaccacgtaccactggatccttaggcacatccatcatttcggtgtcactgggctcagcggcggcctcatctttaatcatgttaccagatttgacagcagtaggttcactttcttgggaatcccttttcacttgtgtagttgcagtaccagccaactcttctttgttgctaacactactccctgcagtgtcagaagcaacatctgcatcagaccactctccttcctctctttccactgcctgagaaacctgattggaggacccaatcattttagcaacaccatcagagctatggttgattaacatagatgtagaggctatgctagcattcaaattatcttctgccttgattggctcctttgtaatttgtgaatctttgctcctcacaaaaggctgaaaacctgaaccggacggtgcgtgcttaaaggcattattgtttaatatcccctgcgactgtgttacttcctgttgcggaaataaagagggccctgctgtgggaacaggaagggtcttctgaggttgtgacacaacaactgcggcttcttcttcttcagcttctgttgggagctcattaaggtcaaataacatccttccacgagaccccatgtcatgggtaaatgcatatagtttgaacctttggaaactattggactcgataacaatcttctggggtaacagaacctactttttgaaagctataattgaccttttgtagaaaatatctgcaaaaacaaccagcacaagataagtaatatacagaacgaacagggttctcaagggatgcttggatgcttcggtccgctagtgagatggctggcccacagaaggccaggagaactgaacaagtgaacaattagagcagagtccacatcgcatgatactgcaggaaaggaacatttcaatcaggtgaagtgacctgaaaatcattcttcgctggattccttttgtgctgtgaccctgcccactccgtcctcttgttgtccacttcctacccatctcaagaatttgggttctagcaatacaggatctcagcatccaggcagacccttttacagataaagtaaataagtatgcagaacatagctaagaacaaaagaatgatgacacattggtggaaatgtttgacatagctacttaagagtgcaagctaggctctagattcttcgttgtttctaaaggaaagcaatgtaaacaatagcaccagtactatagtgtccaacattaaggtttagaaaaggaagaagtaaattaaaataagaatgatgttggactttaacatgagctgcagcaatgtcaggcttgccgatattaacagagtactaaataaaagaaaaacacaattaaagcttgcataaaacagaggctacctaaataacaggaggagaaagagtgctcaactagtctagaaactttcactagcccaacccaatcctagatctaatccggcactagcaatctcctttgcaatcccttagtccaaccgtaactgtgttatgattgtgcatgcgacatttgccgaagaaataccctgccaaaaggactcatgacagaaaattatcaatgccatcaccaccaaactacaaaaccgtaactgtgttatgattgtgcatgcgacatttgccgaagaaataccctgccaaaaggacccatgacagaaaattatcaatgccatcaccaccaaactacaaaagagagtataaacctaaaagaccatcgagatctttgccaaatctaaacaactttgtcccacatgaacaaaaatacacactaaaaccgacaaataatcccttctacggaatttgccaaaacatcaaccgtgagtgacagcctactcccaatcaaaagataaataacccatagctactccaaactatagtcggaactaaaaaagaccacttatctacaaatgctctcccaatcagtgcaaatgctacattctacagctgcatcacaactattgagtttaaaattagaaacaaaagcagatattactgatctacttaactctgattggaagatattgagttctagctaccccaaattaaaagctaattacaacagaagaaacagcttctgctaaacatgccccataaccaaaggctacatctttttcagcagcaatgcaactcttgaaaaagagaaaaacagctacggaatctatgtgacaaataatcccattatgcaacttcacaagatatagcaacaatctacagctgctcccataaagagctacctatgacatgagtaccttcgggtaaacacaaaccaacccctacacgatttcagacactaagacatttactaagtaacaaaaaaaacagggcagccagcatagcggcagataaagcaatagctttaaccttctagtggttgtgacctctccacaaaacctagcatgatgaatactacaacataccaggactattgaaacttggaaaatacaccactgtagtaataacttaaaatgcttgtttgatcaacctaagcagagaaactaagaaactctagacagcaatagcagcagcagctgatgacagcaaaagcaatgcagtgactaactctagtcaattgtcaagcactagaatttattacgaaaatttataacagagcattcaacagacgcgcagaacagcagcacatggaccattcgaactgaatcatcactcggcatttcattccactcgcaaaaacaaaaaggagaaaacgtactaccatccctttattaccacaactccatgacgcaattccccccgttgctctgctcgatctaccaagcacccccgtgtatttaaacccacccccagtcttaaatcagcaatctggtggaaatttttcgtaaagcgagggggatcgttaccaccccgcaaacagttactagattcggcaaccaccccctgagccccctgatccccatttcgtttctagattcggcaaaatctcctcgagagaagtttctcctcaataaaagccccaattcggcagggcaaaaatattaaaaaaaatcccccgccgcgtccagtccaatcaaatcaaaccaccaccacacatcacgcgctatctatctactatcaatcaataatctattagggttctatccgttcgccgttggtcgtcctagggttggttgggagcaggggaggcgtgaggggaagggggggatctccgtaccaggcgatcggcggcggcgcggccagatccggccctgtgcctcgtctcctcctcctcctcctcccgcggcggcgtcggcggctttgactagggtttcccaccgcgcgctcctcctcctcctcgtgtgatgcggtgcggtgcgatgcgatgcgtttgattttttttttctcaagttttttttcttgccccccttttttggtctgggtggtggtgtgtgtctcctcctcgcctcctcccacgagcgagcgagcggtcggtgagcgtgacgactgcttccttcttcgagaaatcgagagaggaggagagggggggtgggggtgggtgtgaggcgaggaaggggggggtggggggc

SEQ ID NO: 69508 - DNA, 656 bp, Oryza sativa
ctccgtttcataatgtaagtcattctagcattttctacattaatattgatgtaaacggaggaagtacgtacgtactccgtagtaattagctagggtgatgggcccggctactaccaattctctgaactcaatatataggttctttgtcaaacatatgggccatgtaaatagggttaatttaccatacatctcagtttggattggcctggcccaaactagtagggaaagaaacagccttggttcttgggagaaggtcaggcctgctagctcaggcttgagctcggtgccactaagctcataaaccaaacgagccgagcccaaactttgtgtgctgggctcgttaagcttggtgcgagggccttgcgatggagctcctcccctaggctcctttagtttatccctatctcctctagctcattccttggataccgtaggtttcttttttcgcgagcgcgtaaaaggattgcacgccaatatattagaagaaaagagttatagttacacgacgcaattagccagaccggcttacgccaagggaaggggaaaaaacaaaggaaaaagtacgaattaccccctgaagtattgggtgagtacgaattacccccctaaacctgaagaccagtaatttttcaccctcaactatcgatatcggatga

SEQ ID NO: 69509 - DNA, 1650 bp, Oryza sativa
caacatcgcaggagtggccggaggaggtctatccaccctatgcaaatggtcctggatatgttatatcttctgatattgctggtgccatcgtgtcggaattcagagaccaaaaactgagggtactatcttatagttttctgtaataaaatttccgtcactctgcgcattaactgtcctccttttattagtacatcagtaggggcctgccctcctgttttcccctaaaaaggagaataccttaactatcactttgaacagttggtttagaaacataaaaaaatatataggatgaaagagacaatagattaacttcaccaaacgaactatatatgattcttacatgacaatttagtaatgaaaaataagaaccttcccttatttggtatcttgttttcgcactggtttaaactggtagattgattactacataagtctggcagaaatttcctaatcataatccacgttgaagaagaaacttatttaatttataattgctttctgtgcagctcttcaaaatggaagatgtgagcatgggtttgtgggttgagcagttcaacagaacaaggcctgttgaatttgttcacagtaccaagttttgtcagtttggatgcgtagatgattattatactgcacattatcaatcaccaaggctgatgttatgtctgtggcagaagttgctagatggaaaaccacaatgttgcaatatgagatgacaatagtttaactggtagcaattgaatcataccgtactggcaatcttcatttaatcaacaaaagggatggatttgctgatgtccttcagtagccatttatcactaactatatctttgatggtaaattaagactgcttgagactgacatgtagaaattgatttcctagattacttgagagtagccagcttagtttcaacatttgataagccagtgcactattactctcttttcttaaaaaaaatgggtacaagtttttaggtactgtagaaatgaatgagcatcattcctgaacatgaagaagtggcaattcagttaagttacttctacttctaatacgactcactacaacgtggcggttgttcacagcttatctggtgtggtgagagcttgaagtataggttgattttgtcctgcaacctgtcatgtaatttagtcgctacctgaatgaactagtctttttctccttgactaatcaaatatgtactcttaactcttctattttttatgtctacaacaaagtatggtctgggaaatttcatgtgatgcgacatctttaaaactgcaagctttcgctgttgctttagttcttacatgaaagtcgtaccttcacaaatcgaaggtgcttatgtaatggtttgctgtttctgatgcctttaataaatatacttttttccactatatccttcatgcgtgcaaatcattcatcatagttttgtctagtaaaagaaaaccttgtatttcggttgttcatgtattctagttgtctgctcgatgaatgtgctgttatcatcataacgatttccctattgatttatgtgcaaaatgcttgctactgaacacttgcgatgaaggaaatgttgtatttttttccccttcccaaacagcaaggctcctattgtgaatttgtgattgctgaataattgaaaatgccactaa

SEQ ID NO: 69510 - DNA, 1823 bp, Oryza sativa
taggcctagaggtgccttgggaatgtggagatgcttaagcatccaaagagcatctcttctctcctattgacaagtgtccatgacagtttcttcaggtataatgctcacaaccgtcattgggaggacgttatccactcagcgcaacttgggcttgggccagcggcctccgtcagggttcggctaaacccgagacggcttcgttggctccggttttcggcttagacactcattttgggcccctcattctattgctatggatgtttggcccatttggaggtgtttaattgggtctttgggtccaaacctccataagtttggatataagtttgattctctttttccttcatgtattttcttctcaacttaggtagtttgccacctgcatacgaatgtacaccaacactcgtggaaattgttagaaataaaccctaccactatgttggatgttttatatttatggtcttatgtagtagtgacggcgagaatttggtacttaacagccgtccactcttagagtttatgcaggtggcatttgacctgcaattgatgtcagccaaagcaaggcatgtttcgttgattggggccacctctgtacctgggcaagatatagtggtgtcttcaccatcagcaatatcacgtctttcccatggagtaaaaccaaatttgtttctcaaagtgcaacaacaatgcaaagtacatgcaacatcctgcttgatcaaatctacacttctgtggtcgtttcagctcaagagtatttttgtaaagaaacttccatagttgatccaggtgggatttgacctgcaattggtgtcagccaaaataaggcttgtttttatcggagtcttctgtgcctgggcaagagcctcagagtgctttatagaaggtaatagctctaggtggctccgcttttgaggatgtggcaactaaagatcaagtaatttagtaagttctttcctcgtgtccctttgactttctggtcccttagtgttgatggtatgctcatttcttatgaaatgtgaataaatgtgcatatgatgttgaacctgtgcataacattcaacaaccttttggtgcttgattaaataaattcaatcctccatttcacatcatatataatacatttcgggtttcatgcatggatccattgatgtgcttcatatatgtatctaagatcatatgaatgttagcgaatttagacgagggatggagagatcaaaacgtcttatgatgtggaagggaaggtgtagaaatttacaatctttagtgggtgtgggattgttgttgtgtgctggaccatttggaaagcaaggaataatgcccactttagagagagttttcctgctaatctcattgaattgatcttttctctctttccatggatttctgaaatagccaaactggaggccaggaaagaaagacttcgacgggttcccaaactactagaacaagttgatggcaggaagactgaaaagctatgaattggatattgtcgtattgaagattttggagcttggaagacttggtatggagagttgtagacttatcagactgaatacgtgttctgatttgaatcaggctctatgctctgtctgcctttgttaaagattttggtgcaacttgatgtaattccctgctttcttaaactattttttgaggccttgtatgccattgtggtgggatagcatcacaatggcaacaagaatttgcctgctgctataacttgtttagcttggtagatgacatcactatttatgcgtggtaatagttggatctttctgcagaattttccagagttcgagcaactcttgtgggctgcaggaatt

SEQ ID NO: 69511 - DNA, 651 bp, Oryza sativa
cccgcgacggcgccattgacgtatacgtatacgtacgcggtacgcctccgcctccgtacacacgtataaatacgtaccagagctgcgcttgcgacgccacgtacaagccgatcgatacgccgtcgcatttctcctcccattaattcgacacagcagcttaatttttttttcaattctacgatatcacactatggttgtctttagttccacgttaaaattaaaagtttgaagaaattgaaatgatacgatgaaaaagttgaaagtttatgtgtgtaggaaagttcgacgtgtcgaaaaaattaaaagtttgaagaaaaaaattggaatataaacagtgcgtgcattttgtacagctagttaataatagtccttcgtcttgtactacaaggacctgcacgacaaagctgatgcttttttttttctgttcatcactctttgagaaaattaagctttttcgattcagacgtttaccagaccagtgtactatgctaagcaccaaacatatacttcctctcatcgtcatccatggtaaaatttgattcttaacgaagaataacctagctaaaaaaaaggtggagatgaacgctattgtttctgctatacacaatagacaatataacattttttctctgagtgccacgttatttggtt

SEQ ID NO: 69512 - DNA, 727 bp, Oryza sativa
attcctgcagccctatacaataatttatgagttaggatcgacctactccatctcttccagtataataaatttgaacatacatacatttttctgttctagatcacattttatactaggttggttttttttgacgaagggagggactaccctaaggttgaggtcttgacttttgttgaaattaattgctgaacaatttttctcatcttgtctcccacgaaggggaaaaggctgacgtggctgtgacctgtgactggcattcatgtcgggtagtattgtttagttaagcttgttcaggcttcccacaagacctgcgcctgcaagctcatcctcgtcacggttgtccattcggtgtagtttttcctcgttagcttgggataccacccactgcaccatgacctctttgccaacgttacccctcattcggccatcgttgaggcatgcatgtggcagtggtgagcgggagcaactcctcgaccctgtcaagaaatggttctcctatccaggcatagagccatgaccgatcttcgatgcttgctctaataccacttgttatcgccagaacagatgaacacacatgaacatttggtgtgcagacaaagcgagagagatttggcgctgcgaactgcattgcagcttttcagttttctcttcctcttattgggatgaaaataaaaatggaaatcacgggctaccaatatgcccaagactcaagccacgacgtacataa

SEQ ID NO: 69513 - DNA, 15061 bp, Oryza sativa
aataggatgtccatcttgagacaacacagccccaataccagtggcacaagcatctatttccaacaaaaaaaggccgagaaaaatcagggagagccagtacaggagttgtacacatggcagccttcaactgttggaaagctgcttcagctgcagcagaccattcatacttcacatgcttatgtaagagcaaggtgagaggttttgctataatgccatagtgctgcacaaacttgcgataatagccagttaatcccaaaaaacctctcaactcagtggtgttagtaggagtgggccactactgcatgatcttagttttgtccggatcagtagcaaccccttctgctgaaatgatatggcccaaatattccaaagatgtggcagcaaaagagcatttactcaacttagcgtataactgatgttgttggagcaattgcaacactaattccatatggtggacatgagagtctaaatcagggctataaaccaatatatcatccataaaaacgagcacaaatttcctcaaataaggagcaaagatggaattcatcaaacattgaaaggtggttggtgcattagttaagccaaagggcatcaccttaaagtgaaaatgcccatggtgtgttttgaatgcagtcttctcttcatccccttctttcatacgaatttggtggtagccactgcgaagatccagtttagagaaaaatttggtgccagcaagttcatctagtaactcatccacaataggaaggggaaacttgttctttactgtcaaagaattaagccttctataatccacacaaaacctccaagtattgtccttctttttaactaacaaaactggagaagcaaatggactacagctgtgaacaatcaatcctgaggccaacatctcagtgacctgcctctcaatctcatccttctgggcaggtgagtatctataagggcgaatgttaactggggaaactccagacagtaaagggatagaatgatcaaattgtctctggggaggtagagaagaaggggtctgaaaaatctgatcatactgatgaagtaacttggtgacagcaggtggcagtggagaaacagatgaaggtgcaggaacagtttcaaccacagccaaggcccaaatatcattaccagcttgccacttacacggtttatcagaagtaacagcagtgagttgctgaagggagtgagagacaataccttgcaacttaaccgtttgtgcctgataagcaaaagagagacacttctcagcccaattacactgcatagggctatactgagacagccaatccatccccaacactgcatcataacctcccagatccaagaccttcatagaagagacaaaagtgtaaccctgtatccaccaagtaaatgcaggaacttgagcagaacaggtgagcagagtgccatcagcaattttcacggtggcaggatcacaggataccaaaggcagctgcaaacgatgacagagatctgcattgataaaactgtgagaactgcccgaatcaaccaagattaacaccacctgatttcccaccaaagctctcaactgcaaagaattagcagaactggtaccagccaaagcctggacagatagtaacataccatcatcaggaggagtatccaggttggtaagagcatccagcacactatcatcaagaatttcagtagtgtcagtcaattccatggccttcaactgaaccccttcaactttgccacacacatgagtaggactatacttctcaccacatttgaaacataaaccattggcacgacgataatccttcagttgttgagctttccacaattccctcagagtagatttccctttatccccaaatttaccaaccccagtatccttcttgacaaaggatttatttaactgttgagcaccttcaaaagccagggctgccatataagcttgagtgactatgacaggttgctgagcatgtacattatatctcaattcctctttaagaccccgaataaactgagacaccaaaacagagccctgagtaatagcaggattatacaagcgaatgtggtaaaccaactgattgaactaggagcgatattcagtaacagtactagtctgagtcagaagcaacaactcatccattttggttttctcaatgtgcagctcaaattcagcagctatagcagtgcgcaattgatcccaagtcggccaccccatctcctgtttccaagcttggtaccagtgcgccgcatcccccactaaattaagagcagccgcagacacccgaaattcatccacaatattatagaaacggaaataagtctcacagttgtctaaccacacgcgaacatcagacccatcgaatttaggaaaatccatctttggtgtccagtgacgacgcccccccgactcatcagaaggacgaacaggtggagtaggcgcggtagtgaatacctgatgagacggtgcagagtgcacatgggtaggggacggtggcgccgaagatgaagaagaggccccatccttagtaggcggcttcggaggtggaggaagaagtggaggcggttgcgacggcagaggtggagtcggcggtggagttggtgacgaagaagcagacgtcaccgccttgagagcccgcgcgacctgagcttgctcatgctgaacttgcccgagagaagacatggacaaatccaccttgctttggaccgaatccagccgcttcccttgagtttcaagcttgaggtcgatctgcttaagctgcttgcagagattgtcgaccctctccaccttcgtcaccaacactgcaatcgcttgagtgatgtgttcctccatcgcatccatagccgccacaacttgacgcacctggacgccttgcttcgccggagccgtggtgactacgtcgaagaaccagatcgaaccaagcacgagattaacagagaaatccccgaagataaatcccaaactctgatgcgaggatttaccgagctgaacaacgaagcagaaccccccacgccacgaacgaatccaaatctgataccaagttgtcacaacctcgtcgccggcgagaatctcgccgccgcaatgaggatgaacacaagatggattcgaatttcagagaacagaagagaggcagaggaaagagagtttggggagaggttttgatttcatttcttcagacttgttttccaactacagttcacggggattatatactactccctcgcgtttccgccctcagggccacacaccgaactcacgctacacatttacttaagtcgctttctttacacaaaaacgcctcagcgtgattacgcttccttctcctgttcctcgtccgttgtcatagcctgcgatatgacacgccgccgccgctaggtcgatgtgccgccggcgccggcagggagatcggagatggcgcagcgcggagggcggagggcgacgccggtggggagtgtgacgtgttcgtcgtgttcttgagttgccactatgtttatatgggcttttcatgggccgggcctaaacgaggcccaaaaggaagagcagaatggtcagttacagtcaggtttacaatttcaacaaaaagagaccggtcagttttcacgagatctcgtgatttcgaggaggctggatttcgaatgattttctagaaatataaatttggtcattaaaatgaattgaaattcaaccgatatttcgtcaaattttctaggtttctgtgcaatttttattcgtagctcactgcatattctccatcattgttttattgttttagaacagtactagcagtaacaactatcgagctcaacttaaagccgaatcgtagtgtaattaaaactaattcggatccgaatcgtataagcaaattcatattcgaatcgtacattcctatatattcaatcatgttgcccgcctcgcctgcatcaacctgtagctagctagcttccataaattaagcacgtaacggcacaagcctagactcgggcagctactctcttcgttccaaaataaacaaaactaacaaagaaccaaggaagtagcttcttgatctagtcagaactcgatctacgcatctgatctatgcaacgtacagtggcagccaactggcggtatgggtggagtggttttgtctgacatggaggtgagcatgatggagcaggggaagacaacaacactgccgcagaaagtgagtgtcacgcccgagcatgagaggccagaagctttgttggacgccaacttgaagatattgctaatggtaagcttgtgttctatatatatacactccctcctctccgttttttgtttgacgccgttgattttctaaaattttaaatttgatcaaccaattttcttgtaaaaaaattatgtaattattgtttattttgttgtagcttgttttgttgttacaagcactttaaccatgacttgtgtttgtacgaaacttttggatcagacaattaaccaaacgtatgtgcaaaagctaatgttgtcaaatataaaaaaacagagggagtatagtatgccttgatctggaaaatatctagtatattaaaaaaacatcattaattattaataggaaaaagtccatattgctccctcagctatggtcatagtccgattatctcttaactaatctctctactcttgaaactattcgtatttcatcattggcctaaaccagggtgtttttcgaagacatagcgtcacttgatatccttattagaaatttaaaatatataaatatataatgtctatgatagaaagagaaaacggaggtgagcatgacacatagataagcagtatttttatttttattgttattatttattattgattggtatgttgatgccatcactaattgcctatatggactccatgtagaagccacatcgttgaaagtactctatttttgaaatataaaaagaaaatcaatgtaactgataatttttttctttacaactcaaatctttttgactgaaagtacaaattttcccgtatatacggtgatctatgcatatatatattcttctaatcactctcttttctgtcctcattttcagataatcgttacgggcgtatcgctgggggtattcgtcacttgccttgtgttggcttttgtattggacttaactgtggagggtagggcaatggtagtgtttacggcgctagttggtgttgtctacggagtggcaggctataacatcattcgagcatgctaagcgaagccaaacaaacttttttttctctctttttaagtttagtttagtttgacgaacggtacaaaaatttccaagatttccaactgtcatttccactttccactttccgactgtcggtatcggtaattatcggtgtcggaaatagaaacggtaatagcttttggaaatggtaacgaaaataggatggaggtttttccgaccgttttgtcggtaaccatatttgtctagtaatttccgtcaaaattcgaaaagttccctagtgatctagctagcctaaccaaccagaagcctataaatgaaggaagtctggtaggcttgcagcctgttaggaatgggaagtggccaggggaaaaggttgttaagacgtgacatgtggactttgctaaactttggtctcctcaacttatcgatgctgaattattattgaagtttgtttatattgttcgtcgaagttattatcatatcattaatcatcatataatagtgttatgtggagtgtgatgatgcacgaatgaagttataaagttatcttcatgtatagttaaatgtgtgattatgccacgccccattgtttccgatatgaattttcgacttccaactaatatcgatagattccattccgacagtcccatttctaatataccaatattatcgatatcgttaccgttttcgggcctatcattccgattccgctttcgataaaaaaaatatagaaatgaaaatggtagagggtcggttttcatccattcctaggtgaagccaaaaaagggggttcgttttccataaatttcatgatttgggggggtggctggatttcaaatggttttcaggaaatccgaatttggaaagtaaattatgttgaagtttattcgatatttggtcaaattttcatgttttcgagaactagcggggcacggaaccctggtattctgaacagaagaagctcctctaacttaaaattagtggaacataggtcctgacaggtgaggcacacccacatgagcccacgtatcaacaacacgtctctcttacttaagttagaggagcctgcctagatcatccaagatatccaaatcagcataacaataccacaagcacacaaagatattggcacaaaccgatacaactgattatgtatatttatatatatttcgcagggctgtgaaagagagatcgctggccgatttcgttcatcagaaaggaaataaggagttgcagagatttgatcaaccacagggttcagaaggttgtaagctagaacagcttgcacatgaaagaattcgcacttcctcagatcatcttgcgatagtttacctaatctgataaagcagaatactctccattgatcgacagcttccatgcaacaacgtcaaccaacacacaaagttcagatacctattcaaggcctgaagagaaagttcagatacttgccaccgtccatttctccggtttgacagaagtggagacgattggcaccaggttagcaactgcaccactgtctgggaaccaatcatctacccagaaagatgttcctccatcccccaacttgatccttgtgggcgtggcagttctaaaacagtcgtcgatcgccttgtcccgcactggcttcagtccgcaccatggatgctcgagggtgcttccattgcagcagcggccaacgcaattgcaaggctgtgccgagcatctggagatcttcaaaccctgcattcatatattgttaactgatggggtatttaacatccgaacactggatacaacagatagtgtttaactgtctatactttcatgatttctcctaaccgtttatactttcatgattgtgccctctgatacccttaggaagatatccccaaggtctgatatttaattgattattgttatcattcatatatatatgcctgcagcataattatcgacatttcagcatgacagaaattgtccaaaagaataaattgcataactgctcctttcatatagcctaagttagtactcaattctgatatgttgagctttcagactttcagtcctaaatagcagttctacattagtgtaagcaacactaccagatagtacttgatatcctacaggtttgggatcaatctagataaccaactaaagtgatatatgcttaagtactatgaatgtttgtgcgatttctgtaaactcttttatgcttacgcttctattatccttacctgtggtgtcctcttgcttccccttctccttgggcagcacctccttatgttatctgcatcatgactgtgagccacgacatctaactagttacactcgaggcccaaggcctatgtctcagatttccgtacagcataacagcaagaattttgaagtccgattcatctaattggagtggactagctgggacatattgctacttagctcttgttatatactttcttctcatatcaaaagcatccatatccaatcattgattcctagtatagtatgtactctttccttctgtagagctgtcttatatatcttcatgtgacagaaatatggtgtttatagtttgggtatggttgtgctcggaattttgggaagcacccaagaaatttattgcaacatttgacttatcaagggaccacgatatgacaattaagaaaattctggattcatgacctttagcaccaacaagaacagaagaataaaacatagtttccctcattaaggtggcattttcttgcttgaaagcttccctgcaagcaagactaacaacgcaggaagtctaccagatactaattgattatcagacttctagttccctatcaacaaactacaatgcacttctattagattaactatgggattcataagcttggtactctagtaaggattgcttctccaattcattatcatgaatagtatctgagtttgagtaaactaaaaatcatatattgcattaccacgaatttggtaaatttgtccaaaattgactatgcttgcatgaaagcaaagttcattaagaatcccaacatgcacaaccttttaaagttcaaatgtggcataagatgaagggagcactaagatgagttgtgcttcaagagtcaagaggtacaatgagtggcttagtaactaactagtaaccgtgcacgtgcattgcacgtagtaacaaatgtaaattaaaaccattgtgggagaaaaataagaataacagcaagcaagttatacatgcatggtagcaccaaagaatccatcaccagaataaatatatactgtatataaataagtgaaagtgctaagcctattttatgtgaaactatacttgtttattacagtgtattccgcacgacttaacttcactacctccctcttatgacaaaatcaggatcatgcacacacccagttgctcacatctcatacatccacagcctcatatgtgttgtcaagtgtcacaccgagaaggtctgtccaacttctttcgccttcagcacttcatccgtcaagtaaaacacaaaacaatgtatgccaagataaaggatcagtattgatagtaaaatattttcttatgcacagtgtatgtcaagtcaaattaacattgaccaaagaaaatccagattccaatcataaagataaaggatatctcatcagaaatagtaaaggctaatattttcaaggtcaatttgatgatcaaaagattattgaattacaataagcacaagattcaactgctaaacaactttgcaagtaattcatgaagcaattccgatgacatcactttatatcgaaagaaccatcgtaatttcttaagttatgtgccaccaacatttttaggtgataattgtaatttactacaagcattttttggaccgggtagttggaaacataaatgcagagtccactttgagtctaatttcagtaccaaatgcgcaaattttcaagtatctgatgatcacatgatcaagaaccagttcatctggagtatgaacattttagtgtcaaacttaaagtgtaaaccatcaaaagcaaacgtggagatgaaaaattcaaaacatgagacgacaaggattaacctgttggaaatcaaagatgccatggcctctgtgaaccatgtgatgctcaatggggatgaccatcattgataggtcacgaatgattctgccagtgacgctggatacatcacttggtgttgctactgcttggtgtagttccaatttttggagaacttgaaaagaaaagaacaagatcataactcataggctcatagcatgtcactgtaaagttgatatactctgcagtaattttaactgcatgaatctcaaatctattactgaaaaagaaaatcttaggaagatgatatctaggatatgaatagctgttcagattctcacgtcggaccacaaccctgtttcacatcaatcaaatattacaattaggtggcagtaagaaagaaaaatgaattcaggcatgcatgctgaactggttaacagggctagcagtccttactaaatcttaacattacgccttatgccttgatttgacaaccctgattgattttacatttctattatatatagcaatatttctgaaagcaaacacccagaaatattttagcaggcattttgatatggaacttcttggcagaaaacattagagagttgtaaactaaagtgcatgttgtaagttctaattatatgtgcatactaatagtgctcaacatttcccatctactttgcccaaattgccagctcaatgccttcatttaatttccaaagtatctagtcaacatacatcaccatttactgccctcctaactgccatgattagatcaccatggtaagctgctatggtgatgtgtagtatttggaaagaagtgttgcttcaggatgacatgtatagcaaccaaaatgatccaaaattgtaagggttagccctacaacacttgtattttgcataggtgctctgcaatttatagaacgaatcaaatagcctacaaatatcctttaccaacaaataaacctcaatttatcggcatcaactctagggtatccttctaaaagactcaaaaaaatatcagtaattcacaagaatagagaattgtatagaataattagaattatcaaatctcaccaaacaatcaaaaaagaataatcatccccaacaattcacactcggctatgttgccaacatggttgaagagcactggattttattttattttataacgaaagtgagacaacacaacttttgattgaagtgttcccatctattgaaacaatggtacagtaattctaatatgtgagttgcggtacaaatattatgtttggagaacaggttgggtatgataaataccagaaacaagccgagagagtgagttggtgtgatatccccttgtggttcagataattgtctgcaagcgtgtagtaaacaaatcgttagagaaaaaacatgaatccagtagaaaacaagtttcttaaccacattctaataccaatataatataaagaactgttgatttgtttattcggcaaactgcaacacattaattaatctgaaagtttcatattcaccccttccagcccatatggcagaagaatacatgcaaaagagtagccagattgcaaaatagaagatgattttgggcattttcaccttacctgttggtacttctgcttttttgtccagaagacggtggtcgagggaaggtagaggccaatcattgcattggcggagcctgtggacgacagcgagaagggaaacatggatgtactccggcggcagggacgggaggggccgacctcggcggcggcggatggggctgaggtcggatctggccgcgacggtagggaagaagccggatttggcggcggcagcagaagatgtcggcgtgggcagcggctccggtgaggatgcggcagcagtacgcgcggggaggagctccggcgacggcgaggatgcggcggcgctacatgcggggaggaggaggagcgagcgaggaggagaagcgaagtccgtgcgtggaggaggagcgaagtcttcgcgtgtggaggaggaggagtgaagtttgggcgtggaatcgtgcggtggtgaattcgtgcgcgcggatggacggtagggattaatccgagtgatttggctcgtaggattggaggggtacaactcctttttatattagtatagatatagatatagatggtggtaatcaatacaaattgtactctgtttgcaaaacactatatcattattgttacttcactgtcttcctttaccatccttttaaatctgctgctacacttattcctgagtaaggcaggttatatagaagtaaaggccctatcttttcatatactctttcaaataaacaaaaatcatgggaaaccagctatcaggcaaacgtaaactacaatgcatagatagttgctgtgcgaaatactgcgggattttgaagtcatgtcaggaataacgaacacttgaacattcatactctgtacaatttacaatcatgaaagcctggttacctgactgtcatagcctcttcgcttcaagaagcaagagatgataattcaagtttgtaaaaaaaaaaattaatcctaccaacataatgaactatggcaactggtgcccttgtaggcatttcactagcaatccggaccaaacgtgatcaaattgatcaaacatatagcaattcaacaaagaagctaaacttttatctccgaatcgtttgtttcatagtgccaattcacactaagattccaactgtacatatagcaattaacaacaacacatttactcacttcgaaattactcatcgaatagataatatatatatatatacccctttcacttccatcatctaagaaaatatagatagctgtatacatacaagaagaagcagaagcagcaatggtggtcaagccgcggcggcggtgccttcctcctccttcttcttcttggcctcctctccctcctcctccttggccacatcgtcctccatctccgcggcgagggactcgagcagcacggacttagggttcaccatgggcgggcccttctccctcccctcgagctcgtcgagatcgaaggtgatgagcctgtcccagatccccccctcgaacagcaccccgaccttgccgtcggtgacgcgctgcacgatgccgcagtacatgtggtaggcgttgttggggttcttgacgagcaccaccatcccggggaggaacagcggcagctccggcgccctcggccgctccaccgtggcggcggcggcgagacctttcctgtgcgccggcttggggggaggcgggttcttggcgacgaagtccttgaggccgacctcgccgccggggaatccgccggtgaggcccatcatctccttgtcgaacgcgtccgggtccaccccggacgcagccggcggcggcggtggcgactccgcgggctcgtcggaagaagtggtggtggatggcggcgcggcgggggagtcggaggcgagctccttgcggatgccgacctcgccgttgcagagaccccggccgccgaggaggtcagcgacgcggaaggtcgccgagggagggggcaggcggacgatgcgggggtggtggtggtggggcagcggcggcgggcggaggaaggaggcgggggtggtgggcgccattggtggagcagagcggagcagaggatgtgtggaagtgacgaagcctttaaagcctaggtggatgaggaccgggggtggctaatgggcgactggtactgctatacggagtacagtatatacttaaagtactactagtactactaccactgtactactttaaactactactccctccgtttcataatataaattattctagcatttattacacgttaacatcaatatgaatatgaaaaatactagaatgacttacattgtaaaacggaggaagtagtagtaactggagtactactaactactactactaaggctgtgtttagatccaaagtttggatctaaacttcagtccttttctatcacatcaatctatcatacacacataacttttcagtcacatcatcttcaatttcaaccaaaatctaaactttactctagaataaacacagctaactagaactagtactagtactactagtactggtaactaggaccactacaccactactactgttattatatactactagtactatttaaaaaatatattttatatgtaaatatatacgcatatacaaaagtttatatataacgtataacaaagtttatgatatatatacaaactttatatatgttcattttaaaaaataaaaaaaaatagaggaaaaccatcacgtatataaattttatatatacactatacgcatatatataaactttatatacgtatgtatataaactttgtatactgtatatacaaactttatatatgtgatgttttttttttaaaaaaacaaagaaccgaagaaaacaaccataaaaaccggcgaaaaaaaaagaacgcgggcctcccactgtgcgcggccgccgcgccccctccccctcctacgcgcgccacgcgtccatccgcgcggggtgagggggcacgcgaccagtcgccaattaggaatttcggatgaggacctcgtgtttttcgactgaaaattttacatttaagcccctttttattttttttcataaataggcccctaaagttactatccgtaagaaatacttcctccgtaaaaaaaaacccaacctaagaggagatgtagtgtccagattcgttgtactgggaggggtcaaatcccctcttaggttggtttctttgggatggagagaatcacaaaataactcaatctagattcgttgtcttagaatatgtaacatcctatcctatattgagttattttgggacggagggagtagacgacgagcccaaatcacgtcaaatgtggtataagatcttcacagtctacctctcagccaactcatgtagtagttagctcttaactataaactatatggttcccatgtttctctcacatattttcttggttcctatgcctaagctagttttaagcataccactcgctttccctctctctctcctctctcatccacgttagcattcaaccttctaacggccttttattatacttgctcttacagtgaaaggtactactaaggctgtgttccctcacctctcgcacagaaaacagagcgatggattagtgcgtgattaattaagtattagctaaaaaaattaaaaataggttagtatgattttttaaagaagctttcctatagaaaatattttttaaaaaataccgattagcaatttggaaagtgtgcgcgcggaaaacgaggaggagaggatgggaataggcagtgccaaacacagcctaagaggaatctagtatgtcatatcggatgaggcttctttaaagattccagcaccacaagctaggccatcctcacaacgctgcttcccgccagattccaactctcttcctagctgctttttcatataggttccatcttcccacctgctttttttagctttttttcagaggaagcactcgtgtccatgcaaagcaccgagtatctatgccaaggtccgagggcccacaccttctcttctccacggcatcatacggcttagatggagcggcgaatccactcgacatcaaggcgcactggaacagcctcatgggaagagagatcgacattagtcttattggcgccgagccatttaacctaggggccagcctctaaaaagggctccagaaaaggattcatttctgaaaatagttttttaagatctatttatgaaaatagtctaaaagaaaagctaaattgtaaaaatttcagtgttcctcgagctcctctgctttatggtctttcatgggccagccccaaacacactaatcaaat

SEQ ID NO: 69514 - DNA, 831 bp, Oryza sativa
aggctagatagaaatggcggtccatattttgttggatatggcgatccaactttttgtttggttgggtgaatatgatgatacagttttttgtttggttgtagggatgaaggtggatttggtgatccaaatttttgtttggttggagggagtagggtgaatgagtaggtgtggtcacctctcacttagagagggtgagtataccccatcaaatttatatatactacgaatcacaaattccccaacaaatcacaaattatatatatactacaaatccacatagagaaaaaaggaaaaagaaaatgagaaaaaagaaaaaaaagaaaagaaggtctcgcaccccgtcgctgccgagctcgcctctcgctctggttgacctcgccttccaccgccgcgttcgcatctcgcgtcgccgccgacctcgcccctccccaccgccaccgctgacctcaccttccgcttccgctgcagtcgccgccgacctcgccttccgccgccaccgctcttgcctctcaacccatggctgtcgctgacgcacggtgagggggtgaagcgacccgcctcgggcgctcgccctgctcgctcgggtgctcaggcggctacatccgagcaaatcactcgaatccccccatccagcatctgagagatatattcctcttcgggccaccctatcccacttccgcccaccaaccaaacaggcaaaaaaaataggccgccatctcctatccacccaaaacctcccatccaaacacacccttagtatgttgtctcatcccgaatttgtgcactatattacatcaactaaaccggccgacacaaatttgggatgagaca

SEQ ID NO: 69515 - DNA, 1055 bp, Oryza sativa
taacaaaataaattacagattccgtcaggaaactgcgagacgaatttattaagcctaattaatccgatattagtaaatgtttactgtagcatcacattgtcaaatcatcgcgcaaataggcttaaaagattcgtctcgcaatttctatcagaactgtgtaattgtttttttttcatatttaatactccatgtatatgtccaaatatttaatgtgatggatgaaaagttttttttttcgactaaacaagccattagacaattatactataagtttactttactgccattgggcctaaaatacatgaccagcccacacaggacttaacccacacaaaaaaaaaaaacagtagcatcacgattcacgagcaatggatcaaaaacaagatgaaatattgaagaaagatagagcggagcttctgcaagctcaggcagagctctggtgccacacttttggctatctcaaatccatagcactcaggtgcgccgtagagcttggcatccccaacgccatccaccgcaatggaggctctgcttcactgcccgagctgcttggcactctccctctcgcggcaaacaaacgatcatgcttgcctcgcctcatgagattcctagtctctttcggaatcttcaaagaagacatctcaagggagggaacaacaacaacaacaagcgtgtatcagctcacaccggtatctcgcctccttgttgatggtattggcatgaacagcaacactgagcacacatgccaatcaacctatgtgctcgtgtgcgtctcacagcttcaagtaggggcatctttgtgcttgggaattggctcacgagcagcgatgagaacaccccatttggaatggcgcatggcatggatttctgggatttcaccggccatgatgccgagtatagcatgctgttcaacaaagggatggcgtccgacagccacttcgtggtgaacatagtcatccatgagtgcgccgaggtgtttgtgggggtaaggtcgctagttgatgtcggtggtaggaaggcgcgatggcgaaggcaattgctgatgcctttccaca

SEQ ID NO: 69516 - DNA, 8633 bp, Oryza sativa
ttaccgggcgattgattttagatttacggatgacggggacgtctcgctgcgttgcgtgtgggacccgatttagtcgctggctggtggggccaagccgtcggggaggagcagagggtgtctcagtcactggcgtgtggggcctgtcttaggtggggcctggttgtccgtgagtaggcatgtggggacacgcacgcatggggtggcagggaggaggggagtaaaactatgggatggatggggttgggaatttaggaggaatggatggggaatccaacgttgtttggtaccacagcagttgcagcagccaaatggtgggccccactgcctttataacaccgtaaaaaaaatctacacaactttatgtaatttctcttttttgcacatataggcatatagccattggtaagtttgttggttaattcgatactatgtgccattataaggcagtgttcaagtgggaaagataaagtgagaaaattccacgttttttgaactaatacatgatgtgtttttaataaaaagttataagaatgttactttcaaaagttatactcccccgtcgcataatataagggattttgagtttttacttgtaacgattgaccactcgtcttattcaaaattttttgaaattattttttattttatttgtgacttgctttattatctacagtattttaagcagaactttacgttttttatatttgcaaaaaaaatttgaataagacgagtggtcaaacattgcaataaaaaacttaaaatcccttatattgtgggacggagggagtattaatttatttttcaaatttaaaataatcaatacttaattaatcatacgctaatggcttatctcgagttatgtatcttctcaatcttttccatcctcttctctcaaacataatcttagtttatctgttttgaaaaatatcattactatttaactatatgtgattataatttagcaggaatttaagatgtacctctacttatcctcctttgatacatttttctagatttgttgttgattgcgactttattgtatgagcgaaatcagaagctgacttcatgttaataagactaatggtgacatgttaacttgttagtgcttttcccgatttcgtaagaatgaaaattacgaagggatcactatcaaatgggccttgaatcttgatttcaacaaagccggacgcgcccatatcatcggaggcaactaactaaagtagggaagatcagcccatagtagacaaaactgatgcgttgttgtgaaagtttagtaatccctccgtattttaatgtatgacgccgttgactttttgataaacgtttgacctttcgtcttattcaaaaaacttatataattattatttattttattgtaacttcatttatcatcaaatattctttaagtatgacataagtatttttatatttatataaaaaaataaataagacgaatggtcaaacgttgattaaaaagtcaacggcgtcatatattaaaatacggagggagtatatattaaccagctttgcatccctaagcctaactaagcaacatggacatgtcattatccttctctcgtctctgtacggagagactaggtgattttgtcaaggtagtgatatagcgcctattgattgacgtataatatacccgacttgtaccgactattatcttgtacaattgccgccaatttgttcggagcctcaaatatgatgcctatatacccctccgtactcgtaaaggaagtcgtttaagaccatgcttaaatcaaaccttaggaatataaatcatgaataactctcaagttgttgagtttgaaaatgtaaaaattatatgaatggatctgtcttgaaaaatactttcataaaagtatgcatatatcactttgcaataaatatttttatagaaataagaagtcaaagttgtgttttggagaccgtatcgctgtccaaaacgacttcctttataagtacggagggagtatatggtaagttactgcaattattatgttccattaatatctctcatagtttgtttgatgttttatcagccacaactaaaatttaaaatttaaagttaatcttagttgttttgggtttttttatcgtaatctactttgcagcattggtttttttataccatgaacaatgcaaaaaaaattgtcattgcttattagccatagcttaaccaatcacaacctaagcgaggatagttttgtatgaatttttgtgttggctagattctagagattaggtacaaaattcactactataaaaagttatttttatgcggtcaaaatccattttttccgtgcggtttggtcacccatctacccaaaagtgtctgaaaaattactattttttccatgcggatgcttatattgtccgcacacgaaaataaaaatcacgaaaagaattccaaaaatcccatcgtcgtcgccgccttcactatcgctatcaccgaggccaccatcgcccttccgtccgccggatctgccaccgctgctgtcggtgacatgggaccgggagtatcatgactagaggcttgggcagccgcggtcacccacgtggcctgaccccctcgggggggtcgggcccgagggagacgtggccaccccctcctctgtctccccgaggggtcgggccgctcctgtttcggccccgagggctggggcaccccgaccccctgtggtattggcgccacgtgtgtgggttaggtgggcacagcggtgctcaccaaaccacatttattgcggaatggacaagtgcgccacgccgcatttaatgcagcacggcgtacgcatatccggtccgtgaccggtcgcagtgtgtgaccggtcacagactggtcagatcgcgggttaggtggcagcaggcggcctgtcacacgcctcgccccgtcccgtcggaatgatgagagcctcttggcactcgtccctagctggagccggcgtggtaactcctggagttagcacgtcagtcccggctcgattcatgccaggcttcatcgcaaccattgcaaggaagtcactgtatgaagaagggcagatgtgcggcatgctaaactgaagcgtggtggagaagaatgaccggtctgtgactggactgacgccagtcacgtcatcggcagacagccgtgctcccacgttgcatctgtttccggcggagtggaggaaggtatgacccatcccatcggagggtcattcagacagcggccattgcagatttccgtccattaatgaagaaatgacagggtgatcccctgtgtccgacgagtgacggcgctgggcatcactcaaggacaagcggtgatttagcttccaggcggaggcgcgagtcgagatttggtcaagatagggtgggtccccacccaaaagaagagtaggtagaagtggtgcatgtggtatccccttgagatataaaaggaggaccttgcccacaaagaaagggggacgactctaagaagacttgagcttggggaggagatcgagagaaaaaagaaccagaagagaaggaaaaagaggggttctagagcttgaactctcttgctctccggctctctgtaactctttctcacacatatccaccagaacacaggagtagggtattacgcttctcagcggcccgaacctgtctacatcacccgtgtctcgtgcgtttgctctctcgcgtatattccacagatcgagggtgaagaacctcactcagcgcccccggccgaaccggcaaaggggggcctgcgcggtctcccggtgaggagccccacgctccgtcagctgccgtccctacttactcaaatataataaaccaatggatagtaggaaccaatggatagtagggtagcgtggataaagatttttgtctcaaatataataacttagtaggggtagtattttataaaagattgtttttactgctaaattatacacgctacccctactatccattggtttattatagtcctaattagtccgggtttatacaccacccatccatagaagataactaagtttatttaaccatgtcctgtctaaccatgttgaaggataaagcttggctatattttagaatagagagaataggtaaaatcattatttatatatttatttggctgataaattttgattgaacattaaaaaaactttaaaattaataaatatgatttttaaagcaattttcttataattcgttttttcacaaaacacgttgtttagtggcttcgaaatcttgcacgggaaaaacaatgaaggtaaagttaggatcgttgacttaaggaaacagtctaatgatagaactaagggaaaagtgcaccgaaggtccctcaacttgtcatcgaattacaaaatcgttctctaaccacaaaaccagatatataacatcccttaacttacaaaactgttcgctttacatattttgatggttttgactctacttttgtctgacatggcaggtgagtcagcgtgagacccacgtgggccccaaatgtcagtacgccacgtcgtcgggttctttccttcccctcctctccctttctcacactcatctccctggccggcagcaggccagctgtggggaggaggtcgcgggacgaggaggtccgacggccggccggcgatgcggcggcgggagcacgggggagatcgagcacggcggcgggcagagtggggcgacggcgaggcggagcggcaccgcacgaagccggctcatgtctgccatagcgtcgacgaacgacgccgtcgtcgcgaggaaggaggaggcggggggaagcgggcggcggtggaggagctccggcgtcgctttgaccgcgggcgctacgagctgcgtcggcggcggtcggaggtcgctgcggcaatggaggagctgcgcgcgtcctcctcctcctcgaacctgtcgccgccgtcgtcgtcgtcgtccgcgggcgccccaccccgctccgtgccgcgggtttcgtgcgccaccgccttgccggccctctccgcctgccgccgcctcggtgtcggttcccaaatcatggcgcaactgaggttcgcggtactggctgttccgtcgtcaatagcgagcctaacaaggtggcggcgtggccggttggaggacgaactctggttggagggcgccatcagatgcgggccgcttcggctcgatgaggcgctctggagcagattatctatcttgtcggtaatctagtggctgcatctgattgcatcgactgttcaatctgattacttcgtgtatttcccctaactctctcttaattatttttctttcgtcagagcagatagtagtgccaagccatgaaaattactagatcaacatacaaaattgtgcttcaatagaattttaactaggatgatttcttgattttgttgtagacacagcccttctcatatggatcaataggcaacatgactacatgaatcaaccatccctttaaaaaagtactgcatgagtgaagtcacatatcgctgctttcgagttggagaacaaatctcgccgtcgccgacgcgtacacctcccggctcatgatcacccatgacgtcgacggcggcggaggaggaggaggcgccattcgagctcgctcagacgacgccgtacggctgcttggtgcgtcgccatcgccagcccgcgcaccgccgacttctacggtctctacacctcgcgcacagcctccaggacgagtccggcggcgctgtgccacgacggggcaacgaggatgcggacggcggtgtttcctccgccggccgccgtacctcctcctctccccacggcggcctcctccccacagcgccgcccgtcgccggcctgagtaaagagagagcgcgagaaagatcgaagaggggaaataagagagaggtgatgaggtggcatcttacacgtgggtactacgatcagccgtcatgtcagacaaaaccggggtgaaaaccgagcatgttgtgattgagggacgattttgtaacttgatgataagttgagggaccttcggtgtactttttcctagaactaaaggatagaacctgcatacatgatcgttgtgggccaaaaggcccaatatgttggggttctccatcgtatatatggcccaatgaagagagtgcaatgaatgctgctcgatctggccttccggcctgtcagtagtcagtacctgcactccttaattttcatcaggtttcaatgcactaaagaaaatggtacacgtaattaagatttcttacaaacctttttatcaacagtcactcaaacatgctactcctaactaggagtagttaattagatagatcccaatttattactcccctcgccttcgcagtacatatcacttagtgtatcttattcacctccatcggtagcccacattatgtaataagtccaaacggtttattagagcaagaaaaataatttgcatgtaagatttttatatatactccctccctcgtatagaaaaaaaacgtcgttctagccacaacctcgtttgcgatttaaccgacgttctgaaccgcagcaggctatgtggccggaatgaccctcgtctattcgatacccgctcccgcaattaatccgcagcacgcccgcgctcgcctcatttaattccttaagcgtcgcatgcaggcatgcagcacgccgctcaacctcgccgccgccgcttgcgtcaagctcgccggccctgctctcgtcgctctcgccgccgctgccacttgcgtcgcgctcgccggccgcactctcgtcacgctcgccgccgctgctctcgtcgcactcgccaccaccgccgcttgcatcgtgctcgccggccccgctctcgtcgcggtcgccgccgccgtcgcgccgctcgttgcgcccgctcacctcgtttctattcttaagccacacgacgctcgccgctcacactcacgctcgccgccgccgctctcgtcgcgctcaccgctcacgctcgcaaagccatggaggtggtgccagactcgaagatggaggtagcgctggtcttgtcggaggtgttgccggactcggagatgttgcttccaccggacttcgcctcgtcggagttggcactgccagacgcagagatggcgccggactcggagatggtgccggactctttgccgccggactcggagatggtgccggattccttgccgccgggcgcttttctatgcgctcgctgccatctcgtccatgaggaccgccaagcatggaatcgtgcgcactcgtcactgtggccgtgctctcgctgcggtctcgtccacgcggaatacataatcggtgccatgatttacggcctcgacgagttcgactgcgagcttttcattcccgatctagacaatgttgtgatgcacggcaatagtatcgagttacctacacacgtgctcaagatgctcgacgagaagcgcgaacatgagctcgctgctggaaaggatgatgccaaagcaacggtaagataacacaactaatcgcattacaatgatgtctctattaattgagtgcataagctaactagctagcttcattctaaatgtttgatgcagcaagagtagcctcggcttcatctagcaaagatggttgacaatggatagaagttggtagccgatcttctctttctaatgttccttttttcatgtgaggaatcttgaagttgttgcttcctttcaccttcatagcttccttcaaaacactttgaagtgttagaaacattcggtttgctttgtgtggagaatactccatgaatgcctacaaaacaagtgtgcaagaaatgaatcaatgagaatattgcatgttaaagaagatgaaaaatgtgtgaacatttcgatcaatttacctcttgaaccgttggaattagtgcctctactgtttttgcattcttcttgtattgaattgcttgaatggcttaaaaaaaacccaagtcaagaatgttgaaatccgtagaattgggtggttgacaaattaggcgaatatcaaatccttcttgcttaccagcctcacaaaacaacagatcatccaattttaaatgggaaggtgcattatcctgttgaatgaagattggtttgcccgcatcttctcttggccgtttggctctaatggcaggcaacactttgttgatcatgaaatctctaatcacgtctcttgtgatcgaagttatgggcttcataaccaagtctccacggacacggccggttctctcattacctcttctagccggttcataagtaacaagtggaaaacaaccaatcttaccatcaaaaatgcaattcccatccctaaaccttggccgagcacaaacacacaagaacatgagcctagggatgtaattcttgttcttacaagtccgatggggatcatcttctttgggcaacaaataatatttttcagattttttatggaggtagaaccatttttcatcgatgaacacaaagtcaaaaaaaatccttaaaccttggatcaacaagcaaacccctcctaatcatgtcaacacaccactttaacctagacttcttgttagcttcggtgaaatatggtttgatgctactagagtggcgcctaagcaaaccttttttcaaatacctttgtatcctccatttgctcatgtttaatttactacacacatcttctatggtcattctatccttgataggaatgttacgcaattg

SEQ ID NO: 69517 - DNA, 2230 bp, Oryza sativa
ctcgaatacttgactgagattgttaggaaaaataaatgaatgtaaggtaaaactagcgcactgccagcttggccaatggtgaagaaggtaaattcataaaaaaactggtaccacatttaaatatttaatatgtattgttattatatattggtcctaaggaaaataaaaaggaaacaaatattgcaactgcgtcatttatttttggactcagtgagctgcaaactgcaaaccatactagtgtggcataatctggactgttgccaatcaagcgaaacctcatttcttctgcacacaggaaagagcagtcttggattctttttccttatggaatatggatgaaattgcaaagtcgttggacctaacaagacaatattcgaattcacccatcaattacatgtctctaacattctttatcttttcctaatgtacttcggcaaatgagatgtgaatttttaataaacctgctttgtacaggacaaaggcctatgttaagaaagatatgctactccgtgtgaagagacgggatgtttcgaacgaatcatttatattggttagtgttgtagcgagcattaagacatgtcctctttctttcatcatggtgaaaatctcaactagctggccgcctggataaattacttctcattgttgcaggttagtcagcgtatctgccaaataactagcgaattcagcaatcagctgtaaatgaaatgccccacgtgcaacattaaccaacgaaacctaaccgaaaccaacgaaccactacatatttctagagctcaaacgaaaaggagtaactaaatatagggaaaacaactagaccaaaaatgtcgcctcgcattctgaagcgagcaaactagccagcaacaattgacacaaagcgtgcattgacttgacgagaattcgacctctcacaattccgtggaaccacagccctaactaggggggtgagacgaacatcccgccccccactacgatctcaaaggctacaccgctacactccaccgcggctcaaccacgccgcaagggagacagcgatttcgcacgaaacatttcatagcgcgagcggcggagatcgaggggaagtttcgcttacccgtaggtgccctcgccgatcttgcggatgcgcctgaagcagtcgacggtgcgggccccggcgggggcgtagtcggccaggttgagcgctcccggcggcgcctcctccccgtccatcacgcggcgggcggcggaatcaacggcgagggcggcggcggcggcggcgacggcgaaggctaggctaggcaggcagcggagcggaggagtagcggcggacccggaggaaacgagtcaaaagcggctgactttttctttcttccgctcttgggcttgggacgcaacgccgtctcgaagaaggattgtctggttgtgggctttatttgggccgagtgggcttcatctcagaaagtcagtgggtttgggccggaggaagacttctgccctctttggatgtctttacaatctgttgtagagaaaaaaaagagagagtatattttgattccctcaactatggccgggtctgatttattccctcgacagtaagagcctgtttggctgtttggttatttggtactccatccgtcccattttaagtgtaaccataagtttctatatccaattttaatcgttcatcttatttaaatttttttctaattaacatgaataatactttatgcgtgacttatgtttttaattttttttaaataagacggatgattaaagttgggcatggaaaattatggttgcacttaaaatgggacagagggagtagaactcttaatttcaaaagttaggtgttgtgaagcagccaaaacgcagctccacctccctagtttattttgtgataacacttcagctagctccacttctattttggatggagctgaaactgtttggatgggctccagcttcagaagaggtggagctagagccagaggtctaccaaataggccctaaaaccattgtaaattggatctcaacaattttgcaacctgattttataccatactactatactatgtggcatccacaatgacccatgtggaaattgacaaggacccatgtggaattgaccacctttatttcttccttcaactatactactctatcctctctcttcttctttccaacaggctcgctatcgtcctacttggcggttaccatgccttgtggtttcatcggcaattgattgttggtt

SEQ ID NO: 69518 - DNA, 5588 bp, Oryza sativa
acatggctaaaatgcacttaaatatttgcctatgaaaaaagtacaacaacatgtagtcaaattaaggtgcttaatttgatactatcgacaccttaatgatctgctaacacacttgtaatcctaaaatataactatttcctagctacattttaaaacaagggaccatatatttatatttacagagaaatttatcactaatacaccaatcgtgtctacgtagcatatttatttttccacatgtggtggttaacctcaatcatttatcgtatatagcaactaaatattatggcttgtccatgatactctagcaccaataattcatcaagtataaccattcaagaacatggttaaggaatgaaatttagttggctgcttgatgcttttttaggccattttaagaggataataaaaaaaagttcctttacgatgcaccatactactagtgatctaacgattaagatctattctatactaaaaattccatacctatagtatgggttatatatatcactagtatgaccattgaccagtataggtatattatggataaagaaagaaatggcatatatgtattttgttatgtacacctaaggtttgcccttgaactcgatctatcccaacatctccagcaaaggctcccacttcaaagtccccaaagattaaatggaggctacccctatttggtgaggcctcaaataatgactccattccagcagtagccactatttcttatcctctatatttttttttctcttctattttgacatatactccatatttactccatgcttcacaccacaatgattcaaacatagatatttctaatgcataaaattcactatatcaaatccacaaattcaaacaccaaaattgaaatttaaattccgaagtttctcttcatgttgctggcaactacgtcaacacattcttcatcatgaatctccgttgtttctaccctacccgattcatcaacaaacacatcaaccttacatcaatctttgtggtctgaggtaggcactgcgatctgtcaaccaccttgcactacactgccaaagttcgtctgagactctgaagaagttcgaaatttattattggaacctcctgaagacctttgcagcctgaacataaacatacctagtatagccaccagatgcaaaaacatcttggttgttctagatattgttcaaccatgcgttgctacggaaaactgttgctacggaaaactaatactccctccgtttcgaaatgtttgatgccgttgactttttagcacatgtttgaccgttcgtcttattcaaaaaatttaagtaattattaattcttttcctatcatttgattcattgttaaatatatttttatgtagacatataattttacatatttcaaaaaagtttttgaataagacgaatggtcaaacatgtgctaaaaagtcaacggtgtcaaacatttcgaaacggagggagtattatgataaacaatcgagcagagttcaactttcagcatccaagtgctttaagaaaatattctccatgctgcgagcgaatacaatctcgtgtcaagatacagacaccaggcaatttttcatttcaaaacaacctatttcacgttataccaggtaaattatcctcgttccaaatggccccactggaatttattttttgtatgttccaaaggagcccttaagtcgctagcatatacttccatcttcatcgactgtggatcagggttttgctttctatttaaaaaacacaaccaaattttgataaaaataaaagtataaaatgattgaattattattaaccggtactccgacatgttttccgagtcaaaattaaatcggcgtgtttttacgaggaaagagatcgattagctttcggtaattaattacgaaccgagtcgagtaggtttttgcacactccgatcgatcgacggcctctgtcgagttatcaaaaccggcggcatcgtcgtcttctccccccatcgatcgatccatcgactcaagtctcaagtctcaagtgatctttttagctagctaattaattttttttagataatactctctccatctatttttgatagtcatatttctaaatctgaaaaatctatttttgataggcatatttcaatccaacaacctatcatcttaatgattttctcggatttaatgcatgactctccattcttccatacaagattggttgcatggacatcgagaaatgtaaatattaatgaatcgcttgtttacgaggaatgactagtagcatgtttaaatgaatgataagtaaaatcacttatcattgttctgtgtgtcaagataaaatatgactataaaaaaaaagtagatggagggagtactagctagctagctatagttaataagtagtcatgatgatgcgcgcggtggcgacgtccctttgcatgctgcgcgccgccgccacggtctgcgccgccttggccacccgcgccgccgtgcgcttcggccgccgcctcgccgtcggctccgtcaccggcgggatcacgctctccgacatcctgctctacatcaccatgacggaggaggacctctcgccggacccggagccgacagccacgtactacgataagcttccgacaaagcgagcgctcgccgccggcgacgtgcaggcttgaggcggccggcgacgtacggtcaagctgccacatgtctgagagatattatttgacttgtactaatacgtgcgagtgatagtctcagtaattaataagggtagtgggttactcgtcctaaccggagaccacctcatcccgtatataattctcccttagttaatgatgtgtgtcttttttttaatctctttagtgatgacttatatcttttatatattttgaatcacatattagttttaagattaatttgcatcattgtactctactcaaaatatgtgacaaaacgagacccatgttggatatattcaaatatttcattgatccaaaagtaatttatttaaattatggaagtaacttagatatgcaatagaagtaactctatatagcattacaaataattacattacgactgagttgatgtaagaaactatatggaataaattcatcaactatatggaataaattcacaagcaaagtgttcagaagatttttaagtaaatatatttatgaaagtaaattcaataaagtcagaaagtaatttatataaatcataaaagtaaattagcacaaaatggaagtaagttgttacaacattagatataaatccgttatagggacaaaaattaaatttaatcagcataaattatgaaattaactaaaaacaataaaaacaataatagcaaattaactaaaaacaataaaaacaataatagcagtaatcaactcagagctttacttatgtgaacctaattaatagtctgtaaacatatgaggtataaaatgaccattataaaagcaaacagagtctgcattagttaaacagattgagattatgcatggttggaacaacagatacctattagtgttatcttatatttgaacccaatatcttggaagcaaggcagtaacatgagctatatatgcacagcagagagacaaataagaaggatttgagcaaatttccatagagcagaaaatgattcactcgttgcaacaatttgtctcaaggacatgaatataagaatgttagatctctatcataccttgggtacgatctggtcagaaatctgcatacttgttaacaaccaaatttcgtaaattctatcattattggcatcggagatgaagatcagatcgaagtggaatccaagatgaagatcgttgcggaaacagagtaagaatcggctgcagtccaaatcggctaaggttaggtcgacagagttcgagtcggacggggctagccgatacagccgattagccgatacagccgattccgataatatgactcggtgtacgtcatcgggttcaagttgatgtgcttcaagatgattgccacgcatggatagagtcctgggaaggcaattgtatctattaattaggatattctatgtaatttctttagagatatgtttgggcaaaagtctgccgtaaagacttatggtatcttagagtttgttagagataatagtcgtgtctgttatggacgtatcttgtaattctcgggtataaatagacccgagccctatgtaaaaaagaacaacacatccaatacaatctcgacgcatcgccacactttatgctttacttttatttcgacgagttcgtgctctcgggttgagctgcatcggtttcaatcttcaacaagaggtaaaacttgtcatgacgacttatgttctcaagattagtgcttccatctttatgacactctaatcttgtctatataattcgtcgagttatcatatatctcacataatctttgataatatcttcgtctaacctataatcggctaacatctgttaatggaaggcagccgattaggttagataatgatgttaacttagactatgtgatatatctaccactctatgaaacttccaacggcttgattgtctagatattgtttttcttttcatacttaatgctgcatcagttgagtttgatctattaagtcgtgcttagaattgcaatctctagcctgctttctggttgcttatcagggtagtatcggagtttcagccaatcttatctgattcaactacttttattctatatgcttgattgacatgttaaatctgccctttatgttaagatcttgtcgcatctaagtatattaagcttatgtttagtatattctacttactgtaaaataaaatcttagtatagagtagtatcggagtattagccgatacatgctagatatacctgatcggctatgctatgaatgtatataatcctactattaatatatatttcgatctaagtgatttatattgtctcggcaaggcgaccgatctatcccaatcatttaatttaagtatatatcgatataaggattatatatcattaatatctacagccgatcgagtagatttagttctggtttgcttattgatatttgtcgatcgatgtacacatgacaccggcttgaaataaatgatatgtcatcggcacctagccgatcggctatcatttataggattaattgcggtttctttgttatttcttgttgattgcaagatcaaatcaactggcacgctcatacatctaaaggcgagctttggacctgcactggagttaagcagatctcccaggcctcgtgttttctgtcaacaatactataaagacatttgccccttaaattaaataaatacattcagatattatgagaaaaacaattgtgcagagatataaaattgtgctaaaagcagcaattaccacccatatgaacgtaccagcaaagcgcatcatatcatcaaccaaaaataccgttcttcttaccactttcttactggataactgaaacatttggtgcatatctaagatcaaatatgccgtaggccatgaccagcctggtgattacatggtgcagtattttacaaaataatatcattgatcttacattagccacccatgagcaagaagaaaaaggcaagattggga

SEQ ID NO: 69519 - DNA, 3272 bp, Oryza sativa
aaaaaaaaactcaaacaagacagcctaaatgcctaactgattgcaaaacaattctactggacaacacagataactaaggatgttaataataatcaacaaagattgatatctcagatcttcgattatgtacaccttgaaaggacctttcatcacttgcaggaagtaattgttcttcacactggtttgtataaaacagtgaaaaaaaacttatgcaaagaatgaatcaagttattaatcagattttgatatctacaaaggcatggtttcagtcttcaaaactttaaacataacaggaagttctgagacagcacacagcaaaaacagagaaaaaaagttgcatatatcaattgcaactataataagcatccataaaacacatattttcagcttttttactgtgaacaatgtttggacttcgagagtaacattagtagtacatatccataaccaagttcttctaatggagtctatcactcatgactaaagtaattagcttgctcacttcaagcaaatagaagaaacgatgacaaaaggtgcatacgcaatattatctaacaaccaccatcaaacaaaatacatatgctttacctcataagttacagcccatttcccatggcgtagcggcctgtgatggatgttgatattccctatgtagaagcttctgccactttgtaccttgttgacttcagttattattgaatcaagtctgacaaaagtatcatcatcgcacttcattacatacctagcagagacaacatgaacctgagcagacaagtcaaccagtcagaaaatacgaaaataacagctacagtttatagatcattaaataagaatcagtttgagcaagaaaattgttggcataccccatattcacatattgcaagagtcttcaaaacaactaaatcatagttgtccaggaacggcacaaaaacgatgtccccaaaaaattctgcttcctttttcaactccacattcacttcctttctgccatgctggaataaagaaagttcatcagctcaggtttacggaagacatgaagcaaggaaatctatcaagttaattctcaagaattaccagtgcaacaaagaaacgagctaccacatttggtgagtttctgacagcagacatccatgtcttcctcacacccatacgctcagcaaaatgattgccagatgacaggatgccaatgaaaatgtcaacaggttcgttaggcagaggagacgactgccaaacagttgacatatccaggtaactctgtggtgaaaagcttgggtgtgttgtgggtaaagaccccgcaaacactgattgcacatcaaggtccccactcaatgctaaacctgtagcatcctcaagaacaaatccctgcaggagccaaagcaaaacaaaaataaacttaaggcaactgttgcccagcactgatgtttgaactaccgtaaatcatagtgttctatcattcattatgcaagtcattcaccacaatttcgatcttggacacaagataaatggaggaacaaatgtacttacaggacggtatggaaaagaagtcacatgtcgcccgtcgacgttcacatggtacccctccaacccagcgctgatagtaagaacaaacaatcggccctccacaaaaggataaggccaatcaaaattcatctccttcttctgtccgatcagccggttcagccaggttgtcgtcgattccttggaccgttcatccgcgttcagaatccagttctcacacttcacgaacccatccactgcacaaaaaattattcactcgatcaacaaatttccacagaattcacctgaactaacataatcaaaatggaattgcaggggtccccaaccggtctcctcatcagagttggacttccagccctcacagcggagcggggtgccccactgcattcggtagcaggtgttctgctcaatcaccggcttgccgctccagtcgccgcggaggcgtgggttgaagtggaggatgcgcggcgggtcctcgccgtcgacggtctttagcccctgaagctccatcatgaactgcgacaccatgatcggctgctccccctccttcagcacggcgatcttagggtcaccctcggcgtgcgccggccgtggcgtcgcgaccacggtgatgtgggaccccagcgtcagcccgcacgggagctccaccacgcggcccctcccatggaactcgtcggcggagcgcatgaccgactgcgggcacttggccgcctccgcctccccctcggcggacggcgactcgaaggcggcggtgtcgaggtcctcgagttccgcgaacacgcgggcgcccgtctcgacggcgccggcaatcgggcggcggagcgggccggcgcgggacgagttgaggaggccgaggtcgagaccagagaccatccccgagaggcgccgccctcgtgcggagggccccgagaccgacgcggacgccgccaggcggggctccttcgccgggcgcgccggggccgcccgcaccccgcccccgccagccgcagatacctcgcgccaccaccacctccccctccacctcccccaccacccgacagagacgtcgacacgagcggcgactcgaggacgaacacgagcaccgcgtacaggacgagcaccgcggcgagcacctcgatcgcgcgccggcggcacgacgcccccgccgccgccgacgccgacgccgacgaaggcctccgcattgcgccgcctcccaccctaggcctaccccgacgcagcgcgcgggcgcgggcgcggcggaagtgggccgtgcactggcttcgcaggaggaggaggaggaggcgagggccaatggcgatatgggggaagaagaggaagaagaggagcgcctcgagtaattaattaacaccctaatccgttaattaacataatctaaatcacattcctttggccaaaaggttgagattactttttgaaaaaaaaaaagaaaaaacacaatttgtttactactgcggtggcgcagagcgcgtgaagggaatgtaattaggaatgtaattagcgggggatttccggactcgtccgtagactcggtgcatgaggattccggagaagatgcggaagtggggcccacgtgtcagtgggtagtcctcgtacacccggtccatggagggcgcggagagagaggcggggggacacgtggatcgagatgggccaggtggtgtcagtctgactgttgtttcagggggtgacgtggatcctctgtggtgggggacggtgtggtccaatttggaggtggtttgaccataggtaaactc

SEQ ID NO: 69520 - DNA, 32916 bp, Oryza sativa
  unsure (1)..(32916): unsure at all n locations
cgaatctaacgaggtatattaatccatgatttgctaccgtgatgctacagtaatcagccgctaattatggattaatatacatcattagattcgtctcgcaaaatagcctaggggttatggaatcggttttgtcggtaatatacgtttaataatcctaaatagtaagattcttgagggctatttaatagcccgaaggatccaaacaaggccattgtgttgcgtgtgcagtgacatgtaatcgggaaaaaaaatttaagactaaaattttgaactagtagtatgaagctacagtgccttcttcctgcagctagctactacctccgttccaaaataagtgcagtcatggatatccatgcccagcgtttaaccatccatcttatttcaaaaaattgtgaaaaatttgaaaatatttagtcacatataaagtatcattcatgttttatcatctaatagcaataaaaatactaatcataaaaaaattttaaataagacgaatggtcaaatgttgaatgtgaatagtgtaaaactgcacttattttgggacagagggagtagatgcaatggcagagatgatctcgcattaactaacttcccccctccatggatcgatctcatctaccccctcttcccctcccatttattgcaaccccatgtcgatcgccatggcagcagcagcagcaacgaaccacttgctcccgccattaatcgcttcctccaactccccatcgtctctcctcctcccctttaaaccccctctcctctcgcctcccgctccaccaccatcgatcgatctccacctcgccggagttgagagagacgacgctgcagggatcgagatcgagatcagagaggttggcaatggcggcgcgcgtggcggttgtcctcctgctactgttcggcctcgccgccgtggcggtgacggcggcgaggatcatgcccgacgacgactgcggcgacacggcgaacgccgccggcgccgccggcgtgggggaagccaagacggcgttcggcgggagcgacggccgcggggggctcttcggcgggtacaccggcccgctcggcggcggcgccgccgggttcggccccttcggcgggttcggcgccggcggcgggccgttcggcgggttcggcggcggagttggcctcggcggcggcggcggaggattccggccgtaagacgatgactcgtaggacgacgtgtgcgcatgcgtatagtagtatagtgcaattaatgtgattccacgtgtataacgttgtgggttaattgtgccacgtcagatatatgtactaatgtacggtgagatgtatctaccgtacgctggagtttgtacggctatcgttgattagagatttctcttgtgttgcttaagtgtttgtgtgtgtgttcattgagttgttttgtgttgtaatttgctaaactttcaagtgcttatctatgattgacagaggtaagattcatgtggctgactatttgggcccaccagtcagccagtggaagggctgatggttgggctcagccaattgaatgttgacacgtaagcagatgcagcctcctaagtcatacctccgtgttcaacttatatgcaaaatttgccacgggacacgcaaaaaatgtgtaattggctggaagacaccacgaaaacgttatacggctgatggacactaaaaaaatgtgaaatttgctgtagaacaccggtcgcattattttattatttccggtcaaaagaggtgagatatttttctaagtgtccagattacccttctctttccttccttttctcctactctttccttcttttccccttcttgttgatttcgctgggaacggcatagcaacctcaaagcagcagtggggcgaggtcggcgcggcgtggtgtggcatcaccagcggccggggcggtcaacggcatgggcgaccatggaggcgcggtgttcgaccagatcgatagcgggcaggcgacgacactgctggtgcagcggggcgcggccgggaggcagcaccaagcgcaggcggggaggctacgattggtcccggcgtcaccactgctacgatggccagtgccctcgctcccttcggtgcgcttgatgagtgccgacgacggcggcgggttcagatcggcgccgacgaagaaggggtgtgatctccctctccggtgcaccatttttcggggtccttgaggggagatggagaggaggatgaagcgaagatgctggtgcaacagcttggcccggcttggtccagataagtgggaacggcgataatgttgctgcgcggtgcacagagcgcgctccagagctccggtgggcacgacagcgttcccgtcgattggctacacgaatcgagaggttgtcaaagcaagatttgattggcatggagagaagataatagaacatgaattagataggaacggagacggctcgttggtgatcggcagtgtcctccttctcagcggctgacaacgaaagataggtggagagggagagctggagctctcttcctaggttcgctctgtgtggaaatgaagtggagtagatggcgatgcagcagggacgagatgaagacttgcctcggcattttgaggcattgacacgtcgtgcacacgcgtcgaactcagccgacgccgatctctctctcggttgtctctggtcgatctctctcacgtcgcgtgctagctcatgtcgcttggcccaacctcccccaaacacgacgagctgaggaggctattctccaggttcggcaagatcgagagggaaaagaagataagggcaaaactatcattttacgttgtttctctctcatcaattgaccgagtattatattttaatgtgtccagtgttctgcagcaaattatcacatttttggagtgtctttgggcaaattcacgtctttagggtgttccagctaattacacattttttttgagtgtcctgtagcaaattttaccaacttatatatacatcatctgtgccataaaaaatcaatatgtgtagattcattatactaaaatgtgttaaattacatatactgtgccataaaaaactaacatgtcaagattcgttatagaatgtgtcacgtccgatcctaagttgttattttgggacgaagggagtacatcacagtaatgtataaaatttactgcaagtaccgtgtatgacatgactttagatgagatgtttgatattttaacatttcataaagcgggtttcgattatttaacatagtaggcatagataaaaggagacaatctaaattgataaatcctgacggatttaattagtatatatttgtataagttcatctcatagtgttatatgtatttttctttaatttttccctctcatacatgctagcttttcctttcactaaaaacaaaaggaaaagagggataacctaatatttcctcagattatttcttccttggaggagactgttaatttctaccgcctcagttaattgctctcaacttggagcttaactctgagcatatgttgaggtattgaagctgtgggccagaaagcctcttcagatccatcaggtaattcccttccccttctgacttgtacagctacaataagcacaagaggtaaaatttttatcatgggtaaaaaaaaattaaaggaacggttaaacacatgtttttttttgcaagtattaagatttggagggagtaataattgtcaaggggagaaacactatcagtctcattgtttggcttattcgaggaacaagccaaatgatatatttaaaaatgaaaaatatttttttaataaagttcttatatacatgttcttaacgatataaatgaaaagactaaaaaataaactacgatgaaaaactttaaaatcacctctaaatttaaagttaaatatttaaactttaactgataaatataaatataagcgaaaagatgaggttacgagagtgtatgaatgatgcgcttgaggagaatacctgaatttcaaagaacacagccgcagacaagctctcgaggacagcatcatcgacgggagctccaccgccatggccagcctcacctctgccactgccaccaccggcggaggaggaagaggagggcgcgtcgtcggtggcggcgaggtagctgcggatgatgcggcggacgccggcggcgccggcgaagcgtgcgcagagcagcttgccgtagcggccgcggtcgtcgtcgtcgtgcgcgtagacgacgccggtctcgcgcagcgccgccgcgatggcgcgcatcgcctcgcgggggcactcgtggaactccacccctcccagcgcccatccgttgttgcgtccgtcgtcttctccggcgacggcgaccggcggctctccggcagcactgctgccagttgcttctgctgctccctgtccagagcaaataggtgtatgatggtgttgaatcagttgatccaatacagtgttagattttttaaaaaaaaggaaaatccactttgtttagtacaaagaaatttcttgatcattattgtgcaaataaaacatttttgtctataaacattactccaggttgattatacttattgttttggataagagtattgtcaaactttaaaaacttttaattataaataacatctaaaatgtttgtcttagaaatgtggtgaccatatatatagattggtcttaaaagtgctccaacaaaatcatatatttatctatacatattttaatagaaaatagtggtcaatgttgttttttttgaagaccgtatactttttaaaacgataggtattatcagtctagatggatggagtactgaattagaaattattcaacattaattctagattggtaaaattgaacatcgtgaatatacttttatgtgctcaaataagaattttatggaaaacttttactgtcatactcaaaagaaaacaatccaccagagtcatatgtttgaactttgaagtgcatgtccaattgcacatatccaagatatttgtccttggacatgggaattttagtattgccatgaatgaagatttattttctgcagaactagttagtttctatacgtaccgtggtgttactttgtccagcttcttgatagacgtcaattgtccaaacataacgtgttggggcatcgaacttcttattgaggatcaggttgtaggcgaccgtcgcctacaaacaaatccatacatgcatattttgaaccacaagtgaattgcaattgcatcgatccatctgtatgtatatgttgccaacatgtcatgagtggcatgtcattaacctttctatgtaccaatactcttatagttgttactttcaaaatgtatgatgacgttgacttttcacaaagtttgaccattcatcttattcatttatttttgttatgatttgttttattatcaaataaaatacaatcataacatataattttatatatgcatactaaatttgtgaataaaacgaatggttaaacgttatgcgaaaagttaatggcgtcatatattttaaaaatgaggtagtacattacatacctcgttttcgactctgttctcaagtgattcaaccaagtacctcctttcaaagccatggccgactaccttgtcgacagtctcagcatcaatctagcacaagatataaacacaattaatcaaaaaaatgcgtaatcaattaaaattaagcacccaaatagcacataattaatcaaaagtaattaattaagcaacacttgccctggtgatctgtgtgcgagcgttgagaggaggcattgcgaggtagcgagggatggagtgctgcagccaacggtgcgtcctgacctcggtgatggtgaggcgcttgtcaggtctcacgatcagcatgctggagatgagatccctcgcgtcgtcaggcacgtacggtgggatactgaactctcctctctgcaacgcaatacgaagagaggaagaagaaaaaaacagatcagctgtttctcaatctcattgggattttcagttttgaccactgataacttcttcttccatttgcttgtctacagttgttcagcagctgaataatatatttttttgtcatatgttttacagttggaattttataccttcttttatttgctggtctagagtaattcagctgaataatatatttttttcagatgttttacaattcacagtttataacttcttattataccgtatttgttggccggtctacagtcattcggtcgaataatttattgtcagctgttttacaattgacattttagtatccatgatgttgaacttctaattcagatttttttttagataagggtatttttttacccggcctctatatccaaccggatatatacggccattgaaatagggaacttagccccgaaaacaacccaatctgaaattcgctccatagaagatttgaactcaggaccttggggtactactcaggtcactgtaactactaggctatatactacaagatttgaactcaggaacttctaattcagataacttcatatacgttgtttatgtttatatcaaagtcattctttttgttaatattaacacggttaattagatattgtaactattgtgattagaattcgaagagtaatttcctaccttgatgatcctgtgcagctctgatacatcggcgctgtcaaagggcaagcgtccacagaagaggatgtaaaggattactccacagctccaaacatccacaggtggaccaacatattttctacccgcgagtagctacaatacaaattacaataagcaacataaacatctcacatatgaatttcaatacattccccaagttactatatgatcgacgacgacatgtaactccttttttttaacacttaaatttcttctaattactaggcgtattgacattgaactatgtattctctccggtccgttccaaaatataagcatttccgtctatgtattttggaatggttaggaatatttcatatgagaaaaagaatatttgtgaatttgtggctgacctcgggagcggcatattctcggcttccgcatgacgcgctgagcaccttgttgtgcctgaagaacttgctgaaaccgaagtcgacgatcttgacgttcatctctgaatccatcaggatgttctccagtttcaggtcacggtggacgaccatgttgtggtggcagtattcggcgcctgatataatctgcctccatcgaattgaccaattaaaaaaaatgcattcgttgttgcatcatcaaattaacaacatttcattaaaatgtttatgtcgtctgactttctttctcctctttctcagagtaaaatttttcaaagtttggaacatggaaatcggcgttcatcaaaccataaaaaaatctcgtagactaacacaaatcattgtcgaaatttcagttcaaaatggggagcaataaatcggtgcaaaaatgcagagttcttcttcttttttgttaactctgaacttgtgaagagctgaagaaagcagggttttcaacctgctggaagatcctgcgagcgtcatcctcgcggaggcggccgagctgggtgacgtaatcgtagagctgcccctgcgtcgcgagctccatcacgatgtacacgtggccgccgccgtcgccgccggcgatcgcctcgtggaaccgcacgatgtgcgggtggttcagcagcctcatcaccgcgatctccctctccactgccgccgccgccgccgatcgaaaattcaggagagaaagaaaatcaagaattcaagatgagagacggatcgctcgagctcgacgatcggagaggaagaagaagaagaagacgaaggcggtggctgcttgcctttgcggatggggatgccgctggcgagaagtccggcgaggttgaggatcttgacggcgacgctgaggccggtgcggcggtggcgagcctcccacacctgcgcgaagctaccgcgcccccgcacccgcaccagctcgtaccgctcgagcagctcccggtgctgctgcgtcgccgccgccgccgccgccgccgccgccgacgccgcgccgccgccgccctgcatcctcgatcgcctcactgagcgtgtgtgtgtgtcaagtagtagtagtaattagtatgtgaaactatgggtagcttaagctactagtactaggattatggatgtattagtaaagctaattaggtagtgattattgcgagattaagaacgagattatatgcaaagtagtactccctccgtctcataaaaaataaatctacaactagatgtaacatattctagtacgatgaatctgtacatatatatctagattcgtaatattaggatgtgtcatacccggtattaggttggttttttatgggacggatggagtacgtagcatcactatgtggcgtctacattatgtgcattggaatcaccggaggaagaatcaattctaagacggtgaaatcaacaaggtaataaggtaattaaaattgaaattaaacttgccagtgaaagcaacacactaagctgggggacaagggggtgcatatagccagacaggcaaataaacatctttcgatgtcatagaaccaaatggttttctcaaatatgtcgacagtattgtgagacaggttttaccttattcgtcgatgtcatttacgccggcctaaatttaactcggtaatttgttgcaagccagccaatcttaatattttttaaagaaaatatatacagcaatttggctgtgcttctttggtttctcatgggtgatgttggctagctagcttgatagccccatgtatgctgctttgctttctcatggctgacgttagctagcttgtccagcttcaagtacttggaactttcaaactttcagttcagtttcagcttagttttttttctcttttttttttgcgggtaccacatgtatatactttgcatctgcatcacaatatattgcactttcatatattcacatagttacacatgtgcaaccatatatggccgggccggggtatcatcgattgttgaaattgacattttagggctccttcggaacaaaggatcaccagaggatttcgatcctatggaaaattcttcctatatggttacctgaatcaaaggaatagctatcaaaaaatcttatgaattttctttggattagctcaaaacataggaattttaaaggaattctaacatgagttccaacctcttaaaaaaaatcttggtgtctatctatcttatataattcctgtattttttcctatgctacatccaaacggccattcttgcagttttcttgtgttttttcaattcatggaatttgaggtgttagagcacttcaatccaatattatttccttccctagtgtattgagaatcatgcgttcatttccacctggaactgttatagtactgcaaggatcatcatatttatgtcaaaaaaatacgaatatattggttttttttaacgaaaggcaaagcttacctattcattgaatatagagggtaaatttagagctaacgaaaaaatatttacagcatcacggttggggtctacggtaacatctctgctaggcgtttggctcccgccatagcccaagattttgcctcttccttaatcttcgagattagggccaccatggttagttccttgtttcggaaaattcgttggtttcgctcctttcaaatttcccaagagattagaaggattaggaatcgagtcccatgcttgggtgcaccttgacgtgttgcaagcgattcccaccagtagtgtaccgtggttgattgcgcccagtttatcggcttgatgggttcacaggcaacccaggtagcaattgcatcctagattttccttgaatatattggtataatttgtatgcactaagcttattttaaatttcgcttattattggcaaaactctacagtgtttaccatttcggaatcacagttagctagctgagtttgagagaggggagatagagaagattagggagatacgcaaaacgaagtaaaccattagtgtataattaattgagtattaactattttaaatttcaaaaatggactaatatgattttttaaagcaatttttctatagaaaattttaaaaaaccgtaccgtttaatagtttgggaagcgtgcgcgtggaaaacgagttagagtctccccaatctctccccaatggcctttgaaagaacgccgccagtattccttgctccttaatactgctccctataactaggataccttcgcagccaaaatagcatctacacactagagagtcacaatccctggggttaagtgcttgaccattttcaaaacgtacagtcagcactcagcatctaaataattggacagctagtaagcagcaccgaccttttgcagctggagcttgcgaagaaatagaatgtgatcctaccactgaatcgtggaaagcagtagcaaaagagcaaatccgagtcacaaggagggttttagatgctagtgttggcatatactggtagaaaggttaaattaaaggttgccatctctctaaacttggacggcagctgcaaggggaagagaatgacatgaagaaaggtaatgcaacgcagagtttacgattcctgatcaatttcgtgaaacggctagagaagtaccctctccgcaaaaaaaaaaaaaacaaaacaaaacaaaaacaaacaaacaaaccaacctaggacaagaacatcaaatctcgttttatgtagagtacgttggtttggttttttatgaaatggaaggagtagtctaacggaaggagtagtctgttttcctatgtttacacttcgaaaaacgtaaaggttacgccctttgcaacgtcagtgtcactaactcaccatagcgtacgcgtgttgccatattagcttaatgtgatcaaaggcatctcttgttctctactggtgtcgtctaatggaaatcctgtaaaccaggggcaaattcacaaaaccagccacgaattctagatgcaaaagaactgcctggccttaaaataagttagacaaatcaagaaagtggtccatcttcagaagcaatttccttgatggacctgcaaccagaactaccatcgatcttcaaggtcatcgagtaataatctctccaaaatcaaaattatttatgaagatcacaggtttgaaaatgcaagttgttccttcttactaagatttagctgtggagtaagagaagatataaagtgggggaacaaacgtagtaacacctactactcatatagcagagcgaaaagagggtagcatacaggctatacatgaatagcgtccaaaaatacacgggactccgacccataaacccagtcactatccgacaccaatcaagcgcgacatcagggacactcgaacacccaagaatcggggcaggactcatgactaacagaacaaaaaaaaacatatggtcttttttttcgccaggaataggcggtattatggggggcaaggtgaatgtggaggactgggaagccaacaccctcacttgcacttgaagccatggcacacggacaggatgatgatgaggatgagcgcgatgatgatgcccaggacgatcagcttgatcttcatgttttgtaaccacatctttcgccgcacctttgtaccctgctgtctgaaatcttgtgcctgcaacccatagttttgatttaagaacgaagaaagctatgtgcatttccaaaatgccaagacagaataaagtgcataatccataagtgccaccattcattggttttctttaacagtatcatccaaagcatctatattgtgtctcacactgtttaatccagttaatttcaacagctgctacttcccatcgctcataggagctaaataagcaaagctcagatagttgcatatcattacaagcatctccaaccactacaagcatctcattgtgcatcaaattattcagcttgaacagtataatagatggtaagaaggaatctatatgcttgttgtagcatagtaataatgtattatacatcaaaagttgctgagttaattaatgagttaaaatagttcataatttccttctgcctagccgggtgcacatcagttataacagcagatggtgtggaggattactacatgtcagtcgcagcacagtaataatgctataccatatcaacagtaagccagatcacctttggaaccataatgcggtacttctacatatgtacaccagcatcgacatggaagctttctagtcagctcaaaacagaaatacataggctaaaacagaccacgagatatcttgttctttagggcaatcttgtatcttggcatatatgttccaaaaattctgaaaaattattctagagatgataacatttcaactaccatagaagtccagtaatattgatgtttcaattaatgaaaccatcccttccctactaacaatgatgcttcaactaacaaagccatcaaaattctagtaacaatgctttggatgcattgagtaaaagagactagatttgtcctacttaaatcttattcagaatgtttttattataatgcactaaattctagaacataccattaccatactccatactctcatgcgatctacactaacatgtatcagtaatttctccatagcaatccattgtataaagattcctgagttctataagatgatttgcagttctaaattctctgtgttacacaacagtaacttcaaagataaagaaactagtacagcacatcatgaaggaaaacgttaatacctgagatctcaggttttcagtcttgtcgacaagcagttcaatcttctcaccacggtcaagaacctgaatttcataattgtaatatagaatcagcaacaacctttgaagagcatcatggtttttaaagaacataatgtgcagaccattggatgatttaagaatgaaccttctcaatgttttccatcataactcctttgacctctgagacttgtgctttgacctttgcaagcttgctgatttcctcagggtggtccacacaatactgcatgtgctccttaagttttgatctttaaatagtagagacaaacaaatatcagtcaaaagaaagaaagcccacaccatgctcgaatatcacataaaagcaaaatgaacatacccgaattctcggttgaggctgtttgctgcagcagtagctgctttcccaccaccatatcttttggtgaaatcttccttgactctgtcaaggaaagcaatggggatttgtcgcccaactgattcaacagcaactacacagtatgctgcacaaagggggggaaatggaaatgataattaatctcaatgcacatcatgagtttgtgttagaaagtgaaaacatcaaagtaccaaaagatcaaaataatgaaaatagttgttttagggtgaccaagcaatttagaatggttccaaaaaatagatgacgcaagtttgcaaaccaatttagactgtttaaattgtgtaacatattcaatttaccataaaagggtgggtgctaccttaacagtttgcctgtgggggaaaaaaaaactttctaaccacccatcttcctgctttttttgttatccttcataaccttccactaattactcaatcatgcacgccacagcctaatacaagataacagttatgaatcttcccttgactacgtaatgttagccccacatccaattcctcttgcactatgaaaccatgtcttgccttaattgtttatttgttcaaaaacaatgcaaacaattggattgggaacttgcatcctacctaaaactaaacagcatttattccataataatatactgcaacctattcaatgaagtaccaaatgaaatttgaagtagccttttgatgtcattttcacattaccataataatggaaatatggtcacccagtttgaacataagaaaaggcaaaatatgctagactgccccgatacaatacttgtgcccgcaagaatgacacaattttaatgcctattctgatcatcacaaagtagaatatgaaagataagtatcacaccattttgatttgataagttagttagatatgtccatgaatcgtccagaaatgcaaaatcgaaaaacgcaccaatcacctaatccctgaatccccagtatgccgatgcggttagagcctaaaaaatatttgatatagtcaaataacacattcaaaacgcaaacacgtctataaatttcctgattctagcatgcaatcacacatggaaacacccgagcctcctctaaatatagccaattcccaacacctagcctccctctctagcattcgtcaactcaaaccgaagcacaagcagcacacgctagatagcactagcacgccccgcaagtcagctcggagtccaagcggatccaaccactcgaggccccaggcctaccgaaacagatcgaacaaaccccgcgagatctacacgcatggagaaccccaaatcgagcacgcaacgttgcggatccgaggcagatcggcgtccgcgcggcctcgccgaggagggagaccgatcgatcattggatcgaggaggaggaggaggaactcactgaatccgtcctcgacgaggtagttgaaggtgtggccgtcgcagttgtaggtgaacttgttgttgctcgcggggagcttctggaggcactgcgccgcgatggtggtgaagttgccggtgaactccgtgtactcggcgagcaccaccgtgcccctcgccacgaacgcgtagatcagcgactgctgccccatcgctggcggtcaacctccccgctttncttcctcgcgctctccgccgccgccgcaacctccctcgctggtgaatccgacggcgccgacgaggatgaggtcgtcggcggtgaggtggttggggggggggggtggaggagaagggaaaaggggatgaggatggtgagcgagcgaaggtgggcgtggaaaaaggggagaaagaaatcgaattcgaggtggggttttgcactttggtccttgggagggggtatatttatgtactgtataactgttgctttgactggtgtccctaatctttgacgacaaatcagggctatttgatttgaagaaaaaaacatataaattttgaaggatttctagttttatagaaacttttttatgaatgtcttttgaaacaaaggattgggtcattttatatcctttgaaattcctatggaatggaaaattctatagagattttggagaaaaattagcaagagcttcaatcttttgaaaatcttcctttgagtataactctctcatacgattcttatattttttttcatgcggtccaatcaaacgtttttcatgtgttctgtaattctttgtttacacttgcatttctatcataatcctaattttccctattttttgtttttttattcctacgaatcaaggggctcttgaagttttagcatattggaacatttcaatgctgcttagggtctgatttttaatctccaacttaatttagattttcaggggcacataaaataagataaaccattagcacataaatcattagtgttaattattacaaaccttaaataatgggtttatttgaattttaaagaaactttatataaaaagcttttgtaaaaaatacgtcatttaaccatttgaaaaatgtgctaacaaaaaataaggatggagttgacaaaaagaacaaggcataaggtaatgctctttttaattatgcaccgaattattgaaatgtattattctgctctctaattaaaaatacatttaagaaaatcttctgttgtattgcttagatagcttgttttgaagtttactttttaaatatttaatttatccatataataataaagataatatatgataataatccgttcgataatctaaatcaaacggaagcttgtgtcatggttgcgaggacgtctctacctctgtcttgataattatatttttttaatggagttatttttgtgcgaactgaataattgtttgactcggtacaaaattataatagtgaaataatgatacaaactacaaactctcaagtaggcattaattttccattcattttaagatactttatactttatatactaagatattgaagattagttataacaaccatgttgcctacatcagtatctaggtgttttaaaacaatactagtagtattattcaagtgataacataattagtagagctttagacgggttgtcccttgtggtttctactttctagttgcaccaactgatgctcaaccttggagggtacctgtttgtgatggagccataattgcagggtgttaggtcccatctggagccaacaaattggattgccggatcatgaagcaagatgatcagaaaaacgagcagatgactcgtcaatttaaatcgcaaaggaattcacacagtgacacagaagggaacacacatcgctggtcggtaccaacttaattaattttttatgggaaaggaaaaagggtataatggaaaaatgagatactggtgttcttttaattctgaacctccgcatactgtgatattgcagatgacaccttgatgatgggattttggggttaatctcgctagctctctctgcgatgattcctacgattcgggaatagaaacgaggcttaaacacgggtgctaaatagtttgataagattggcattggtgccagcaaatttttggtggtgtttgaatctcctaaggatgaagattaagtatttcacgcaaaacgaggtggtaataacaagtgattaattgagttttaattattacaaacttaaaaaatgaattaatctgatattttagaacaactttcatatagaaagttttcgcacgaaacgcaccgtttagcaatttgaaaagcgtgccattttaatccaaaatttaatccactctttccagtggattcgaacggggtacatgtaccgttctcttttttttaaagaattacgcagtacatgtaccgttattgttaaaaattcgtttgaccaagattttaaaattaaaattaaattaaattttgcaaggaaacttcaaattgattgagcttccatgatccatcttgtttgggactacttctagattctctttttgcaatgtaagatactcatctccctccgtttcaccattataagatggtttgatctattcatctatcgtctggatttacttagatcaatataactttggacatatttgtatataaatctagtcaaaaccgaaaacttctcacaacataaaacataggaagtagtaatatgctcaagacaatacctaagaggtcctttgttgcatgaactgttattatttacatactgaatattctataaaaattcatgccttccaaaaaagctaaaaaagataatacagttggcaaacactggttaatagtgatttttttcattgtttataataagacaaattttgctacataacattcaaaacttgtgtaatttgctaatgcacattgaataatgtgtcacgactgaaagacatcctaaaaattggtaatttgctagagaacactttcggctcaattggagaaattcttaagaacgacgagaatgctcttaacatacatgcttcaaacataacgttagagtaaaatttagaaattatgcaaatataaatttaccatcaccccagtacatcactatacatcataatccatcttcactctagcctagctcaaaagctttttgaccggcattcttttttttaataatttctctctacaatgacgagtgtcctccagcaaattatcaattttgtaattgtctttcagccctaacatgtttttatgatgtctcccaacaaattatataaatttttgagtatcttgtagcaaattttgccttatatttaaggttagatccatgtttcatccttaaacctttgataaaatccattttcatccggaactatatatagaactgatttccttttcatccttgcttttcaacaccggttatatcgggtctgtttggcacagctccagctccagctccacccctcctggagctagagctcagccaaacagtttcagctccaccaaaactggaagtggagttgggtggagctctctcacaagatgtactagagttgtgtagctaggtttaggcagctccacaactccactccagactcaactcctggagtaatatttaggagctggagctgtaccaaacagccccatcgtctagagtaaaaatggaatccgtgaaaagtttcgagggtgaaaataaaagactactgctttagaactgcaagcaggagaggaataatagattgggcaaacaaatgctagggctagtgatattagaattagtatagagataatgtattatatagattatcttaaaattatgagtatgtgatatggataaaattagaggtagcaaccgtaaaagtagctcttggaattataccttgattcacgagactaatcaaagactggccggccgaccttagcaaactttagggtagtgtttggttggtgggatggaacgggatgagttgggtcgatcccatttttccagttgtttggatggagggatgggtgggatggaatgattctagatgggaatattctctccagatccgggatgaagtgatccgccaaaatcggccggaccaatcgatcccacttggatggagagaacggcgtcactcgctccagccacctcccgctcggttctgtcgtggcgccgcccgtaccctgccgccgctcgtcccccagcgccgctcctccgcctggacgccggtcgtctacctcgacgtcggtcgcgctcctccgcctggacgccggtcgtctacctcaacgtcggtcgccgccgctactccgcacgctgctcctccgccgagtcgccgccggtgaagctgcgcatgctcgtgcccgctgaatcgcctatcggcgacgctccttcgcccgctcgccgagtcgccgtccgctcgccgagtcgcgccgcccactcgcgaagctctgcgtgctcgcccctgccgagtcgcttgccggcgctgctccttcgccggcccgccgagtcaccggctcctctacctgctcgctgccgtcctgctcgtcgaggcgagctccttcgtcggcctgctcctccgtccgggctcagcagcggcggatccggggatggggagtgctgcggcggcggatccggagatggggagggctgcggcgacggatccggcctctccctctccgccgcggacctcgccgatgccgtcgtcgccgagccacggctgctcgcagtgaaggccgacaccattgcccgccgcagatcggcagctccctcctgtctggcggcgcgacgcatctcggtggtggagagggaggtgagggcagaggcggaggtggccatggttattgcaaacggcgtcgtcagtggttgcaaacggtattcatcccattcctccctcgtcccttcaaccaaacaaaaaactgggatcgtcctattcaacaaaccaaacacacaggtggaatcgtcccaaccccaaaatcaggaatggtttcatcccatcccaccttgtcctagaaccaaacacacgctaggagaacgaacgcgtttcagactcttcgatccagtgttgtttcctcctgtagaatgtacgacggtcacagtaaatacgaatggatcaacaagcaagcgcgtgccggcgtgcgtacatgtgtacaccacttgtgcgagtcgtagtacgatttctaataagtcgcgcaagtgtacatgcgccgtgagaggatgatgagatgagaggaggcgagcgaggcgacgggttgctttcgccgcccgcgtaaatcgtatgacgccgttcactttttatttaacgtttgaccattcgttttattcaaaaaatttatgtaattatcatttattttattatgacttgattcgtcatcaaatgttttttaagcatgacataaatatttatatttacataaaaattttaaataaaatgaatggtcaaacgttggtcgaaaagtcaacggcgtcattaaaatatgtgagggagtgtaattaattaaagctagacatcttgctaaatacggcacctgcctcagaatcagataattaaacacgctcgtgaatcagaacagagacagtatgatacttcctctatttcatattattagtcattttaacctcttttattgaacttattaagtttaattaaatttatagaaaaatagagtgatatttttttacataaacgaaactaatttactattttatatgtgactatttttttctataaatataattaaaatttaaacaatttaattagaaaaacacagagaaaatatcacgtactccctccatacttgtaaaagaagtcgtttaggacaatatttaagttaaacattgggaatataaattataaataactctcaatttaatcattttttaataaatatttttatataaataagaagccaaagctgtgttttggaccgtgtcactgtataaaacgactttcgtaagtacagagggagtatacgtacgctggccaagccatttctcgtctgggtcggtcaatcgaaagagatggagacaaccgggaaatgcatgagcacgctttccgtgctcggccgcttgatagccggcgaccaacaggggtggctgtcccatttgctctctctagatggaacggcatgtcagtttacttttactactccctaggttccataattcgtgatgttttagataataacacggacttaaaaatacatacttaactataattttttaatataatatatatacaataaataaataaatttttatttttgttatagtactttgtaagataaaacaatatgtatgttgttataggttttttaaattaaatatttttaaagttattaatagtcaaagttataaaagtttaacctcaatcttatctaaaatattaagaattatggaaccagagagagtactccttttcatattttaattatttgtgagaaacacgcggggttttttggctagctccataagatagtgggctaaacgatctgggtttgaagcctcacctcttataattatttgatattaggtcatttcctaatattcacgtttttatattttaactagcatggtgacccgtgcagattgcgcggctagcatcattatattttctctcatataatagcatatatgttttctcattatattattcaaatatattaaaatgacaacataattttaaattttgcaataactttacaaaattacaaatgtgtaatattcatattgtattttatatacgtgttagttattaattatttttaatatcaaattttagttatttgtaaattatatatattcctatatagactctatgatcttcttccaatattatttatttttatttctgaatttttattatttataattgtatttttatgtggactctaaactcatatttcaatattctttaatttttaatttcgaatttcagttacttctaaattatattcctatattaactttaaactcttcttcccatttttttttcttaattttaaattttagttatttgtaaattattttttatacggactctaaactctacttttaattttattatgtttattccaaattttagttagatttaaactcttatatggactctatactctacttctaatattccttatttttttaattcccaatttctatttttttttcttaattgtatttctttatggaatctatactctacttctaatattccttatttttaattcccaattatagttatttcctaattgtatttatatatggattctatactctacttctaatattccttatttttaattctgaatttcagttgtttcctaattgtagttctatatggactctatactctactgctaatattccttatttttaattccgaatttcagttatttcctaattgtatttctatatggactctagtctcctcttctaatattccttattttttagttccgaatttcatctatttctaaattatatttccatatggactctagtctcatcttctaatattccttatattttaattccgaatttcagctattcctaaattgtatttctatatggactctactttttcttttttctccgattaatgtgagaatttctaggccatgagagtgaacgtggaggttacttataaattgtattcctatattgactttaaactcttcttcccatttttttcttaatttcaaatattagttatttgtaaattgtatttttatacggactctaatatctagttttaattttattatgtttattccaaattttagttagttttaaactcctatatggactctatactctacttttaatattccttattttttaattcccaatttctattttttttcttaattgtatttctatacggactctatactctacttctaatattccttatttttaatttcaaatttcagttatttcctaagtgtatttctatatggactctagtctcctcttctaatattccttattttttaattctgaatttcatctatttctaaattgtatttccatttggactctagtctcctcttttaatatttattattttttaattccgaatttcagatatttctaaattgtatttctatatggactctgctttttcttttttctccgattaatgtgagaatttctaggccatgagagtgaacgtggaggctcatttttctattcctttaataatataatagattacttgtgatatgctcatgtgttacaacgagatttaagaagtttgatttcatccgaaaaatatttatagccatgttttttttcttgattttgatcaaatatttatagccctgtttttttttctcgatttttctcacaatgttttcttataggtggggatgaaagtgtttttatagagaaggaatgttttttttaatacgtggagggtgggataaaaaagggaaggaaaacgaatctgcttttatactaaacgtctactttaaaaagaactttattatcttaaataatgagtaaagtatgttggcggttcttaaacttgtagggttgtgtcatatatgtccctaaactctcaaaatgcatatccaggtcccagaacttgtcaaagtgtatcatctaggtcccaaattgatacatcccctctaggatcctacgtggcgctgatgtggcaatgccacatggatgtgacgtatccttttcttttttttcttcttcttttctttttcttttccgttttcttctcattcttctttttttttcgaatcttctgcacggatcacagagaaaggagaagaaatgggaaaaaagagaagaaaaaaagaaaaaaaagaaaaaattaaatgggtcccatttgtcagtcaaaataatgccgcgtcatgtccgtgtggcatgccatatcagcgccacgtaggatcctgtaggggttatggcgatttgggacctagatgacacactatgacaagttctaggatttggatatgtattttgagagtttagggacctagatgacacacccttacaagtttaaggaccgccagtacactttactcttaaataattatactaagatgatacggttaatctaagattacttcctacctacgtaattataatgcacacatcgtatcatcattaaaaagcgaaaaaaaaaggagaacgacataataacaaatactttaggcagtaatgagctacaaccacaaacgatcttcatcctcatgctttaccgtagtgacgcttggataactgatgtaacatactcttcatgctttgatgttttatttttgttttgtttgtagtatatgagttagaaattatggtataatgtgatacttatttttgtacatactccctccgcactcacgtaaaggaagtcatttaggacaatgtttaagtcaaaccttggaaatataaatcatgaataactctaaatttgttgagttttaaaatgtaaaaattatatgaatatatttgttttgaataatactttcataaaagtatacatatatcacttttcaataaatatttttatagaaacaagaagtcaaagttgtgttttggagaccgtgtcactgttctaaacgacttcctttacgagtacgaagggattacttccataaagtagtgcacagtttggaatacttctaaacccataatagtggtcaaagtttgtactacaactcatgatatttgtttttggtttttaatatgcagcgagagtgcacggtgaaattgatttttaaggatgtttaattaaagtcttcaggatcaaaagtaggttaccttgaaagcagacatactgtgtgtgagtaatactaagagcaagtttaataatatagcccactactagctccaatttatctatagccaatctaatagctaattcatataatagttgtttactatactattaatatatggtcacacttgtcatacacacactgtgttttggagtccatgctgcagctagctacagatttatagtccgcttctcttctctctcatcttttatctcattaaaatatgtttatagctggctaatagtctgctattgtacctgctctaaagcagtagggtgcaatagtgcagatccaagcgtgcaaagccgctactttcctactatacccggtccctcctttcttttttagggtgtgtttagtgcacgctaaaattggaagtttggttaaaattgaaacgatgtgatggaaaagttgaaagtttgtgtatagaaaaattttgatgtgatgaaaaagttagaagtttaaagaaaaagttttaactaaactcggcctttgtccatgtagacaccaagtccctaattactccatgcaaattaagcgatccctaattactccatgcaaattaagtgactttttcatcatgatagtacattttccgttcaatagccataagcttattaagccgctattatagaattattagctaataacttccctaccaatattgctcctgtttgataactgcagccagtaactggttttattcagctgcaatagagttgtgcggcttttctgcagctgcactgctgcagccagcacaaacgatgaaggcccttctcgttttcttttctccatggcatagtgacatgcattttcctagtgcaatgttttctcgggtaggtgagtaaaatcgaaaatagatggttcctcggtcaccgcgttgttcatggatggttgcgcattgcatttcgaggagactctcaacaactatatttagcttaatcctacagtccagcccttgaaattggaattccttgttataaaaaagcactatcatattaatcaaagcaaatgggttttatacaatactccattcgttttttaatagatgacaccattgacttttaaacacatatttgaccattcatcttattcaaaaaattaagacgaatggtcaaacatgtaataaaaaatcaacagtatcctatgttaaaaggtgaaaagcaatcgatcttacagcatataataaggtggtgataaatagatttcgagcaaagttcatagtaccaaaaaatgactttaccctaaaatttaaaccggcccacaggtccagcccatcaaagtgctgggcccaacccccaataacctccaccaatctctttccaaatccaaaaggccccactatttttaaattattatttttcctcttctctctcatcacagctcttcttctcccccgtgcacttcactgaccgaccacctccgcctcgccgccacatcgccgccgccgccgccgccgcaggcgagctcgcgaaaccctaggcccctcccctctcctcccgcgccgcccaggcggcgaatggacccggccccctcgctcgcggcggagctctggcggccgcatcaccaccgccaccacttcgaggcgtcgtccgtcgtcaccgaccaggggagcggaagccgcggcggaggaggaagcgggcgcaggaggccgcggagcgacgcggggcccgaggacgacgacttgtccaaggtcgtctccacctccgccgcctccggcggcggcggcggcggcgggcaggactcggtaaggccgtgggggaaccgcattgggcgcgatctgtgttggggttggtgggtttcggggttgggggttgcaaagcaaggggggaagctgtggaatcgtggtttttgatggccctgttcgccgtgatctgcttgtccatgtggatgcacatgcgctgctgctactgtagctatggcagtagcagcgtggggagcagtttagcttcagtgcttgagcagcgccaaacctagttaacacagatcaaaatcttccaaatgccaagtccatgccagtgtccaatactgataaatgattttgaaatgctcaatactggtcagtgccttgtagagtgggaatcagatatgcgggcatgtcagttcatttgggttcattggcatcctagccttagtctaggatgttgctaactttctgaagctgtagcatgacagttgaagtatgaatttattttgttggtgcttgagcctttgcatattcaaagctgtcatatattgatggcaccatcactccatcagaccttgggtaattcaagcatattgttagtttagttgagacactgtatttgctggactgttccgttgttccttgggttagtcacacatcaccaaaacgatttcgggagtatatgtgatgttgttctttttgtcatttcaagaacttgtagttgacccgcaaattagtgctgcttaatttataaaaccttgaattctttgtactgtacaaatcctccgtttcttatttatgattgaatttcatttgtattttaaaaatgtaaagtaaatttataggtggttcacttcagtgtggatgatatatctggatacttgtgtttatacttcatcgactatctacatggatattcaaatcaactgaaagtcaccaccctactttccaggatgctccagaagcaaaacgtttgaaaccaatgaaatctagtgataagaatgatagtttaaggacagaagctggaaccgattcaggaaacagcagtaaggctgctgataaaaatgctacaccaccagagccaccaaaacaagactacattcatgtgagggcaagaagaggtcaagcaaccgatagccatagccttgcggagcgggtaagctcttacacaatattttttttccctaattttcggttttcattttaactatacaagttataatattctctcacaagattataacagagtgacaaccaactcatcacagaaaatgtaatgttcagatattgctcaaggtggattgcgggtagtaacatgataatcatatcagcttaatatttgtttattgacaggcacggcgagagaagataagtgaacggatgaaaattcttcaagatcttgtccctggatgcaataaggtgcactttgaataccatcatgttttcaagtttttgttactttaaagctctttgttctctcaaaattctattatgagtaaatggttctcttttataatatttacttttcaattcctcaggtcattgggaaagcatcagtccttgatgaaataataaattacatccagtctttacagcatcaagttgaggtattacattttctcaatcatgcttggcatggagttgtcttctagtttatgtttaagtacctaattgagctgtttctgcagtttttgtccatgaagcttgaagcagttaatagtcacatgattaacggaattgttgcttttccatctaaagatgtaagtttagttttgaacaactatttattgagcttacaagattcttgattattatctcagcttcagctcttaacatttcaaattgacctgacttgtttgctgagcttattattttactcagtgtgtatttgtttcctgaatctccattttacgctctacatttacattattttcaattcattggacatggagcaattaaaatgttatggattaagtctacttttcatccttaaactcttattttgtccaattttcatccctcaactctaaatgaaagtagacaataccatcctttggaaacaaatggcttgagagatcagtattttctactgatgtttcagttacatagatgattgcacaggaatcttgttttgcacatagatataactttcaacatgcaaaacaattcatagacttttaaaacggctttgctaagttactggatcttttctaatggtgatgaataatatctatacttgcaaataatgacaggtcacctcctgtctaggccaaatgacacattgtttatgtagcatttgttcctcctgaaatgaggtcttaaaatgttcatacagggttcaaaaagattaactagtgcctgtggtcttgcagtttggtgctcagccatataacacagctgctggtttgacatttgatccacaaacaacaagggaatttgcccagggttcaacatcagagtggcttcacatgcagattggaaatgcatatgaaagagtgacatgaataaagcaagcaaaaccataaaacataattccttgtagtggcaataaagtgtactgggatcgatcaagcctgtggtcctaggattatttttttttctcaacaatttcttctcattatcatgtcaccaagttatttttttgttcctaatttggtccatgatgccatagatacattcatcttgacctgttgatactcaacggtctatctgctttgcttgtatcccatggtctttgtagctcggatttgaatagggaaagaagaggatgaaaaaaaaaaacagttgtattgcatagcttgagcctacagttgtactaagagctgccatcctggcgtgtcgggggggaacaacttttatttctttgcaaggactggcttgtcgatttttcggaatatgtcctataatatgcttttggttttattgcgggagttgcatatgaatattcgacacctaactacctaagttttctgccaggttcatacgaaagatcaaaatcatgacaggattgcaaagtaaagtcccttttctccatattggtttcctttctttttgactaaaatgaaatgggcatctatacatgtcattttcgttggcgctgcacgcctgcacctgtttttcctgatggaaattcaaaggaagagacagccatgatggatccaatatctgaatttcgtggaccttgcaacgatattgtgcccatgtacagtccaaatcttgatgtggcgaactgcaggttcaggacccctaaactgatgcttttatagctgtgttaccactttgcagctcagaagatcagagttgcagcttgtgattctggggcagttctctgtaccctttgaaccaaccagcgttttatttgggttgacacactgcaaaggcaaaatgttaattaccaactgatataaggaaacatatactgtgcacacacatttctcatacacatcaactaattaaatgtcaccgaaaaatctataaaattttatgcatatactttcgatggtattacacatgcgtgtaaaatcttaacctcaaattctttatattttagccgtaaaataaaaaaagcaatctggctgctttaaggctataactctattagaattttgtatttttttctctttatgtaggatgaatttgaataagatactttacacgtagatgtactattgttgaagtacatatacaattttttctagaatttttagtgatattgtttgttaattggtgtgtatggtgtgtacgcgtgaagatttaagtgcacaggatacattccctacataattttggatgtgtgtatgcaggagactactttttgaggctacgagcttttcctgagacaaagttaggttagaataagcattagaggctaagactagagaaactgacattaagttagttattagtctatcgatcgagagggttagatgcaatactaatttgtttgtgatacggagaatatagaaactactatctttgttctaaaataagtttatttttcattcatgctatacatataataaaaaatagaatatccacactttattaaatttcaattattatttctctatttatctactcttaacatatttatttatcctctacttttacacgctctgatgtaatgataacttagaaataaacttattttatgatagatgagagtagctaaaagtaaacttattatgatatgaagggagtacaaataatgttagcattgggactaaggtggaaaataactcaaaactcatgagctaactcgacgtgcgtacttagcttgcttgactggacttggttgcttaagtgcttaaccagccagctcaagcttactcgcgaattaattgcttcatttgtgttagtatcacctctatcctaaaatataatatattttgattagatgggacacgtcctaataccacaaatctgaatagtactaggatgtgtcatgtttaacaaaaatcccttatattttggaacggatggactaatgtgttgaattacaaaccattgtttatatgctgcaaatgtaccataaggtcatgatttcctatcataagttcataattgtccatggcaactcaattttgtgagtcatgatacataacatgagccatagctcttaatatatgagcctacgggggggtgattggttggttgcctcactttgctacaccacactttaatcatatcatagtttcttatgtatgtgtttgtttcgctactacaattgtgttatgccatacttttttactcttgggatccacatgttatactctcaaatttataaccgaaccatatcacacttatggccaattatttcttagccacactatgtccctatcctacaactcgcctaatcttagttacgataagtttaggcatcaaccaaacagcccctaaatataccacataaaaatttaaaaccatgtaataatgagttcaacggcctatgaggttgtgtatttaaaatgtgaaaggtaccattttttttccttttaacagctgcgtgaggttgtgcatattatcggtttggtccatcaaaggagggatgagggagccatgcctagatagatgggtttatttgcttcttgggttaatttcgacctctttttcatatttttttttgtcatacccatgcgttgcatatactttttttaaaaaaaagtcttgagtttctttttaacttgttacattaacaagtcaagtactcaagtggagaagctcattaacttaattgagtttctacgagtcaaaggctcttttcaaatctactccctccgtccaaaaaaaaactctcgtactgtatgttgacatattctagtactacaaatctatacctgagtatgagtatgtcaacatctagtatgcggtttagttttttagggtagagagagtaagggtgtgtttaaatcaatggttaaaaactccttttctccatggaaaataaggtagctcattaacgcatgattaattaagtattagttaaaaaacttaaaaaatagattactatgatttttttaaagcaatttttctatatttttttaaaaaataaacacattatttagcagcgggaaacatgcacgtagaagatgatggagtagaagttgaaaaagtgtaattccaaacacaactcacataggatttagctactagcctactatcttattatcttatttttgcatgctatgttcccttgactggtattattttgtaatttttttataaaagtttttttaaaaaacaaattgaataaatatattttttatatctgttggtgatatgacatgagacccttcgaccagacctgccgaaaccatgcaaccagtgagggttcaagcccgagacgtcaagatcgttggggcgaagcccccacagcgaagactatgaagcaaagagggcgaagggcggagaatcgcgctagtacttcacaaggataaaggcatcttgggcgaatactataaggcgaagagtatatgacgaaggagggtgacttcgccataacgagttcggcttcgagaaggctcaggaggctatcccagcctctcaagcctggtggccattgggccaacattcgccagacggcccattagaaacccatgtacctcaattaaactgtatacccatgtaaatgtccctttcataaggcaactatgtaaattcacatgtataacctaaaccctagtagtaagaacctgtaatggggctataaatagccccctagggccatgtaatagggggaaccgaagaaaatttctcaatttaatacactttactattttccaaccactgttgagtaaccacgtcttccgatgtatgcggttgtcgtttcgacaacaatatctataataataaatactttattaaccgtacgttaataaatttctatagttaaacgtaatatctttagttgagttaatttgttagctactcattccgtcacataaaaaaccaacatagtactggaagtgacatatttcagtactacgaatctagacataactttttttagattcgttgtatgtaccacatccaattctaagtttatttttttggatggagggagtatcatgtacgtacaatcatacatatgcattaccacattagtatccaaatccctgcctaggaataattaactatttgtcacttttgcaagtggtgataaatgatttgccagttgatctacatatcatagatacatgaggactcacgagccatagactactagtggtaataaatcattaattaccaattctaaaaagtgacaaaaaaaaaaggttaaatgtcccccttgcccaacctgaccgggggagacacgcccggacgcccgcggtggccggtgccgtccgagtccggttcgggcgcttgctttccacgagtctagtctacgacggcgacccgcccgaccccgtggttgcgaattttaccgtattgcccctctccctctccatcccctacgcggaatcccacttttacccctcctcctccactccccct

SEQ ID NO: 69521 - DNA, 693 bp, Oryza sativa
attttacacccatcaactaacagaagttcaaagcttccaaaatagtacatcgtaagagcagtacaacccggtttaatggtgctttcttagttttgaaattcaaatatgctttttacttgtatgacacctaattaaaaagatatgtaaaagtagttaaatgtaagtgaaacaaacatatttttggatgtcaaaattgtgaaaaccactataaaaaaggctgggttgtactgcacttatttggaccggttttggtaataagagggtgcaaaatgttcggttcccaagatgcttccttttctttatcacctacaacacatgcgcacttgcacatctaaagtttgtgtcagatgacttgtatcttcacttaaaaagatgtaataattcataggttgtttttcctctattcccctaaccatgcctccagaacaaaaaaaaaatgatgaattgacctaattttgtactttggttgtggatggcagtttgtactacatgattggagcgatgaggattgcgtaagaatcttgacacgatgcaaacaagctataactaacaaggaagaaggaggcaaagtgataattatagatacagtgattggatcaccatctcaacagatacttgaagctcaactttcaatggatatatgcatgatgacgttgacaacaggcaaagaacgagaagagagagattggcata

SEQ ID NO: 69522 - DNA, 26584 bp, Oryza sativa
ggctgggtcgtcatcatgcggtcgtcatccccccaccaaccgcctcaccgccgctgccgcctcgcttgcctcccctgccgccgcgctgacctcctccgccacaccccgccgccgctcgcctcctcctccaccgccgcctcgcctcgcctcgagcagtgtgagctcccgccgctgctcgcatcctcctcctccttcaccgccgccgcctcgcctcgcctcctccgccgccttctcgtctcacgccctcgtcctccccgcgtgcacgccaccgagagggaggggggggtgaaagccacgccgagctcctcatcccccgccgccgccgcctctgcgtcaggcggcagcgccgccgccgctctgtgtccccggccatcgccaccgccgagagggaggggggaagccgcgccgagctcctcatcccctgccgccgcagcctccacgtcacgcgctgctgctgccgccgacccgttcgacggtgagagagagaagagagagtagtgtgtgataagtgggtcccacaatttttttttataaagagaatgcttactggactgccacgtgtacgccacgtagaccaaaaccaccgcggattagttcgagggggtaattcgtactttttcctactagaaatgacacatttagatattatagaaggtaattgtcccggtaatatatgattgatgatttgttgttacgataatattcttaatgataaatcaagatatataaatccattaatgttatatatacaattctgaaaaaatatgttaaaacatatttattcataattgttattaaacatttacgcctattaaaataaataacatataaatatatttaatagatagagaggtcgtagtcgcgaacacacgacttaagatgctagttgtcaatgaaatagttgtactaaaacaaattaatcgcattggtacaattatcatctgtcatccaccaaatatcaatcatgaatttggtacacaaattgagaaagaaaggaacaattaaactctgagtagtaacagcacgtagctctgttagttctaatcaattttttactttttgtttgaacttgtgtgtgtgtatatattgaacttagacttgcatgccgatggagtgattgcatataggttttgagttaaatttagtaagaggtccaatcaaataatcatttctatatttttgctatgttttgcaatcctctattttacacttagaccctgtttagttcacgagacgaaaagttttggtgtgtcacatcggatatacggacacacatttaaagcattaaacatagactaataacaaaataaattacagatgccgcttgtaaactgcgagacaaatttattaagcccacttaatccgtcattagcgaatatttactgtggcaccactttgtcaaattatggagcaattaggcttagaagattcggctcgcaatttacacgcaatctgtgtaattagtttttttttctgtatttaatacttcatatatatatatatatatatatatatatatccaaacattcgatgtgataggcaaaaagtttttgtttggaaattaagggcctattcgcttaatttcaaatcatagcaataggaaaaacgaaggaataatataggaatgcatatgcaaaactaaggataggaaaagtataggaatgactcttatagatagttggtagtaggaaaaatacaggaatctttgtattaagttaccacaatcaagatttgaatactctaataatttgtgtaacttaggttcagatacataatgaaacaagtgatttgcctcgatcctacgcgtaggaatagaaaaatgagatccaagtggatgttaattttcctaccaaaatccataggaatcacatacaaaggaattcttcctttgccataatcctacaaaacgaatggatgaacagtaattattcctataagaatggtttttcctccatatttcctatgaaacgaacaagccctaaacagagccttacattactgttaaaatcatatgtttttcctattcctctattttttttatttctactattcaaacgggcccaaacttatatttgaaagcagcaaaatagaattaaacaaaaaattgaagtattaacgcgttaattgatttgtattaaagatgtactagtataatatattaccagtaacgctaaacaccaagcatcatgctacgcattacgtagagtacctcactgtggccacctttctctctctgtttttttttcctagtttccccctcccatccctaattccctatgggtccgtatcagcaaagtttggcttaggttgaggggtgcatacgatttttcagcagcacgtaaaatgtggtaagctattaaatactatgttaattgagtattaattattacaatcttaaaaatcaggtctatttgacttttttaaagaaaaacttttatatacaaagtatttaaaaacataacgttgggaaacgagttcacggtaaatgaaggaatattttggtcgagttgtagaatcaaacttagtctaaatctaaaccatccataggtgaatgttttttttttaagactgatcaccggagaggatagttccctcctgaattttcattaagaaggggttaagtacatagtacaaagagcacatcaggttacattaattagatcctaaggaggagagaagatctctgtactatgtacttagattaagaggagaaaccaggcatctgaaaatgcttagcaggcacctgcgctggagcaaccagccttgccaggtctttggcacttatggtattgagctgaatttccatggagcaccagaatgaggccgcgaacgaacactgaataaggtcctgttcgagaacccaactgaggctgtgtgtttagatccaaacttccaattttttccatcacatcaacatgtcatacacacacaacttttcagtcacatcgtatcaatttcaacccaaacttctaagtttggaaggaactaaacacaacctgaggtgagattaagttttaaattttcgtggcacgcttttttcaagctgttaaacggtgcgtttcgtgcgaaaattttctatatgaaagttattctaaaatatcagagattaatccatttttttaagtttgtaataattaaaacttaattaattgcaagttattaccatctcgttttatgtaaaatacttaatccttatcttcatctttacctttaggagattcaaacagagccttaaatatgtgtgatgatgtttcatcagtagcattgccgagctcacattgaggcaactgtacaatcttcttcttgtggacgtttgtggggaggcgctctttagcaagaagccatgcgaaaaactgaatcttttggtggagctcggttcttctagacaaacacccaattgctacatacctctacgagtaaacaagagggcaaatgcagaaaaagtaagcatttaccccttttcggtttaaagaaaaatcagaaaactcacagtaccctctccttaaaaataagaagagacaaagattgagagttcgggaaaataacatgagatatatatagattggaaatattacacagtaaacaaattattttgacaaataaattattttctcaatggaagctaccaaagcaggaaaaaagaatagctaaaataacccctctctaaaacaaggagaaaaataaaaacacaattttttttctggctaaaagaagaacaccaagcagtgctccatctctatcaacaacggagctagctccgaggacagttaggcgggcaccgggctttatatcgctgtcattgcacgtttgtagaaatgacatcagtgacagggaaatattagcctgtttctttctcggactattcattgtactattaaaatgaattatttgctacatgcttcaaaaaatatttatctcgaaaaacttttagaaaatttatttcttaagctacttgttaagctatttattaaatatatttattcattttatctctataatagatacttcctccgtttcacaatgtaagactttctgtcattgctcacattcatttagatgttaatgaatctagacatatgtatgtatttagattcattaacatatatatgtatgtagacaatgctagaaagtcttacattgtgaaacggagggagtaacttatactactaatccactcgataatcgtcgtatgggcttatgaagatgctactggctcagtcatccgtctcatgactccatgttcgacgcatatatcttcatttagaggatgaataatggattgattgttgttatatgaaagttctccataactttactccctccgtttcattcattttacaagacatgtcttactttattttgaagttaaactttattaagtttcttttaccatgtttagagaaaaatatagtaatatctataacaccaaattagtttcattaaatttaacattaaatatattttaaaattatatttattttatataaaaatattgctacatttttcatagaaagaaattaaagtcaaagtgaattataatacgaaacggagggaatactctatttttgaatcggaatctctacgttagcctctaagaataaaaatatatgagaaacgttgcaacagaaaaatcatcacttgcaagggatacttccaaaggatacatgcaaacaaatggtgcaaataaattgtgaaaaatctgttggattctaatttactttggttggtcttagcctaatataatcacctatgcttaacatggaaattaatctactgagctgcttgtgaagctattgaggccggtttctttgatttatatcctacttgcggtttttcttcttgtctctcttacagttttccttcttatattctctgtttgacatagtgaaaaagcttcttaatgccagctacactaccccaagataaccacataaaagccttccagcgtttaaccgatcgggcgattaaggtttagagttttgacgcaagaattagacatcacctctactctacattttctcctatatataaacccactggtgaggctcaaggcttaattattgcctactccctccgtcccaaaatataagtatttttagcatagtgccaagtcaatcatttttaactttgactattaatagcaaaaaaaataataaaaaatcatgtaaaattgatgttactaaatttatcattaatcaaactatcataatatgcaactctttctatttaaaatattttatttttatagatattgttggtcaaagtagtatttcgaagactgtatcgagatcttaaaaatacttatattttaggacggagggagtattatatttaaactcaatctgtttctaccgaccacacaaacaaaatttatgtccccgatcacttcttgatcgggatgaaatctggtggtttttaactcctgccaatctgtaacgacagtggccgatacaatcgtccgacaaaatcatcccttcttccattgctccattccctgaaaattattttaaactgtgccacggtgtcttccgtgtggcattcaagcatgtgatgtgaatgggcagtcgacgtggacggctacggattccatggagtttgtgtgcaaatccgccactatcttgaagattgatactattacaacaaaggacacaaaatgattcgaaggataggaccacattttttttatgattgatttggcaccactgctacaataatgcatccttggttagcctaatatatgctgattataaaccatatgatttatcagaaaaaatatattttgtagataaaacttttatacatgtgtgtttagagatttaaaaccgaatattagaaaacaaactattcaaaactactaagttttcaaattaaattttggcagcggcttaattataagctagtataggtaaatggtgggaggagatcattagtaattttaattatgaatataaacttgcacgtctactgatcctatttaagagccttagctcttcgccataagattgcacttgtagtactttactgcacgaagaacaccatggcacaacgtgtccaagaagaagatgagcagatgatgagcaccgatgacttgatccaagctcagatcaagctctaccaccactgcttcgccttcatcaagtccacagcactttgggccgccatcgacctgcgcattgcggatgtcatccaccgcaatggcggagccgccaccttatccgacctcgcgctcaacgtcgggctgcacccgaccaagctctcccacctccggcggctcatgcgcgtgctcaccgtcactggcatattcgctgtcgaagaccgcaatggtgaggccatgtacacactcacccgagtctctcgccttctcctcaacagcgatggggagggaacgcacgccttgtcccaaatggcgcgtgtgttagccaacccactcgccgtgatctctcatttcagcattcacgagtggttcaccaccgagaaggcaaccaccatgacacccttcgaggtggcgcatggttgcacgcggtgggagatgatagcgaacgatgccaaggatggcagcgtgttcaacgccggcatggttgaggacagccgtgtcgccatggatatcatcttgaaggagagctgtggcattttccagggcatcagctctcttattgatgttggtggtggccatggcgctgcagctgcagccatagcaacggcattcccaaacatcaagtgcactgtgctggatctgcctcatattgttgctgaggctcccgccactcatagcaacatccagtttataggtggtgaccttttcaagttcattccagcagccgatgttgttctacttaaggtacatacttaagtgacctttgatatgctgtgctttcagctgttgagtagcttctttaatttgtgttagttttgcatgtgatttcagtgtcttttgcactgttggcaagatgatgattgtgtcaagattctgcgactatgcaaagaggcaatcccggcaagagatgctgggggaaaggtgataattattgaggtggttgtcgggattggatccgaggaaattgttcctaaggagatgcaacttttgtttgatgttttcatgatgtacatcgatggcatcgagcgagaggagtatgaatggaagaagattttcttagaggctggattcagtgactacaaaatcaccccggtgctaggtgcccgatcaatcatcgaggtttacccttgatgcttctgaaggtgtacatgtgcatctctccgtggaacctattctagttcagacaattgaactaaatacataacatgttggttataaacatgtttatgttagtcttttgatttcctttcgttcatgagtcagtagccttgaggcgtgtgcatgttcacactgaggccatcgttttttcgtttttctgttgtcgtatgagctacagtatgtgctctgtgggatggtacaacttatgtacgtcgtggcttgagtcttgggcatattggtagcccgtgatttccatttttattttcatcacaataagaggaagagaaaactgaaaagctgcaatgcagttcgcagcgccaaatctctctcgctttgtctgcacaccaaatgttcatgtgtgttcatctgttctggcgataacaagtggtattagagcaagcatcgaagatcggtcatggctctatgcctggataggagaaccatttcttgacagggtcgaggagttgctcccgctcaccactgccacatgcatgcctcaacgatggccgaatgaggggtaacgttggcaaagaggtcatggtgcagtgggtggtatcccaagctaacgaggaaaaactacaccgaatggacaaccgtgacgaggatgagcttgcaggcgcaggtcttgtgggaagcctgaacaagcttaactaaacaatactacccatattctcatatattggcatcaaaattaacaaccaaatttttttctttaaacatggctaaaatgcacgtaaatatttgccacaacgtgtagtcaaaataaggtgcttaattcgatactactgacacctcaatgatttgctaacacattcgtaatcctaaaatataattatttcctagttacaaaggaaatagctaaattttaaaacaggggactgtatatttatattttgagaaaatatatataccgctaatacactaatcgtgtctacgtggtaaatttattttggttttgctaaaaaactgtttttatttagggaactttcgatttttttcatgtctgatgctctttaagattcatgcgcctttttagttaggaacttttttgattttgttttgtcatcagatgtgctttaagattcgtgcatgggaacctgaagaggatcaaaccagttacctcgcgtgagtggcatggctacattttgtttagttatattctatgaatgtattgtagttacagtataattgcactccaattacagtatagttactttgaaagttttccaataaaaaactgtcgaatgctatatagatactcctatttattttccacatgtggtggtgaacctcgatcgtttatcatatatagcaacaactaaatattatggcttgtccctaaaccctaaactctagcaccaataattcatcaagtctaaccattaaagaagatgtttaagaaatgaaattttgctggttgctcgatgcttttttaggccattctaagaggataataaaaaatgatgtgcctaagtataggtcagtgaggctggcggcaggccaaaggcagcccatcagtcgacgcccaggccaactatccaatgccaaactcttctcccacgcaaacgttgcccaggaactactgcagtgcagggattctcatggtggcaatctggttcatcttcaattcgttgtcaacgattgtgtcatcttcctgcaaacaaaagttagttaatttaaatcttaattagttatcaaaactgattctctggataggcgtgcttcccggccgcttgcagtttggttcagaccaatgtaattacaaattcatcacaatttatttcgaatccaagagaaagatgagcacagcacatcacaatttattttactagcttcagcaggtgaacttcagcagtatccatccatttccccagttgatgagtgcataatatttctctttgatgtaaaaatgatctcagcgtaaacatcgcacattgttgaacgatcctttggtgatggctctgtgcactttagcccaagcttagccaattctatggatgtttgcatttcaaccacagcatgatttgggtcttcaccttcatgataataggtgagagtaggggctctaaaatttcattgatttgatgtggaaatatgctgactccacaaagctgtgaagttagggcgctttcctatgattatctctggaacaataattccataactatatacatcatcctctattgaaattttgcaccccaagccatactctgcgatcaatattaattatgcaagttgataatctttcttagtcagtcaaaatatgatacagttttgcatcacttccatgaaagataaaatagagacaatagaaatggacaaaataagaatgaagcaggtgatcacctggtgcaatgtatccgattgaccctctcagtctggtagtgcttgatgcatcacccaggcttataatgttgttctgaagaaactttgcaagtccaaagtcactaaaggattcatcattcaaaaggatattgcttggtttcagatcgcagtgaaccaagggaggaatcggttatgaagatagtccaatgtagtggcaatgtcttcagctactcttaacagttttggggggttttgactgcgcacttttggattgatccagacttcaaggttgccatttgatctaaactcaagaacaagtgctttgaattcatccccgcaaaaaaagtgctttgaattcaaaccctgatgtatcaaaggttgaacataggccaaccccgatggcgaatacttttcaatgcctcacattcaacatagaaactacttgggtgctccattttggtcaagtctaaatacgttaattgcaacattgcgtgcgccaaacttcaattgacctttatatacaaacccaaatgttcctgaaccaacgagacttcttgaagagaaaccatatgttgctttgtacaaatcattgtatgataatttactaaaacacttgaatgaatggttgacaataattctcttaggcccatttctcctcctcaggcaacacatgccatggtgactataagaatggtagtgattgcatccattacactgtgaatataggatgtcttcttcctgttggatgacagttccttgcaaggtggtaattgtatcactagagaacttacacacacctctttatttccttggatgaacacatcgcttgaatttgcaaacacacctccttcagggactggcccctcaaggttatttaaggatagattgagagtgcataaagattcaaaagtcccaaaatatactgggatgtcaccagacaagttgttttgggaaagatccatttcatcaatgcctcttaaactcataggagataaagtttagtgagccgctccaggttgccaattgattgagggatttctccagaaagcttgttgttatataagcttaagatcgataagttttgaagatttccaagtgtgctgggaattttgccggaaagtaaattataatccatttgcaagacagtgagactagtgagtttttttttatctctgaaggtatgctggcggttaattggttttgtattagagtctttagaaggatttggttttgctcatatttctgaaaggttggcaatagaacttggtattattccttttagattgttttcatccaaccacaaattttgtaagtgggtgcagtttgttagcgaggacatgaaagtccaatctccagcctcaagcttattgccacctagatctaagtttgtaaacgtggacaaggatcccaatgagggataacatcagtgaaagagtttatgcaaaaaaatctctctgagattcaaagcattggctaaagaaacatgaattggtccttcaaatttgttccctcctagtatcaaatttgtgagtctgggaagggtatagccaatgttagtgggtgttgtcccaacaaattggttggcaccaaagttaacataggtaagatttgaaattgtttaaagtccttgtggaacgacgcctaataagttgttataactcaggtatagtatttttttttctaatcaccatgttgcacgttttgcttggctatgtgtcttctttgcctttaatgtcctccctccccgcaatgcaaaagatattttggataattggctaaggggagcgccttggcccaccaaaatattgattttatttggagttagtgcgctttattggtcaatttggaattaccgtaatgatagagtttttaacataagaaattgtctaacattatgcaggttatcatcatgtgttccaatcagctccactcttagtatttgatgctttcataggaacaacaggatattatgcgcattggttctacatgcttggaattggtagtcaagagcttttattatactttggatagcgtagtacctacaaaatttcatgctagaatctatgtgattttaaaaacattatttcagttgatccttttattggcgaaagttgggaatttgtccaatcacatctattattaattccttcctttttttattacttctaaaacttgttggctgtgtgccaatgggcagaagctggagatttaatccatttctatcatctaaataaaaaaaatgtagttctatgagaaatttaatattaaatatatactattgtgatacatcacgttaaatctagggttctatgataatttagttttatgaaatctatacctaataaaaaaattcattaggtttccgggatttttactcgtccgtatcaaatttccgttcatctcctgattcgaccgtctgcgagatcgcatcacctcgtttctgtcccgtacgcacgtacagatcaaacatgtccccttgaactagagatcaaatctaatccattcaactttgtacaatctatcacaaaactgcatatttaagaatttattttacaaaactatagatttagtgtatttgtttatcacagaactatacgtttagtgtcttcatttatcacaaaactacagatttagtgtctccgttattaagaaactacaggttttaacaatgctaaaacttgtagttttgttataatgaagatactaaacatgtaataattttgtgataaatgaagatattaaatctgtagttttgtgaaataagttcttaaatatgtagttttgtgatatattgtgcaaagtacccgtagttttttgtgataaacgaagacactgaatctgtagttttgtgaaacaaattcttaaatctgtagttttgtgatagatcatgtaaagtatttgcagttttatgaaatttacttgtttttaaaattttattatgttttagctctcaacaacttaggtaaaagaaaagaacagatggtgcgtttacatgcttgagtggtgagcagattaccggattggtcattttatatgtcagctgtgatttttattttccaatctgtatttttttgtttttatattttttatttcgatcctttttgggatggatcgtacttaatcttggctaataggccgggctggtcatcattttatctcttagttgtgaatttttcttttcaatctgtaattttttttgtttttatcttctttatttcaatcttttttcggatggatagtacttactacgtattttctctcgtatagaaacggtagattagaagtgagagattatattttcatagatctaataatctaatggtccaaaacaatgaatccgcggtttaagggaaaattatgggttagatgttttacttttttttcttagaaatctctaatttattatagcgccatttggcgatgtatgagcatttgtagatagtcacatgatgacttaaccgtgtttataggaagttaaataaaattttagtatataatagatatactgatatacatgatgtttaatttaatagatatttattattaatggagtagaaattaaggaggccaatgtgagcaaggagagaggacgtaaaattatttgtcatgacatcacagtatatgttattaatttttgctatttgcaggagctttgtcaagcgatgtatttcttatatatcagaacacattaccaatatagataaatagaatatgtttaaaaaatataattatttagttatctattttttatattataatttttttatctagaaaattagaagatggaaggaacaaagaagagagaggatgtgaggggaaggaacgtacgtaacgctgaggagatgaggcccatgagggaggggagccggacaggatttttggcagatgggattttgctttattttgtttaattaaaatagatctaatggtgtaaaataatgggcccgctatattaagtgaaaattgagggtcagatattttgcttttttaaaaaaatttcttggatttctctaatttattagagcgccaagtggcggtttgagagcgtttgtagaaagtttaatggacttttagtatataatagatagatagatagatgttaattgagtattaattattacaaacttaaaaattagatctattttatttttgaaaaagaacttttatatacaaattaattaataaaattattgtttagtagttcgagaaacatgttcatggtaaatgaaggaatatttcaggtgagtattgtacaatctaactcaacctaaatctaaaccatccataagtaaatacttagatacttatgggtccgtctccactaccactagtaaacaagagggtaaatgtgaaaagtgagcatttaccccttttcagttaaaagaaaaatcacagtactctctccttaatgataagaagagccatgcattgagagttcatgaaaataaaacgagatatagattggaaaattatcacagtaaacaattttgttgacaaataaattatgttctcaatggaaggctggaagctaaaataccaaagcaggaaaaaagaatagctaaaataatctctctaaaacaaggagaaaattaaaaacaaaatttttttctggctaaaagaagaaaacaccaagcaatgttccatctccatcaacaactgagcttactccaaggcgagttaggcggctgccgggctttctcgctgtcgtttgtcgaagaaaatgagtagatgatgaggaccgaagacttgctccagctcatatcaagctctaccaccacactgttttgcctatatcaagtacgtggcgctttgtactaggcgaagctttcccttgcacatcccatggctcttgcgtgtgctcactgtctatgtaccatcgaatgtgattatttatccaaattgtatggacactatttttttctgaaggatataattggggatctagcacattcattctcaaggtctataaaacattggacgaaaaaaaaaagaaggacatgccccattgatcctaatgggccaaatgataataatgtagattgattgctacaagactctttataattgtaattgtatatttataaaaaatacaagaaagatatttatagtaaatataattattctttggaataaattttttctaccctttgtgcatgaaattcagctagttctgctcaatgtagggttacatataagactgattaacttagacgcatactaattattaaaataaattatggaggagttgcatcaatcaaagctgcagtaccggttctgatgccgtgcatgctgcccacacatgatgaataaaaattgcgaaaggatttaactgatctcctgataattgttccttattaaatcacaccatgcatgcagcatgtattatgtattgtttagtagttcgacaaacgtgtttacagtaaatgaaggaatatttcagccaggttgtagaatcgaactcagtctaaatctaaaccatccatagttgaatacttatgggtccccctccactaccactagcaaacaagagggcaaacatgttaggtgagcatttacccctttttagtttaaagagaaaaatcacagtactctctccttaaagataaagaaaagacatagattgagagttcatgaaaataaaacgagatatagattggaaaaattgtcgtagtaaacaatttttttgacaaatacattattttcacaatggaagctaaaataccaaagaagaaaaaaacaatagctaaaataatctctctctaaaacaaggagaaaaataaaaacaatttttctttgggctaaacgacaaacaccaagcaatgttccatctccatcaacaaatgagctagctccaaggctagttaggcggctgccgggctttatcgctgtcattcaccaaacattcctagaaatgacgtcagcgacagggaaatagcctgtcttttttggactactcattgtactactagaatgaattatttcctacacgcttgaaaaaaatagttatctcgaaaaacttcctaaaatataaggctcaataactcataacataaagaccaagaaataatttaatcacaatcttgatttgatcacatccggcatgcacagtgtggaagaaaagtgggtagtaatatgccttactaccttctttgccattataaaagtgggtaacataggaggtagtaactaatactatactagacaatagtactactacccggtaataagcataaaaaaatactaaaaatctctcgtctatcttttttgctcaactattgttttacaagtacgtcatatattactattgtcggtgacatgggaccgggagtatcatgacttagagacttgaggcagacacgatcacccacgtgacctaaccccctcgggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggaatggaggtaggtatgggccgtcccatcagaagggtcactcgggcagcagccgttgcaaatctccgcccatttatgaagagatgacagggtgatccccgaggtcagacgaacgaggacgcgtgtccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagagagggggctggaaggggggaggatctggagagtagatcccacgagaggaaaaaagggagaagagggtttctagagtaagagctctctggctctccatctctttgtagcttcttcatacacagatccaccataacacaggagtagggtattacgcttctcagcggcccgaacctgtatacatcgcccgtgtcttgtgctttttccattctcgcgaactttccacagactaggagtttagaatctcacccagggcccccggccgaaccggcaaaggggggcctgcgcggtctcccggtgaggagccccacgctccgtcatctggcgcgccaggtaggggactctgcgtgtgtttttctaagctctcgcattctttcgtgtgcgccaagcttttcctgttcagcccaatggccgaacaagcaaaggcgcacaacctctctccgagtgttagcggtgacgacggggaaccgaacccacgccgtcgagctcgtactccaccgccccctccacgccaaagtcctaggcgggaggaggcgctcgagagggtcgaaggatccgcgacttcgacatccacgggtgatggagaagggcggcgagatggggagcgtcgcctcctcgtctacggcgacggcagcacgccccagggcgcgctccaaactgcgggcgcgctcctacgtcacccgcccattgtccctgacccggagtctccagcccaacgttggctggacgacgtggccaacttggtcatgacggcgcggcagcgcctagatgctggtgggcggtcctccgccaccaagacctctggtactgctaccaccggctccgcgtcgtcaagacggagggcgcggcgagcggcggccgctgttcgccattcggccgccactccttcgtcagcgcctccgacccgagaagatctgcgtggggggccggattcccgcatcagtatcgagcgccggcgtaatggccgacgtactgcccacgcaacggagggcgcctcctcgtccggagtgtcacctcaacacggacgcggggatcagccctccgtgcccccggttggtggtgtcggctgtagagcctttgtggcgagccttcggaacgtccgttggccccccaaggttccggcccaccatcgccgaaaaatatgacgggagcgtcaaccccgccgagtttctccaggtctacatgaccgggatcgaggccgccgggggtgacgacagggtcatggcgaatttctttcccatggccctgaagggacaggcgaggggttggctaatgaacttgccacccgcgtccgtccactcttgggaggacttgtgccaatagttcaccatgaactttcaaggcacatatccgcgcccaggtgaggaagcggacttgcacgcagtacagcgaagggatgatgagtcacttcgctcatacattcagcggttctgtcaagtccgcaacaccataccatgcatccctacacacgcggtgatctacgcgttcagggggggtgtgcggcacaaccgcatgctcgaaaagatcgcctccaaggagccccagactaccgcggagctttttcagctcgcggaccgagtggctcgtaaggaggagtcatggacctggaacccctccggttccggtgtggcagcttcggccgcccccggatccgctgctcggacagggcggcgtgacaggaggaggaagaaaaggtcagcccattccgacaacgagggtcatgtcctcgccgtcgagggtgcttcgcgggccacccgaaaggggaggcctgcgagcgacaaaaaggaggccagcgctcccagcagggagcgcccaaccggcaagtggtgcaccgtccacaacacctcccttcacgacctcgcggactgccgcgcagtcaaaagtttggctgagcagacgaggaagtgggaggaggagaggaggcaggagcgccgagagggcaagtccccggcggttccttccggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgtgttgcccggggaggacaggtcgcaatggtggtttcccccactgtttgcaacgtgaagctggggcgtgtcctcattgatgggggagcagccctcaacatcctttcccccgcagcttttgacgccatcaaggccccggggatggtgctccggccgtcccagccgattatcggtgtgacgccggggcacacttggccgctaggtcatatcaacctcccggtcaccttcggtggatccgccaacttccgcacggaacgggtcaactttgatgtggcggacctcagtctgccctacaacgcggtcctagggaggcccacgttggtgaagttcatggcggcggtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgtcgccccgaggcagcggatagtcacgtgcgacgaggtcccggtcaaggaggttgccctgggcgacggcccgtccaagaccacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccggacgcaaagccggtccggcagaaagtgcgccgacaggccccggaacgtcaagctttcatccgcgaggaggtggcgcgacttctggaggccggattcatccgcgaggtcatccatctggagtggctggcgaacccggtggtcgttcccaaggcgaacggcaagcttcggatgtgcatcgactacaccgaccttaacaaggcatgtcctaaggacccttacccccttcctcgcatagatcagattgtcgactccacagcggggtgcgaccttttgtgttttctagatgcatactctggttaccatcagattcgcatggctagggaggatgaagaaaggcttgcccagccgtcggcgcgacctgaccccttaggggagacggacgcgcctgaccggcccccgaggcccgtcggagtccaggcctcgggacccgaggggagcgctcccagctcccttagattgattgcttggatcgttgagatccaagcatacctcacagataagactctacccgaggaccgcgaaggaagtgaacgcgtccagcgcatctccaaacgctacgtgttgatagaagggaccctctatcggcacgcggctaacggaatcctcctgaagtgcattcctcgggaacaaggcgtcgagcttcttgctgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcagttccacgccaagcaaatccatcagccggcctaggcactgcagatcataccactttcatggccgtttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggggtgcctaaccgtattattacggataatggcacccaattcactagtgagcttttcggtgactactgcgaagacatgggcattaaactctgcttcgcctcacccgcccaccccagaagcaatggccaagtggagcgcgccaatgcggaaatcctcaaaggccttaaaaccaagaccttcaacatcctcaagaagcacggcgattcgtggatcgaggagttgccagcagtgctctgggcaaaccgaaccacaccaagccgagcaaccggggaaacgcctttcttcctcgtctacggcgcggaggcggttctcccatccgagctcaccctgaagtcccctcgggccaccatgtactgcgaggctgatcaagatcagcttcgcagagatgacctcgactacttggaagagcgaaggcggcgcgcggccctccgagccgcacactaccagcagagcctgcggcgctaccatcagcgccacgtccgggctcgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccttaatggagttcgggtgtcaggtttcgggctcgggccaaccccgcacccccttcaggcgtgcagggttggccgggggctaccacatatgcatattttttcttctatctgtatttcaataaaagcattttcgatttcctaaaggctgtatctgtgctgttgtttccttttgaagaatcttgacttgaaataggtcacttgtgctcaatcctgccctcgggggctcgggtcggctaaaatcgccaaaaggggcccagaaccgagccgtgccccggggtgtggtgaactccgggggggaatcggcaaaaacccacaatcgggtcacccataaccctcggtcaccacgctctcggcctggccagtctcgacacgtggatctccccaggcactagccccgacccgcgccttttgaggactgggacctgggcacgagcccttaatcaagttaagacacaaaaggaccacggcacagatcatcctcatctcatacacatagcaaaatgaaattgacacagaaatttctttattttgattgcagattaagttaatctatacaaaaaggaggcccgaaggccttggaagaaagaaaagaagaaaaaactaaggattggcgggggcctgggggctcactccgatgcacccgggtcgccagcctcgtcgccactgtcgcccacaccgccgtcatcgccctcctcgtcggagttgaaggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatcttcgagaggcgctgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaatccagcgcgccctgcagatccgcgatggtgtgttcggtagctgccaggcgagcggctaagtcgctgtcgcccgtagccgccccgccgctacgcgcccttgcatccagctcccttgcctgcgcctcgagttcagcggcccgctggttcagtgcggccctctcggcgcgggcactttccagattgcgacgcgcttgttcctcttgcgcagcttcgcggagggacgcgctctccgctagcctctgcgctgtggcctcggcctcctcgagggctcgctcccgctcggtgagcgtatcctcgcggaggcggagtgcggactcttcttcggcacaggcggcttcgtgcgccgccagtgtgacctcccgaatagcaacggcggcctcgcggtccgccaggtccctctccacgacgcgggcacgctcttccagcgccatgtcacgggcctcaagggtttcttcgcgccgccgggatgccacctcggtctccgccgcccgccgttctcgggcagcggcagcgtcaaggaccccacgggcggcgtcgagcttcttccctagctccgcctcccagctcccgtattgaaggcggaggtcgtcctgcgcctcgttcatcacggtagtggcgatgagggcagcccccctctcctcctccacctccctggcgatctcccccagcatcttccgacgggcttcgagctctgagacgtgccggtggtgtgccttgcggcccacctccaccatggcctccactgagcgtcgcccctcttcaacacgcgcccatgcggcgtcgagctccgcccgctctgcttgcagggcctctatctgggcacttaacccgtccaacacagtggtgttagcgacggccaaggcctgcagaagaggctctgcgctcagtggggcaacggaaggcgtgggggagagccgcctcggtgaggatgccgcgcggctcggcccgctgatggacgtgccggactcagggatgttccccggacctggcttgtcctgagcgtcgcccgagggagtgggcccaagcgatgcagccgcggcctcgtcgcgagctgcctcggaagtcgtcgccgcctcggcctggcgaagtctggcctcctcccgagcggcttcttcagcttggcgagctcggacggccacctgggcagcttcctcggcttcccgaaggcgatccgcagcttcttgccgatcagtctcgcgggttgcctcggaggatgtcgtcgcctcggcctggcggagtctggcctcctcccgagcggcttcctcagcctggcgagcccgggcggccccccgggcggcctcctcggcttcccgaaggcgatccgcggcttctcgccggtcagattcccgcctccgagcctccgtggtcgccgcgttctcggcctcagattggccggacttggattggcaagaaggacgcgacgggatctcgctgaagcagaagaaaagccagaagacaaacaagatgggtgaatgaaaacttgtgttgggagaatgaatatagccacaatgggcgtgggacgaacctgcgagggggtcggttaaacgaccaccttggaggggaaataaggtttccccgggatggttctgtcccccccatcttgcggagccgtttcttctttcgctccccctcgggctgcggcgtcggcgcggccccctccgggcgcctgctgctgacacgcgccgccccgccccctcgggggggagatggggaggaagtaccctcttgcttcctcttccctcgggcgtcggcagggcggctgccccccgagcccccatcacggggcccggaagcacaaccccctcctggggtagattgatctcccttgcggctcccgctcacaccgtcatggccctcaggagctcgctcctctgaggccccgaccgccatcatgatggacaggatgttggcgcgatctggatcgctgcagagggggaggactccttgggggatgagggatgcctctgcggagctgagattcagcacccgttggatcattaccttgaagtcttcggggacccagtcccatttgaccccccggtgagtcctcatacagtcctcggacccggtgtactcccaggcgccccgggcgcgccgctggagtggcgcgatccggcgacgaaggtagtcactgtacaccatggcccctgtgagcccctgggatcgcaggcccgccaggcggtcgaggatggcatcgtagccatctcccaggtctactggcgcccgccagctggaggcctgtgctgggggctggctcggaagtcggaggcgcgcttcgtcggcgaggggggtgtagaaccagtcgctcttccagtcatcccacttcttgcggtggacgcagggaatgtagcggttcagcaccggcccccgcggctggaagtagcagccaccaaccaccgacggcggcgacaccggctgtacggtgaagaaccaccggaacagccgaagggatgggcgcaccccgatgaacatctcgcacaggtgcgcgaagatggccaatgtcattaccacgttagggatgaggtgcgccatctggagatcgtaaaactccagaacatccatgaagaaagaagaaaatggcggaaccagccctaccattgcgaaagggaggaagaagacggaccgccccgggtagtgtggcgccgggcgtccctcacccagtgcgaccacctcccggccggtggcagattccggcatgaagcggcgcgcaagccggcctgcctctcgctcacgatgcgggaaggcggcaacacgctaccgtcaagcggaacggaaccccgtgccataacgccggaagaagagatgtttgagagcgagcgcgtgtggcgagggtagggcgcaggaaagaaggagttagggcgcaagcggcgaagacaaggggaataatggcgagaggaaggaagcaaatctcttcctcggcgactttatacccttgccaacgctctgcccggctcctcgtttctcgcgcccactatctcgccccctcgtttctcgcgcccacgttttcactaatcccattcgcccgtttgcggtgcatgaggtggatatgcggctgtggcagtcgagatggaacatatcgtgcgcgcgttaattacactcgccgaccgaagcgccatcaccatatctccaggaaaaacgaaccggcttgtcccgatttttgtgagtaatgtggcagtcttgaagagaccgctcattattgacagtcgagttaccaatgccgatatgcgtgatttgcgaccgattggttttctttccaactgtagagaccggccccacctgtcaccaggccttaggaagaggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggtcgggcccgagggtgatacggccgcccttctctttgtctccccgaggagtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaaaggcgaacacgcagattgctaaactaacacgtggtggacaaaggtgaccggtctgtgactggtctgacactggttatgtccccggaagacaaccgtgttcccacgttgcacctgcttccggcggaatg

SEQ ID NO: 69523 - DNA, 985 bp, Oryza sativa
cgataacttgcaagatctaaaatcaaatcacaagaatacaaacacatacatcagtacccatctgatgcatgacggtggaggcatcgacacgtagtgcccacaggaggaggtggacactgtggcagccgccgcttggggatggaggaggcggctagcccttggaggtggctgctcggtgatggaggaggagccggatccggtttcccctgacctggatctggcatcccctaacttgcccttggaggaggcggctagcccttggaggagccggatccggtgttggagaggccggatctggcatcccctatctcgccgacgttcccgccgggcctcggcaccttgctcagcttgacgatggacttgacgaattgcgtgaagaaagcggccttgtcctgtgtgaaccgcctgacgaggtggctgcagcggccgctggatctcgcccttcctcgtctgtcggatctcgccacgccgacgctcggggatgagacgctgacgcccggccacatctagccacatctggccggcgcccggcggcatctagccgcatcggcgcccagtggcttggatcccggcgcacggaagaagggagaaagagggaggggcggaagaagggagagcgcgggtggaggcggaagaaaaaagaagaagaccgatgggcgtgggttcggagctgggaggagaggggagggttatgagagcgattttttttatcatctttgacgggcacacaaatatttggcccatcacaggtgactttacctcacatctgacgggttcctttttggcccgtgtcacaggtgaccttttttttttcggggaaatgggaataaattactcaggaataatattgtttcttacaagatatgaaatagaaacacgactagagaggtcctcacaccgacgcttattagcaaaaaatggctgaccatattctgctcacgccgaattttccagagaacaaattctctacttccattcaagaggt

SEQ ID NO: 69524 - DNA, 708 bp, Oryza sativa
aattcctgcagccccagcgtactaagcaaagtccggattattgtcgtcttccacttcattttctttcatttcaaccccttgctctccgtgagatgccaacaattatcgcttggcattaactccgacttaaacaagtggaaatgaatagtcctgaatgcagaatactccttctggttcttacacttattgcatggataacaaataaaacccttatgcttgttagcttcggccactctcaaaaaataatgcatgccgacaataaactctttagaccgccggtcagcgtacattcattgcccatccatctacatgaaatgaaaaaaaaaatcgtacacaaataattattcgtacaataatgacagtcatacaataataataaaataatcacaaactcttccaaaggtcatacaataatgacatatcattattcatacaaaaattataaaatattccaccaaataattcttatttattatttttgaacttttaaactaatattaatgtgttgtacttcttttggttttcaatttagtttgttttctattatttaagattaactttcactatattttccttctcaactattttataaaaccttctttagcaaattaacaaaatttctatatattctttctttcccacacaaattttctctctcatcaactaacaacaaaattttggagacaaaaaagtgagcaaaacatagct

SEQ ID NO: 69525 - DNA, 34073 bp, Oryza sativa
ccactcgacatcaaggcgcactgtgaacagcctcatgggaagagagatcgacattagtcttattggcgccgagccatttaacctaggggccagcctctaaaaagggctccagaaaaggattcatttctgaaaatagttttttaagatctatttatgaaaatagtctaaaagaaaagctaaattgtaaaaatttcagtgttcctcgagctcctctgctttatggtctttcatgggccagccccaaacacactaatcaaatggaccgttctcctttgtgggtttccatgggccctacccaaacgaaacctccagatgggccgtactctcggctgcccatgggccgggccccaacggaacgcacggataggttgggcttgggctggattggacatgacgccatttgaaggcccatccagacagcgagagcggcgccgcggccgctacttctacccgccgccgcctctccactccactccactcctcatccactccctctcgccgccgcctgcgacctcgccgccgcgcccgcctcacctcacctcgccggagttcccccacggtacgctccctttcccttctctcgcgccgccgtccggatccgccgtgtcgtaatcaccgcgttctataagaggaggatttctcacgatttggtggttttacgtagatcggggggcatccggggtgggcgatggcgccgcccgggacgagcaggaggagggggcggcgtggtcgtcgggcggcgggccggtgcgcggggctgcccctcgacgcgctgttcgagatcatgctgcggctgccggcgagggacgtctgccgcctccgcgccgtctgccggtcgtggcgcgccgtggcctccgaccgggccttcgtcgacgcgcacgcctcccgccacccgggcccgtacgtcgccgcgtgcttctccgatgaagccgacggcggcgacggcgacgagtcctgcggcggcgtcgacatcgtcgacctgtcctccggcgacatcgtcaagactatttacaccgaagtcagtggatccagagtgcagcgcacgcgcctcgacctcgtctgcctcgttgaagggcctagccccttggatgtcaccgtgctggatccggtcaccggtgctacctacatcccggcaaagagtatctctgcggataataaggatttgctgagttcaggccgtctcataatggaatcctgtgcttttgggaaggtcccctctacaggagagtacaaggtggtccgtctccttggttctggtaatccatgtgagctatacgagtgcgagatcatgaccgtgaacagtgctggcgctttgcaatggagggcgatacaaggacctcagttgcctgtttgttcaagtaacaatatgagaagtgtggtcatcaatggggttgcgtatttcctgttagattattcgaggctctattgctcaaatgatggcttgcttattcgaccaggtaacatagttccatttgaccttgagacggaggaatggatgggtattctaaacggaccgaaaccagtcgccaggggacgggatatgattgttatctcctcaaccttggaaattatggagcccctctcgctagccgacttgaatgggtccttagtgatggtgcatgctgtatacggttcccccatggacctgtggtttctgtcagatcttgagcaaggactctgggttaagaagtacagcatagatttcgaatactataataacaatgcttatcctttgctgctgttagacgatgagaagattgtcttcctactgcggggaactaatgttctacaaagttatgatctaaaggatgacacatacactgatatattggtggtgccagatttcagatccgttggcatttatactggagatctattgagcttggagggtggtctgaactgattatgtaagtattatttgctgatgttttctttatatcgcattgcaatggtagctgcttttcaatggtggtactatattttttaaggcatttggtgcgtggaacaactctccttgatttaagccttttaacaattagagcttctcaatgaatgaaaatatacattagaaagaatcaaagcatactagtttcatggttaaaacggacaaaaaaaattgtaactaaattccatgatttcttcagatttgtttcggcatgcttattgtatgtacaaagtggacactagaaaaggtggtaaaatatagcgcattgcatagatacccacacctttcattatgcttttcttttgtgctacatgggtctgtatttaacagctagtgattctccctgcaaatgtagcaattaatgttaaatgttagactatactaggatcagtacatgaaaattggagtataattgctgctgatcgttgtttctgggtgaggaaggatcatgattgtaaaccagttttatcttgatccatgtctcatcccttccacctccttttgttcctctcatgttagcattacaatgtaacaatgtgtccattggttttaaggtcttaaaatttgaatgtgattgcttcagtgttctaaaaatcagcgttaggtggcaagtcccgctgcgatttgcacttagtcggggggctacctgccgaggcgggattaggtggcatttggcgctgctaggcagggtttggcggggctcagcggaggtggcacatggaggtgggagggctcggctctgctcggaggagctcacgaggcacggagctgctcggagttggagtttgtcacatcctgatttttgtttcaggatttataaattatttaataaattattattagaatttatattaaatgttcattaatttacaagtgaagttaaatgtcggaaataaaatttcctaaatttaaagcatggatggatttaatttttattaaattctccatgattaattacactctctgaaattttctcggatttttcagagctcaattcctaaatgatacaaagaacagttcagtaattatttgatcattaatgatctaattataattgttaagagcttttcttgtttaaaaatccttaaattataaattgttgtctaaaagggaattattagaaatgatcttaaaagcctagaagagaagatctaattttaattaataaattccaatataaaatggggccagataaaatttcattaaatactttacttgattctatagttcttagattttttctgggatttatttgagccaaggaagtatttttaatcaatggaatatcatttcatgaataatttaaattgaaaaaggtttttgaaagtctcttttggctttgggccgaaagccggcccaaagccttctctctccccggcccagtcggcccagcccgccgtcgcttccttctctctctcggtgccgctgataggtgggtcccacctgtcaggcccgtcttcctcctcgcgccgctgccggccgaaaccctagccgccgccgctttccaatccggtcgatcctttccgtttccggtgaagtcgtttgaggggaaataatctcctcgatctcctcttccttttctcttatggaatcgtcggctaatttcggtttggaaatccgtggattcgatctcgaatcggattcgtctctctcctccgaaccctaatctttccttctcgtcgctggtcgccgtgggccttcgtcgccgccttccaacccctataaaaggacccccaagcccgccgctacccgccgccactctcgtcttcgactgccatcgcccgtagagccctagccccgtgagacctcgtgccgccgtcgccgccgcagctccagccatgcgccgccgtcgctccggtcgtcgtcgctgctcgggaaggttgccgtcgtggtcgccgtcgcgtcgccgtcctcgtccgcccctccgccgttgctgtcgaccgccggaacaccatcgccatcgtcaagccaaatgtcgtcgccgcttcttcctcgtcgccgttgccgtccgttgatcttccgccgctgttttggtcaccggtgagttcgccgcgtcgcccgcatcgttttggtgctctcctttcgcgctgtcgcgccgttgttcgccggcgagcttgcgcgcccgagccgctgccggtggtgatgtcaccgctgacgtcatcgtcgtcgtctcccgtggtccggccgtggaccagtcgatcttggccgtccgttgtggataggatcgatctcggccgttcgtttccttagaccgtcccgtgcacccggtttaccgtggatcgcctttgatgacgcaataatcctcttttccttttcaaaaataattcattattgcgtcataattcaattaaaatctatataaatgctttaatccgatttaatctttgaaaattcataactaattctttgtaactcagtttaatgtggttcaagttgcaaaagttatataaaataaagatctacatattaaaattatccataaatagaattaaatttatttaattctttttaaatgggctttaattagatttaatcttgtaaaattcgtaataaattcatttgaagtcagaatgaggccgttcaagtctcataattcatctaaaatcatgatctacatgtttgtttactttatatgtattgtttatttggagtttcttagtgttttccttgttttgcgtgttagcttgtcgtttccgtcgtttcgaaggttcgcgagtgcgccggaagtattcaagaagattaattgaagaccgattattgtaaggcaagtcacacagatcctaaacacaattcctttgagcatgttgatcctatatttaaattctctatttatttcaactgtgcatttattttcgaatgtcaccgggtggtgtgaacttattcctttgttatggccaatttgcattgattactctattccttgataccttgggttattataacttgactagttgagctttatatattggttcagctagatattagatatgattgcttagccatgcttagaaacattagcacactattgggataacttatgactcactattatttaatgatggcttaataatagttcacgatggccaatcgtgattggttaattaattatttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatggttcattgcggagcaccagactgagaagtggcggagataagcccacgagggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcctaaatgttttgctaaatgctgcttttgcaaatgagcatatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgtttttcttttttttcgtaagtatgtaacgttattattatgatggatttgtatattaaattgtcagtttgggtacctcggctgattcctggacgaggattttatgcataaataagttcggaaattactagtgaatttccgggcgtgacagagttgctgctcgctggctcgatgctgctgtgctgtgtttctttcgggcgacagtgtgtgcattatgcagccaggaggaggggtagacgatggggtagttgggttacataacttgcatccaacggctgtgatttttcagggcccacttggcccatgagtgtactaggatttcctatattcattccattcccacagctgccgccttcatcgttctctctctgtccacatcaaccatgggatacattggcgctgcggctgacatggacgagagcaactgtacgagcaccgtaagcagcttcttctccttcagattggtctctttccctccttgcgttcttcccatctccttttcctccatctccctcctccctccctccatttccctccatttcaatggccaacgcggtgccgcgacaagcaagcgctcctcctaccttgcttctccgtagctttgcttcagtgcttgtcttgcactgcttatactttcacctgatcgaaactcttgcctccgctctaatacatggttttgcccctcttgtggtggaatacctaggcgtcgcctcggcgtgtctagtcgctagtcggtagtcgctgggtagctgcttgactagcgccttcttgaacactgtgagccatgcctttcttattgctccattgtatgcattgaaattcttattatatattgacacaattaggtgcccaaactggcaggtatcgatgcactgactatgcattgtgctggcagtagggctaagctagggggatcatattgctggactggtgacaagttaaatgtttgttaaggtacaagtcattttattgagttcgcagtattgggtgctacactccggagtctgcgggtcggacattctaggtccctgtccgtagtgccctttggtcgcttggcatgcctattttgaagtgacactgtgttgtcatgcactgtcggttcttctttctttaaacgaaagccatgcaactctcctgccagggaaaaaatggtattgggtgctacagaacacgtttcttgatcttttgtgcaatttaacttctgctgacttagtgaacacgtttcaagtaattcatcatcctgtggtttgacatgataattttgcattattggtaataaaagataatatttgtccccaaaaggccttactgtgggcaactctagaaccttttccatagtatcatagccatgaccatgagtttttatgtactccatggtccaccatgcttatatttatctttggtttttactgtctgtttcctttaccatatgtgacgtttgctgttttggttcttgcaggtagaccattgcgcctcttgtattctccaaagacaaagatgttgctgctttcgcttgctgaggctacttgagctacttcgtctcttaatttgctccccagatggagcaaatgatgctatctcattcagttacaataatgaaatactcctatatcagatacctgtttgtattccgacggtacaagctgatgttatcagcctggtttaccgtctttttaaaatgtcgacaaacctgtggtggtgtgatctgtatgcatggtacttgtcctttaagactatgggaaaaccgtgtatcactgtcagtttagcttgggcacatgattaccaatgggaattttctgaacaatttcatcctcgtttgtcttttttttcctgttgagctgagcttgatctgaagctactcgtctgtttctaattctttttaggatgcagtttgaattacagaacctgcaggatctggtattccaagaaaaactgaattatcgattgctgccggaaggaatttctgattttgaatgaacatttggcagaaacatctgaatttcaactgattctgactgaaaatttggtagcaaattagaatcacggcggttactacttattagcgggcccgtaattgtgggcttgtggccaagctgggtaatttgaagccgggtaaaacgccgttttccttggtgcttaattagtttagccttgctttgctgaattttgtgttctgtcactcgaagcaactcatatttgtgcatgcagtttgttcgtacttgaactacatattatggtttgcacaatacacttttgacatacaaaggattcaagaatccagtaagcaaataactcaagtaggactagtattcaaatattcaattcaatcaagaatcaagtacgcttcagttcaaccaattaacaattaattaattttacatacactcgttttaaatttacatttagttaaaccaatcaatagtgatctcaactaaaacacttgtttctgcatacatctggcattcagaaagaagttgacacagttacttgacgtgtacagtccatgaacaagaaacactcaagagaagttcagtcttagggagtctgaacttgatccgcacatgcagagaacacttttggcataagcaaataattattgcaacctaagcatatttaatccaaacaatcaatgactaatgatctcagctcaattagctcagtccatgacacatactctcaagtctgaactccatcccatctcagggaaagcatgtctgaacacaatccagctcataacacgaatgtttcaccattcttgaactataactttcagaagttgatacttttgatgcgctgcaatacttggtgatcacaagtccagacatttcaaaccgaatatgtacatttcatactcgatttattcagagaatgcagtcaactcttgtcagcgcgtttgcagctaccgattgttctgatgatcacagatcaaccaatggccatgtattgtaccttggaccccaacttaatttcctggtgctcatgtagagttgttttggtgcagcccctgatcaaggagcttagtgtttaccagcttgcagaaatgtgtactctgacactgaaaatgccatttgagaagctttggtgcaatcagaaccttgttgatctcggttaaaattgaagggagctgttaaacaaaaatgtgcatacaaaacaaaaaacagtagcatagccagctagctgttgctgtaattctgttccaaaattacccgcatcagcttcaacatcacaactagccaatgcaagtctgaacttttctgaaaaataaatgaccaactcaagtttgaacttctctgaaaaataaacaacaacctcaactctgaacttctctgaaattcagacttgagaatctgaactgaatcaaactcatgcagagtacttttgcacaaacaaaagaatcaagtaaatattttattcccatgaataaatattacaaaaatttctacttcagcacatttggttcaaccaatcaataactaatgatctcagcctattaccaatacctgaacttctgaaagattttatccatgctgagtaaaactgacgaatcgaaacatgctagagttgcttgtattcaattcaaacaggacaatgttgtgccaccagaacaatgtgacaattaattgacatgtacagaccatgaaacagaaactgtcaacccaagtctgaacttttctgaaattcacagacttgagagtctgaaatgaatccaactcgtgcagagtacagtcttggcataaataaatgaatcaggcaaatattttattaccatgaataaagattacaattagtgttacttaagcatattttatccaacctatcaacaactaataatctcagctttgctaataaatacaagccatcagaggactaagctcctatacatctctgcttctatatctacagaagaatctctttccttcaacaaatgacaatgtcactgctaatccatctctagctccatagatcgaacagctcatcatcaatggtgaagtcgatgcagctcaggtcgtccattgtctcggcgaagtcgatgcagctcaggctatccatgctgtctggaactccaaaaccaatagcctccacgtccatgacgcccgatgaggagtgctccttctgcttgtccggcgacgacatcatggaccctgcaccattgctggcgtcaacttcggcttcattgccgccttttgcgggagagtcgaccggattgcgcgcggcgtactcaagtggaaccttcagctcagcctcatagtacccggagcagctctgatcagagtcattggggaggtccaccactgctgaaggaggaggaacggagccggagcagccatgatcggcgatgtcagagacagagtcatcgtgatggttcaccattgctgcaggaggaagaacgagctcctcgatcagagcagtctctgacacggcgctagtgcagctctggccatccatggcggcaaagtcaaagcagccaaccatgtcatccaggctctctggaagctcgaagaacattggcgcctcatcattttggttgtgctgcgatgacacccaagacgatgccggtgctgcacggccaccgccgccaccggcttctgctggaaagttcaacgggtacatcatggaagaatcatccatgctctctgaacctccaaattcagcaaactgcgccggcgctacgccaccaccgctgtcagcttcagcatcagcttcacagcttccttgtggcagagagacgaacaggttgctcgcggcgaactcaggcacaaaactctgcagctcatcctcatcgattgacccggtaacatcagaaaacaacagggtagagttgtcccccacgccagagcagctctgatcggcgccgtcagtctcattgggaaggtccaccactgctgcaggaagaggaaaggcgccggagcaaccttgatcggcgttgttagaggcatagccatcgtcatggttcaccattgcagcaggaggaagaaagggctcctctggtatggcgctagtgcagctctggttgtccatggcggcgaagtcaaagcagccaacaatgtcatccatgctctctggaaactcaaagaacactggcgcctcgtcgttttgattgtccagcgatggcgccgatggcaagacgatcagctcgggaagattagcaaacaccacgccggagcagctctgatcatccatgttctctggacctccaacatcagctaacgacgacacagattgcgccggttcagcttcatggcttccttctggcaaagagacgaacaggttgcgagcggggaactcaggcacaaagctctgcaactcatcctcatagattgacccgggttgatcagagaacaccagggaagagtatcgatcggtgacgtcagagtcattggtatggtgcaccaccggtgcaggaggaggaacggcaccggagaagccctgatcggtgtcgtcagagacacagttcaccatcgctgcaggaggatgaaccggctgtggcggcggcgcgctgtcctcgagcatagcagtctccgccactgcgatctggtggttgtcgctctgagattccggttccctcttgcgcttcttgccgtggccgctgaaccggatgcgatacagccgcgtcgtcgacgacgcgaggtcagccggcgccgtgatggcgtactcgtgcatcacccaccccgagctccccttctcgccatccgcgaagtagctgagcacgtacttgcgccacgcgatctccacgccgccgccgccgccaccatcggggacgaccagcctctcaccatcgacgcacatcctctgcccctgccagtaccctccgccctcgaccgtgcgcttctgccggctccccttgccgttcttggcccgcgcctcggcgaagaagaacgcgtcgtcgcccctgccatgatccgcaagaagcctccatggcggcgcgcagaggggatcggcgtcgaggatgacgccatggagagggaggggcttaccctggatgcgcgcgaggaggaagcgggcgacgagctcgtcgtccttgggctcgaacctgagccccggcgggagcccatctccagccgccgccgccatggatcgatccgcaggagaggagaggaatttctagggtttgggaggagggtttggttgggaagagaggagaggcgattcgaatcgaggaggggatggggatgtgagcaacggataggaggctatttaaaggcggcggcttcgcgggatcagctcgcgctcgcgcgcggaaagatcaggtgtggtttcccatttttgggaaagtttgatgaaatatcttgtctttgcgattcgatatgaaagttatttagaaaaaaaatagcttcaaaattcgaggtgagattggtttgaattttgcagttctgctcaagctatacatgcgtattactgaaggtgacactgaacaaatgatctttgcagcctactagctattgcagtattgccaattgctgaaggcctgaagctgacactgaagaatggagccataagaaagattcagggtgaatatcacaaaatttttttttttgacgtattgagcaaatccagctgttgacgaagttcgaagtctgttgatttgtcttttgtcttgaggaacactgatgaggttaccgcccgttgacacagttctatgttcttaactcctctgaagttcagactttagagcctgcactcaatccaaatgatgcagagtaaacttttggcacaaacaaaagaatcaagtatttttactgccttcattggagataatcagacaagagcctaaaataattaatgcaacataagcacattcaattcaaccaaatcaaccattaataattcattaatggttggctgtcaaacggattttgtgatatctgaaattctgaatgtggatgctacagttttgcactgagcttaaaattcggacgccgactgagcaagttgttgtgatgatggcagatcaactaatggttgatttcctggtgcttgtggggggtgatttgaactctgaagagattgttttggtgcagtacctgccttaagaaactactaggtgcttatcaggttcagagttcagacccctcatctcctccttgggcaagttcttcagaaatttttacaaagccatttgagggacggccgtttgagaagcttgggtgcaatctgaaattttggactttgttaatgctactccctccgtttcacaatgtaaaactttctagattcattaacatctatatgaatgtgggcaatgctagaaagtcttacattgtgaaacaaaggaaatagttaacaacttaagattgaggggagatagccctcctctgctagcaagaagaacggattcaggagctgaagattcagaattagcatatgtacagtccaaaattgattggccactcttcaattttttttaattaaacttccctaaaaaaaatgaactaaacaaaattttgttcaaatttcaacttttttctaaccgaaatttcagcaatgtccccccccccaacccccggcaaaaaaaaaatatttctgatttccaccatatagaaccctatagtctttcccttaaaaaaacctacagtccaagaaaccgatttttttttaggcaaaggtttgaagccaatgatctttcataaataaaagaaaaagaaaaagtctgaactcaatgagataacgtgttggcgtgaaatatacaaaactcatatacatctcttcactctctgctctacagaaggcactcaaatcaattcctacacgcgacaatgtgccaatgtcagtcttgatctcactccaaatcggatccaaattacatcgtgttcggacttcggattcgaactaattaagcgtcccagcatataaatcggatccaaaataaattgtgttcgggctcaaattcggattcgaaccaagcgttcgcgccatattaagcgcgcgcgccaccgtcgccctcgataactcgtacaacgtgatcagtgcgcctccggaactagattcacaagccgtctcgaccagctcgccgtggcgtcatcaatggcggcgccgccgagaaaccgcacgacggaggagaaggcccatgttgacaacgacgcgttgcagaggttttgcggcgcgtggcgggatatgcagtgctctcgccgcggcggcggcggcggggacgcgttcgtcgtcggcgcggtgtaccacatcgccgaggacctcaccgacatcaccctcatggacgcgtactccggcgaggtcgtcaggcggatggacgggctgagcaggccaggcctcagggtctgcgccggcggcgacatgatctgcgtcgtgagccccggcgacgggctgctccgcgtagtcgacgtggccaccggcgacctgaccgacctctcgatgggctgctcggcggcgacggggaggaacgtctcctccgggtacacgctggggaaggttcccgccaccggcgagcacaagctgctccacgtttacgccgccgccaacgggtcccagtcaagcgaggtcctcaccatcaccaccggcggcggcggcggcggctgccagtggagggcgacgcggagccacccgccgatgaggatcgagcacgggatcagccggagcagcgcgaccgtcggcggcgtggtccacttcctctccccggccaccacctccgccccgcgcgaccgcggcgtcgagtgcgacaccatcgcggcgttcgacctcgcgacggagcagtggaggccggcactgatggacggcccgctccccgcagaccagcgccaccgcgggcagcgccccaacctcggcctcgccgcgctcgacggccgcctcgtcgccgtccaccacgactaccccggcaggaccatcaacctctggtccctaacgccgaacgacacgacatggacaaagctccactcgctcccgatcaggaacgtcctccgcgggtgggaagaagaaccgacgagccacccggcggcggcagcggaggcgaagcgcggcgggcgaagcaagaagaggaagaagaagaaggaggaggaggtgaggtggttgtgcagggagaaggtggcgcagccgctggcgatggtgggagacgggaggatggcggtgtgggcgagggggtgcgagggggcggtgcggctgcacgacccgaggacgggggcgtgcgaggaggtggcgcaggtggagaagtgcggctgcgtcctgggcttttactccggggctctctcgccgtctcacgctgttgagatggaggagtaacgtgcgtgtgcagggggaagagttttaggtagcacttcggtgtgtaggtgtagctagacgaaaccttacgtgctactgcgaaagaattgtatggtaaaatagtaaatatgtgtctcctgcgccgctgatatgtaactggcagatgtgcgtagggagagatattctttttctctttaagaaaaaggaaaaagtttatttagtataagttttaattactctattgttaattaatttggtgtacttacctttattttgtaattagaaaatatgtccgtgcgttgtaataggtgaaggctatcttaatcgtattattgttatatagtttttgtctaaaaagtatgtccggcgctctctcgctgctgagaatgagatggaggagtacgtgcgtgtgtgcagggaagagttctaggtagcacttcggtgtgtagctagacagaatcgtatgatgaaataagacaatcaaacagaggggaaaaaacagagtttcagttggaaactaattgactactcgtacactctgccatgctctgcttacctggaggtgaatggttcagtttgaatttttttttttgagattttccactaaaatggagctgggaccttacttgaatgtataccactcagaaaaggattataagttagcataatctacgtacaatgtacagtctatgtcatatgtatttttgaggggaagaaaaaaatacatatgttaaagatgggttctacaagacagcagtttgaggcaatccttaccttctatttatattgttggagataatagtattagtacaggtctagttaacaagataacaatcttatcgattactagttttaactgatgcaattgtatgtaaactatacacgagatcataagatcactttgtttaacacatttcttcagtctcagttgctggatgctgaaaccataaaaacttcagactgaaaagggctttgtgaaaaaaatctggatcctgaccctgagtgaaaaaatgaattgaatatcctaaacgtaactgaagtctaatgaattaatttatggaagatttgtgatattccactcagaaagaattaccactaaaaaagatattagcagttaataaggttcccttagttgtaagtcaaacaaaggttcccttttgttatgagcattgtcaaacatcaatagtgatccgaaactgatactcgtctcttcttttcattcaatctggcgtcaacctaggatgagatatgacccatcttatgccaacgaatctggacataggtcacatctactcctaagctgagttattttgggacggagggattattgttcaagatgacactgcaaactgctcttatgcagcctgctgctgtatcgccacttgctgttgatgcagctcaatgtccctttgtcttttgtttggaggaaactgatgatgttattgatcatttacacagctatatgtgattaactactggataaattagcttgctaaaaccgggccatgaaaaagaaccaccaactcaagtatgaactcctctgaagttcacaacttcagatttcagagtctacgctcaatccagctcatgcggagtgaacttttgggaataaataaaagaatcaatcaacaattaatttagtttatcagattaatgaaacataagcaccgtgaattcaaccaatcaacaattagtgatatcagctttggatacacttcattatttgaagttcagaattcagctaaggattgtggtttcagtctttcagaagctgaaatgttaaaaataccagagcattgttggtgcgctgcaatacttgaggatcacaagatgttatttcacaatccgttaacaaggtgcaccggttggctgtgaaacggattatgtgatatctgaaggctagagctttgcactgagcttacaattcagaaaattcagtcagctcttgtcaggcgtccttggacattggctgggcagattattctgatgatggcagatcaactaatggttgatttcgtggtgctcgtgaaaactctgaacttgaggggtgatccgagctctagagagatggtttgggtgcagatctgaacaatggtgatatgataccggttaagattgaggctttttttttttggttctcctcaaaaaaaaaaaaagattgaggtttttttttcctccgtgcagtgtactctgacattctctgtaaaacagaaatagtagattgagagcatgagagagggcttccaacttacatgacacatgtactctcaagtctaaactcaatcccatcttggggaaataaggtctgaactcataacgcacatgctgttttgctaaacaaaagctcaatccaactcataagtcattcaagaataattttggcataaacaaacaaatcaagactctagtatttaactgtcttgactcttcagtatatataagatcctagaacaatttatgatacttaagcacattcgattcaaccaatcaacaattaatgttctcagttgcatacacctagtcaatcaacgtattttcagggcatcaataagctacctggaggtgaagtgatatctatgatgagtgacatgggacaaagtatgtcgggaataccgacttacaagttaagcattgagaaaagaacaccaaaacagtccagaacttacatactagtaccgaagatatgacaatctagtactacctccgcttcaagttataaaactttctagcattgcccacattcatatagatgttaatgaatctaggcacatatatatgtctagattcattagcatatactccctccatttcataatgtaagactttctagcattgtccacattcatatagatgttaataaatctagatatgtacaggcaatgctagaaagtcttacattatgaaacggagggagtatatgaatgtgggtaatgctaaaaagtcttataatatgaaacggagaaagtatttgcgataagaggttgatagcctgttagaaccacactataacaattcaacccaacaaagcaaagtatcacaataagatgctaactgccactttatagcactcagaaaatatctatccagtcatcttcatcatcatcactatcaggacagcagtcccggtagatggcaccatcctgcacgccatgtacccaatctacctctaaatcgctatttgtgatgagcttatcattggtgtaagaaccgtttgatccatagaataacttctcgaactcatcacgcccatggaaactctccatggttggatgcagaattctgttcccttgatactcacaataaatacaacgaacttgtcctgccattcataacaaaaacacatttcgacacaaattagtgggatcagaaatcatggcagcatgcatacccttgaaataggcgcacattgttccatatgactatgagagcatacttcattaggatgaatcgtaacaaatttggagctgtcaaaggatcaattgaatctaaggctaagcaactactctctccgtcccaaaaaaactcaacttaggaggagattatccagatttgttgtcctatgaggggtcacatcccctcctaggttgagtttttttgggacggagggagtaagtgctacgtgactataacagcaaaagggggggggggggggggttcaagcaccataaactaaacttgcatcataacaaaaggggcaataacatgcaataagtctatgttctatcttattccatcccaatttataccaacagatttctatctaaactattatgtgataatttcttttgattcccagtagagccaacatcacccaagccatcataattgctcatcaagcaccagtccaattaccactttcattagggagtcacctaaaagaacaatttttcagtctgctataaagactataaattctttcaaggtcatcatggttgctatttagaacagtgatttaatgttgtcttgaagcgtaatagaaaaagatagaccatatggtgagcagtccacgaaatattttcaaatcaagatattccatgatcttagtgtaatgtataactgatctccaacaaacaatattaccatgcaacagtaaatgatgtattactgaaaattctttgtaagacacaataatcaggtgggacaatggctactgcatgatgccccatgatggcattgcattgggctacggatcaaaatgtgaaaagtacccaccatgtagcaactaaactctatagttaagcataagaaagcactgacgatagcatacatgcagtattattttgatgatatttggatgaattataggcaaccaaacattgcagattgtgaagttgataaaaaaaagaaagagctcaatctactagatagaaaaatatcaagatggaaattgcaaggtcaaggctatagcataccagcttctggtttctgtggaatcacagggacacaccaacatgtatcagcaccatctttgccacattcagcaaagaagagtgttggaggatcatataagcgggctttgcaaactgctagaaagttgatatgggtgtgataatatttgtcacgagtccatggattgtagtctccaactttctcacccaagctgcgcaccgggccagataccagctcattgacaccacagatgaaatgaagttcaaacgggtgatcctccttcaaccacgagtatgaagagtgttagattggaaacacggcatagcacaaatacacagaatacacaaagtgaaaactatggaatgagtaaaggagtgtagggggagaaaccaaccatggtattgttgaatttgtccaatgcatctctcaccatgctggtgactcgggcatgctgaccccagaacctattcctgcattgacatatgtgattatagtctctcttttttacctttctacatgctacatcctgttgttggtgcagcttgccagtagaggagggacaccgttgtaatatcgtgcgaagcaaactaagcttctgtggggagagtgggccatccgaggcagactgtgatcctgggacgcaaacctggatatgcagaacctctgagacaagctcaagtttactcagtaaaccagttggcgacgcaaggaactcttgctgcgcaagagggtagccatgaaacccggcggtggccgcggcaatatatgattcatcaacaccggcagaaggggtgctttcttcaaccacagagtgctgaatatgagaagtgtcaggattgtcaagaacttgagcacaatctgaaaagtccagacgcttttttctactagtagcactaggcgtaggagaaaggttgggatcagcagctttcaagttaaccccggtcaccagcaggcgctgcatggctaggtcaggtgtgaggcctcggtatcgagtgcacaggaaggacacgaggccgtagagcgatcgagctacaatgcacgacagcatcgtggtgctaatcatggcccactggaaactgtttgcttgccgggaagttgtgctcgtaccagatggtgttgacaatgatgttggagacagggtccagtggaccgtagcagtggccacccatgagcatgctgcggtgaaacgaatcgcacagctccgaggttggcagcctgcccatcgcctgcaggtagaatccatggattgttgcaagcagcactcgcttcatgtgtgcccgggcaggaggcagccatttgggccctgcataaattcccatcaatctttctcgcttaagccgcctcttggcgagttcccacgatccttccagccgaaggacaggatcagctgccgcattatccttgtgtaggcgacgtagtacgcgacgcgctacgtcgccgtgcatcgtcgtctcgcgtggtgacgatggcgcagagccgaagagcgcctccacgacaggcgagagcagcttccaccctagcacgaggctccgcggatcggggtgcttggcggcgaccgcggcgcatctgagggcgacctcaaccgctgcctcggtgggctgggagctgaggtcgaactcccggattccgcgccttctgatgatgagaagcgaggccacaattgggtcagcgtccgcggcgtcgaggtatagccgtgcctcggcatccgggaggtaggggaagaggcaggtgaggaaggcggtgagaccgtcaagcgaacgctggctcagatcagcagcattgtctcctcttcgtcgtcgttttcttgatcctcctcctgcttccacccgcggagcagcattgttgttcaggtccttagctttctctcctcctcctcctactaccgcctgagctgcagtagcaggagacaattcagagatggcgctgttgatgaggatgttggttacgggatccaaaaggccaaagcaaaatccgttcttcttctccaatgaacccttgtcaagctgcaggtggctgtagatcttgtcgatcgtggcaacaactgctgcaatctcatctttcagtctgtatatgtggaattggtcctcaacttctctcggactaaaagtgcgcatgagattgctgctgctgctgctgccaggggcggatccaactggggacacgggagttcttcagttgaacccccaaactttttggggaacaaaaaacaaactgtgaaattgagattaaggttaaggctctgaaattgagaggagcttcttcccaatctacaggagaagctagggttcacgaacgcaagcaaaattccaggcaaatttagtaccggtgggagagagggaagaatccgaaagaggatgtggatgctcgccagatggagattaattcagccgcgactcgtcttgccgcgcaaggagcggaggagacggagacgggagatcttctcttacgccaagggaagatgaaaacggtttggaaattttttcggaaactttccgaaacggaaacaaaaactaatgtgataatactaatatctgtcggaaacgaatccagatttttctttctccgaatcagaaacaaagtatttctcatatacaactgattttcaaacttttctacttcaattatttagatttatactatgtgctagtacttgtaactacaagatacaagatagtacttataattgtagtgacagatgaatatagttcttttcttccaacaaaataaagtgtacaactagttgtataattattaattgataaaaatttagaaatatcgatttattgctttagaaaagatattaaactacagctcttcattgatttgagaagttcgagttttattttctgataaatatccattaccctattcgctcttactcgtattcgataatatttgattatgcttttgtatccgtggttttcaattccgatttcgaaaaaaatagggaaacaaaaacgacaaaagtggtttccgtccgtttctgaacctttttcatcgccactgaagatctccatttcttttactactataaaactagctatttctttatgatgaccggtggcccacataacagcagcactgagagaaaaaaatgcaacaaactcatttgaggattgtgttgacaacaaactactcagaccaccaaccactaactgccgctctacacaccgccaccgctgctctttctcgttgagccaccatagttcctcctctctgtctttgcatgcgcaaccgcaccctctagtcaccgacatatcttttctcctcccccatcgccatgcatgctattgtcatggtcgccgttgaggttgggggtgttaggctttgtagggactcggggaagcaagagtcgacctgataaagagcaaagactcttgatccgggttcctccttgctggataaagaaaaaggcggagagaaagagagttagtatgcataatggttgcaaagtcaccggacttgatagaatgaggtggtccaaattaaaatgtaaagtgagatgttgtgtaaatgaaaagaatggttaaatgatgatataatatgaaaacatttaagaatacatagtttaaactgtaatttacttttttttttctctagcataattaaagatgagttgtccattaaccgatagtctcatgatatgctaagcccactacaattttatcgtctctgcatagtatggttgatcagtgtacttagctattactaacaatcttatgatatattgatacatgacgatataaacttctactaacacgggctaattaattatggttagataaatctagcttaagaaaagataaaaataataccatatattttgctcaataataaagtattggattgtggtcctgttttctcactacatgatatatgatgactatctcttgtcactgtgtactcctcaaaaaggattagcagttagaacatgcttcaatagaatgtacgatcaatacctcatgtgagtaatttgatgcaatcctgcacacctcagatcatcaggcttcccttctattgtattgctggacgtgagtagtacaggcctagatcacctgataacaactttattttattagttacaactgatacaattgtatctaacctaaactatacatgagataagattcactctgttttcagtctcagctgcaggaagaagattgaggttgcccctgaacatgcttctgattgaggtttcaaaaaatcagatattcagaagctgaccgatgtttaaataccgcagtactgttgatgctaatccattttatctaaatgactgttggtgctaatactcctaagtgttttcacagccatcaatctgccactgcattaattcagtaaaattgcatcagagtttcaaatcaagtattaatgggagctgccatattttctgggcattgaaacaaattaatctacctggaagtggactgatgctgacacaagttaaacaagtaaccatatccatgatctgctacatccgaatggtatgcagtttgtcaaaccgattgccactcctttgtcaagttcagataagtgagctcaagattgttgtttcatactttctgagcggctgcaggagaggctgattgtcatgtaacaatgcagtaacaaatgccttgcattctcctgttgatgaccaaattaagagtttgaaggtatcatcattagcacactgtcttgctgttcagtttttgtacagtgaatgcttgtttttcctgcgacaataaccatagaggaagaactagcatctttttctgcctccattttttttttgaagtgaaagcggcaaaagatttgccgaatatattagaagattagaaaataaaggagtacataagagcgattacaaaatagtggattgcaacaactgaaaagagatgaaaggagatgaagatcccttctttcttcatggcggtttgaaggccatctctggctagactgtcctgaactgctcctatgaactgcaagatcaaaggaagatcgcttgggcactaattgtgagaaagaaaaagaagagtgctccagaatacgcacctaaacgaaaatcaggtggcagccatggtaatccaggatattaaccaaagagagttagctttccaatttatagactagagccttttgatgctgtaacagtaccaatgctattcgtgcctatgttttcctgtaacctcagtacttgtaaaaacaatcattctccttcttcttaacacataacaaacggcatagctcctgccttttgctttaaaaaaaaaagaagtgttttggaggctgcttcaacagtgtagacttgagatgctgtgtatttccatgtcagtgaatccggttctgtattgagattcccaacttgaagttctgtccagaggtagtatatcggctgtaaatcctgaatgtttctgacttgttttgtagggttctgaatcttttttccttgataattccttctgtgccatcctattgtatctgtccagaattttgttcttttcaccaggggaagtgtcttttcttggaaggtttgatgagacataatgtcttgatgtttagtttggatataaaaggtaactgattttttcaaagatttcagttgcctgaaatctagactgtccctagtttcaaagtttgggcagaatattttagtgtttctcaaggtatacatattgctgatgttgacactgaaaaatactctttgcagcctattgccaatccgtgaacttctgaaaggttttatccatgctagacttgcttgtattcaattcaaacaggacaatgttgtgctacaaggagtcaaggacattgtgacaattacttgacatgtacagaccatgaaacagaaacagccaactcaactctgaacttttctgaaattcagacttgagagtctgaactgaatccaattcatgcaaagtacacttttggcataaacaaatgaatcaagtaaatattttattgccatgaataaggagtacaattagtactacttaagcacatttaactcaacctatcaacagctaatgatatctgcttagctaaataaataccactatactagccatcagaggattaagctcctacacatctatgcttctttatctacacaagaatctctttctacaaaggacaatgtcactgctaatccatctctagctccatagatcaaacaactcatcatcaatggtgaagtcgatgcagctcaggtcgtccatcgtctcggcaaagtcgatgcagctcaggccatccatgctgtctggaactccaaaaccagtggcctccacgtccatgacacccgatgaggagtgctccttctgcttgtccggcgacgacatcatggaccctgcaccaccgctggcgtccttcagctcagcctcatagtacccggaaagagaatcgtccaccatgccggagcagctctgatcggcgccgacagagtcattggggaggtccaccacttctgaattaggaggaggaacggcgccggagcagccatgatcggcgatgtcagagacagagtcatcgtgatggttcaccattgctgcaggaggaagaacgagctcctcgatcagagcagtctctgacacggcgctagtgcagctctggccatccatggcggcaaagtcaaagcagccaaccatgtcatccaggctctctggaagctcgaagaacattggcgcctcatcattttggttgtcctgcgatgacacccaagatgatgccggtgctgcacggtcgccgccgccactggcttctgctggaaagttcaacgggtcatccatgctctctggacctccaaattcagcaaactgcgccggtgctacgccaccaccgctgtcagcttcagcatcagcttcacagcttccttgtggcagagagacgaactcaggcacaaaactctgaagctcatcctcatcgattgacccggttagatcagaaaacaccagggtagagttgtcccccacgccgaagcagctctgatcggcgccgtcagagacagagttattgtcatggttcaccattgtaggtggaggaagaaagggctcctcgagcacagcaatctctgacacggcgctagtgcagctctggttgtccatggaggcgaagtcgaagcagccaaccatgtcatccatgctctctggaaactcaaagaaagctggtgcgtcgtcgttttggttgtccagcgatgatgcccaagacggcgccggtgctgcaccaccactgccacaggcttcctccggtggcaagactatcaggtcgggaagagcagcaaacacactcgagcagccctgatcagcgccatcggagtcatcagcttggttcaccacctctgcaggaggaggaacaggctgtggcgagagcgccaagtcctcgatcagagcagcctctgccacgacgtcacggcttccttctggcaaagagacgaacagattgcgcgcggcgaactcaggcacaaagctctgcaactcatcctcatagattgacccgggttgatcaggaaacaccagggaagagccctgatcggtgacgtcacagacacagtccaccaccgcagcaggaggatggacgggctgtggcggcggcgcgctgtcctcgagcagagcagtctcgggcatggcgatctgtggggcgcagcgcgctcgaccgtgttcgtcgtgggcgctctgagaatccggttccctcttgcgcttcttgccgtggccactgaaccggatgcggtacagccgcatcgccgacgaggcgaggtcagccggcgacgtgatggcgtactcgtgcatcacccaccccgagctccccttctcgccatccgcgaagtagctgaggacgtacttgcgccacgcgatctccacgccgccgccgccgccaccatcggggacgaccagcctctcgccatcgacgcacatcctctgcccctgccagtaccctccgccctcgaccgtgcgcttctgccggctccccttgccgttcttggcccgcgcctcggcgaagaagaacgcgtcatcgcccctgccatgatccgcaagaagcctccatggcggcgcgcagaggggatcggcgtcgaggatgacgccgtggagagggaggggcttaccctggatgcgcgcgaggaggaagcgggcgacgagctcgtcgtccttgggctcgaacctgagccccggcgggagcccatctccagccgccgccgccatggatcgatccgcaggagaggagaggaatttctagggtttgggaggagggtttggttgggaagagaggagaggcgattcgaatcgaggaggggatggggatgtgagcaacggataggaggctatttaaaggcggcggcttcgcgggcgcgcgcggggagatcaggctagggctcagccgtgtggaaatttccccttttctgtttgaaagtttgatgcaattttattcagtttggaagttatttggaatagcttcgaatttcgaactgagatttttagtgttgcgctattgctgacgttgacactgcaaaatgctctggattcgcagcctaatgccatcccctgaattctgaagaaatcttttcttgaaagaactgaagaattttacccattctgaacttgaaggactgaaacatgggaaacatttagttgagaagacaataaaaaaggacattatgcttaatgaattgaaacagtttgggaataataagtggttaccccttttaagatcaagaatgtggttttcacctggttagcaccaagttaagaaaatccccctattaatgtctgctcgttgaaccgatgcatcatccagtagtattcccttttgtatgtacatgagttaactgttaactcatccggattcagatctcctggattgcctaattcctctgaactatccttctaaaaaacaaattcctctgaacttgcatggagtggcactgtgcagcaaatgcattacattttgattctagctagatgtaatacttacgtagtatcatcaactatatatacgcacctgcaaatctgcaatggtatagtgctagtctgaattcattttttttaagcatgtttgagtagcacaagattattcagtcatagaaaaatgtagcacaaactgtcctgggagatattggctatttctggttgctagtgttgagatcgacttccagccacacaaagatcttggtctcttggaccatatttatctgcagaggtaacatgcagtaggcctctgaatcaccagacaatttgaaccactgtatctgttcagaattttgttccttttttctttcaccattgctaactgaagatgctgtctggcagatcataatcagttacaccagcttatgttttgacattcttgaacccatcactttgcattgtgcgcaatacaccttcagatcaaacaaaggtcaatggggtggatatttctagttgcgaattcctgaaatcctgaaatgttttctccctttttcttttgtatttttcagcagagtcttaacattttgcaactgcaaaaatttggtttgcagctgctgcctttgtttcgtaccaaattctcaacttgatcgttcaaactgaggctttcgttaaaccaagaaaattcagagtgtatatatcaaaccgacgcaattgcgactgtggtcttgtgactacatccggccccagcccacgttttcctctctttttcaggggtcccacggttatttctccttttttaagggtcccatggttattttattcttttaggggtcccacagttattttttttctttttttaagggccctacggttattttttatttttttaagggtcccacggttatttttcagaatgagataagacccagcaaaagcagagacacatcccgagtccccgactcatccgagtctccggcgagagccgccgccgccgacgtgccggactccggccgcaccaccggccaccgcgctagctccgcttcaggtaaatcccctgagcagagaagatgggttgaaatctcatccgtttttttttgatttgaggtctcctacctccggcgatggagtcggcggcggcggcggcggggtgggggctcggagccgtggacggcgtcctgccgccggagctgctgctcgacgtcctgctgcgcctccctgccgggccgatctgccgcctccgcgccgtctgccgctcgtggctcgccttcaccaccgacccgcacttcgtcgccgcgcacgccgcccgccaccctgccccgctcctcgccgtcggcgtgcagggcttccccaggctctgcgtcgacctcgtcgacctctccggcaaccttgtcaagcagatcctccgcgtggggaaaggcagggtggtgagcgggagctccgccgaccgtgtcctcgtcgccggcgaggaccacagcgtccgcgtgctcaaccctaccactggatccatttcaattttacctagccatcgctgcggcggcgcagacccctcaacgattgcggcctggtttgcatttggtcagacagcttccacgggggagtgcaaattagtccggattttactgaatattgataactctcgtcacctatccgaggttatcaccatcggcgacacggatggagagtggagggagacggcgaacccgccaggctaccttggttggaactgcaccaatggagttgtgttcaaaggcgctgcttacttcatcttggattactgtttctctgatccctccttcctcgagaggggctgcatgccttcctttgactttgcgacggagaagtggagtgtggccctccaagggccgttgaacagaattctcgaggaatccaatggcacgctcagctatcatgaccttgccaatcagcttatgttatctggacttaaaggcactttgtgtacatcgcactggaatgatcaattttataccgtggatctatggtttctaactgattctgaaaagggtacatggtccaaagatcataggattaatgttgatgctgtttttcatgggattggagattatctgaaagtgcaacctttgcttgtgacggatgagggaaagatagtactctcgatgcagatgggatcaaaaggggttgtgcagatttatgatccagtaactgacacttcctcggatataattcagattagtatctacactggagcaagtgtgttcactggaagtttattatgtccacagagtgtgtgacaaggtaaagtttggtttcacatcatcacattattgatattcatgccgtaatttggttatatttgtgtgtttttatcatgtttagtttcagcatctttattttgtcatttatttcaagaaaaatgaccagttccattgaaatatccatcattctttatgatgttaaaaacttccataggtcaagaaaataagatgtttctccaactgcaattagcaaatgggcctatatactttgataaatgataattatagcagaaatgagaagaatccaatgattaatgaaacacttaatcatctgctcattgagatgtattgtagttatgtactgctggcaagtggcaattcttgctaaagttgtcgcctaaggagggtttgttattaatttaaacaaacatatattttatcaatgtgttgataaaaaaaataattggaaggtcttttgagtctttatcacaatatttttaaaacggaaaataattttgcatatgaaaatagaaaaaacataagttatatcaaaattttcatatactctgtttatataaaaatggattgttctatcatttaatctcgtttttagtggccaagaaatattgaaagttgcaaatcgcttcaccgaattgcataaatggagattagtagcatgagtccatgctgataattgagtctctagcttaaatttgtcgattgttttctcaactgcatgatactaggggagaaaaaggttagtctcccagatagctattagggaaaaaaagttcagttggcagtatgataaacacttggaatgccaattatgctttatgtcattattagggaactaaaaagaccactgttttatcttgtgatgtcatacatctgaaaggttttaacttgagaataaactatagaacttaagtaatgaatggaaatgttttaatgttgtggtgggagttcttgatcctggaaacacgggcatggggctttcttggtctgggacatgtcacatgcctgtggccctggttggcactatttatcttgaccatatgagttcagcttgacatatatttattttggtttctgcttctgtcttgtaggttggcagggcattgtacgaggtgctaccacaaagctgggcacttaggatctctactgctctgatgatgtttcggtttggtgtcatcaaggtgtagctgatgtccctcgaaaatgtaacaaaaaaaatggtgtagctgatatttgctgtgtcttcgtcatgtctctgaatctctgatcgatcgcgttattgcgatatgttctgtaatcatatcaacaattctggagttaagcatatgccgttagctcgagtttgagggatcgtgtgctcctgtctcgagttttacctgatgcaacgactttatgcaaatagtaggatgaaattaatgctcgtcaacgtaagtttcgttttcgtagatggattcctctgacagaagaaattaaccgacttggtttctttcatttatagtgaacttacaagcacggattttttgcaggaactttctttcagtatatagaactttctgttcgtatgagcaattaatcacatcttaatatcttaccagttgtccacttctgatgcatcagaaaactgaatcaaaacagaccttaacatttcgatggtcagtaaatgtatccacctgcaagaggcgaaatagaaggattttttaaataacaattatcacccagtacagcattagacagagcttgaagagagtcaagctcctggtaagaatggcatgtacaaaaacatctttgcctgctaatttgattaagcagaacctcctgccatttcttaaaaagagttcagggaatctgctatagaaaggaagcctgagccaagaacaaaatgttcatagagcgattgcgttacaaaaagcggcccacataaatccatgtcatacaagaaaagggtctcaacaactcattccaatcgtcatgagagtgattttccgttgaacacgactactgtctgtcataccgactaatgtgaacgaccattcaatcagtacgtaagcctcagttttcaatagatgaattcgaagcttccctcgtactcactctatccctaaatatttgacgccgttgacttttttaaacatgtttgaccatttaaattatttaaaaacttttttttcaacagagacatgcaaaaaaaaagagctcatcattatccccctggcagaaatgccatcaacttttttttcaaatatgatttcttcttaagaatccaaaatgtcacggccaagagcatccaattcatcaggaatctgttatcccccatcaacctcaggtgacctacaaggtgaaatgagtgaacaagaaagttacaaagatgaacaaaatcatcaaaattactgcaatcatagtgcaataaactccagatacatgatagtcttaactcttatcataagaaaaaaaactattctagagcaaagtattgtatcttgcatctaacacatccattagaggtgccattcttgtatgacgattcagaaatctactactcgttctgcttgtaaaaataattaacaaggtttttgcaaatcagacagcgtgaacccaatgacaaagagtgctggtccgtggccaaatctaattttcattatttattccttgcaaaggaacaatctctgtagtactacacaatatgcactggatattgctagtttatgctcaaaatgtgtactaaatcaccattttaaaaaaaaagagattttttatggtccagcaaattgtaccgctcggtaccagtacgcatctgccgttcgttccggcatgggtaggatcggaagagagtggcgctggccatgccttgaagcaatcaagtggcggcgagcggcggattctggcatgcgttgaagcaggccgctgcggcggcatcgaactcgtccttcccagcggcagcggcgttgaagcaagccgcggcggtagcgaactcgtcgttcctggtggcggaggcgtcgatgtcgtcctttccggcggcagcggcgtcgatgtcgtccttccccgtggcggtagcggtggcgatgttgaagcaggcgacggcagcagcgaactcgtcgttcccagcggcggcgtcgatgtcgtccttcccggaggcggcggcgtcgatccaggaggcggcagcggcgtcgatcgatcgagaatcccagcccttctagggttcgagctgcccgtccatccctcccgatccggttattgcacgcgaagttacgtttttgcccttccatctcagttctccgcgtggtactgcacagagacagaattggtaccgcccggtaccaaactctaccagccgttggatcgggccagatccaacggctaggattttggtacctggcggtaccggtaccgaccgctgtaccgtaacaac

SEQ ID NO: 69526 - DNA, 4179 bp, Oryza sativa
attcctgcagcccgaaaaagagatttcatctagaaatacaatttataaataattaaacttggtgataaaaaataaagactgttgaaagaaagaccatttaaaacacatgtcgagattaattaagtaatagccctatacaagagcagagtggtggcggttgatgggacatctaaaaactattaataaaacaccaaaaagaaaatcctaatgacgattaaaagaaatgacgacaggcaagtcgtgaagcaatctgtcaaggcggttggtgggacttctagaaagtaaaaaaataaaccacaatgataattatttttaatttttataatttcaattaaaataaaaatgaaaggcaatggcgggtcgtataggaatacaatggcagagccgccgatggttggtgtgtcttctagaaagtaaaaataatgaattctaatgatagttatgttcgacttttacaatcccaatgacaataaagtgtatgcggcggacaggtcatagaggagtatagtagcagcgtttgacgggatttctaaaattataaagaaaatgaaacccaacgagacgataaactctaaaaactataaggtccaatttttaaaagttcgggcttctgaaaagtaaaaaaataaaccccaatgataatcatgtttgattttaaaatctcaatgacaataaagaagggcaacaacggccgagccgtataggagtacagcgacaaagccgctgacgttctggcagaactgctagaaagtaaagatagctcgaacctaagcaataacgatgttcgactttaataaagcaatgacaataaagagaagatgaagtggacggtcgtagaggagtataatggcagcgtttgacgggactcctacaaatcataaacaagaagcccaacatgacaataaactttacatcgtgattggatccaaattttaaagattccaaggagaatgaatagaaacagtggtagatcgagcaatcaaataaagaataatatgacaaaagtaaagggtagcaactggtgtgacttttaaaaattataaaactagaaacaagaggatgataaggtttggactttcaaaatttgaagacaatgagaaaactatttaataaattttaagtaaaatcatattaaaaaatatataattttatatggatgctagccgcgcaattgtgcgggccacccagctagttaaatataaacaaaaagaaaaactaattatatagattgtgtgtaaattgcgagacgaatcttttaagcctaattgctccatgatttgataatgtgatgctacagtaaacatttgctaatgacagattagttaggcttaataaatttgtctcgtagtttacatgcggaatctataatatgttttgttattaaactatgtttaatacttcaaatgtgtgtccatatatccgatgtgataaccaaacccaaaacttttccacaaactaaacaaggctaaagttttattttcatactacatgttaagttgttgcttacgtttgaatagaacaagcacatttatagaaaacaatattatatttactgaaaatcgcgaaactagagatcacctggctgaaatcacaaatttagcattctatcgtacaacaaaagtttgatagggtgcatatcgaacggctgcacccatcaaacaacagttttttaacatgctctttgccaaagtgtggctgttcaatgggttgttcgctaggataaaaagaaaagtgaaagcgcatgcatgcagggtggcctacggaaccatggttgttcaatacatcttgctcgtctaccaccaattgtaaggttgattacctggcctcatgtacattttattgctccttcaagtgttggtgatattgtttcgataagctatgaacatgcatcatgtgcttttacaaccttttaccattcaaacaaccctgtcaaatgatagttgtggttgttcgatatgtactatgtcaaattttggttgtccaatagggtcttgtctagggttttctttgtattcttttcattgtttctctatttattattacctccgatggaaatattgatgtagaatgacactcttaaaaacaggaaaaaaataatatgactggtaaatataaatttgcatacctacataactagaaagagtagaagagtgataggacataccgagaatgatatgccttccatattgaaagaatggaagtcattatttatttattttctacctcaatgtttgctaccttgcatatgggccacaaatgggttgagaaattgtggcatccaaaacaaccccaactgtattgttggacatgaatcgactcaactctagatttattttttcagaaatttttaacgaccatttgtagggatcaaggatgcaagaaggttagggagacaagtgtttaaaatcttaagatatttaactatttatcactctttgatgtaattcatcacctatacttatatgttataggcatatgagggttcacatgtcattgacatatggatacaaatagttaaagctaaatttaagagtggccaatagataaattccttatcttttttttcttgcttactagttactccctccatttcaaattaatctacatatatttttttgaggttatttctaaatgatctacatatttgtgtttattcattgagtctattcgttatttatgtattggagtaaatggacattgatgcatgcaagtatgcacacaagtatttataacctacatgcaatatcttgatttgctattggctaaaaaatagtggggatggtgcatgcatcgagtttgttgctagagtgcatatagtatgagagagttattagcttttcttgattttggtgtacttataaaatatgtagatcaattaggaatggagggaatatttttttattagcaagtgagtgataaaccatgaagcgggtttttatgctgacagtgaaattgcccccttatgttgctaactatcttacttttgtccagaagtaaaaattacttctattgtcccaaaatataacaatttatatcttaagtataacaacttctacaccaatattctctttctaaccaatcacaaacctccaccatttaattttttcacctagctctacttatcatccaatcataatacttttctatttaattttatctattttcttaataactatgtttaactctaaaaatgtttatattttgggacgaaaggagttaatgtactactccctccgtcctctaatataagggattttgatattttgcttgtattgttcgaccactcgtcttattaaaaaaattgtgcaaatataaaaaatgaaaagttgtgcttaaaatactttgggtaataaagtaagtcacaaataaaataaataataattctaatttttttgaataagataaataatcaaacagtataagtaaaatgttaaaatcacttatattaggggatggagggagtagtacattaacatcttcctaagatggcaaaatcctaaaaaaatggtaaaaaaaatgggaggaaaaagaaataggagaaagaaaaatggcaaagatgaagaactcggcctgccccttcattcccttccatccacttccaatccatccagcccaagtccatctcccacccttccaccactacccacatcgtctcgccgccgtcgccgccgccggcgtgacctccgccgcaaatccgcagcccccaccaccgccacccaaagctctcatcccgcatgaaggcgtcgatcaagttccgcgacgacgaccggccgctgctgcgtgccagggtgccgatcagggtgctcgggctgccgctccactccggcctctccgccggcggcgacccgcgcgagctccgcctcgacctctccaccgccttctccttcggcccggcgatccgcctctcgtaccgccccaatgaccccgccctccccttctccgtctccgtccgcgccggcgtcgggcccctcggctcccccgcccgcgcgcccttctccctcgccgccgagttcaacctcctctccggcaaccccggatcccccgccttcttcctcctcctcaagccgcgcctcggcgacttctcgctctcccacaccctccgctcctcgccgcatcccggtaataaggtcggggaggtctccgatggcgatggccatgggcgcgaggtgaactacaagg

SEQ ID NO: 69527 - DNA, 11833 bp, Oryza sativa
ccctttgcaccctaacgctgatataattattccacgcagatcgcaagattaaatctcatgctcagtttgaagtcttggtcaacaagattaaaaaacttgaaggggctagaagcgaagtcgccaatgctgctactccactgatttaagccatgttctacaataacaacggtccgagcacaatcgatgatgttgaaatttttgataaattgagagctgctccggacatgtacttcaagaatattaaagaggctagaagcatgggagcaagcatggctctagcgatgactaagtccttgtatccgaagatcgacattgatgccgttgatggctttgcagacggaacaagtgaagaagatgcccttgatcttatcgatgatgcctagaaagccgccgacaagatcgctactgatgttgttgagagatttcaagataacaatcttggtccgactgggtctcatgaatccgatgatgaaaaaactgagtctgactgatttcaaatgatgtaatctttgacgatggagcctcaatttgtacaatactgatgtatttatgctgtgcttgataaattaaacttagcttttgatttcttaaaagtttttgtcaaaccttattgagcctagaacccgctaaagttgttagaaaactctcagtcctgattaactaagccaaaaaatcagacaaggcaatgataaatcgagtaagcaaattgaattgataaaaatcacactctattattattatgatagcccccgactagtaacttcaagaaatagcttgatgttggcagtcaaggaggagaaagtatatacaaataattcttaagcataaaaacgacgaaggtgctcgatattccacgaattgtcgacgttagaaccatcttcacgcttgagtcgataagatcccagccgagtaacttcagagattataaacggtccttcccaaaaagaggataatttgtgccgatctcgtgtagattgaatcttcctcaagaccatgtctccaaccaaaaatgcgcgtgatcgaacattgcgattgtggtaacatcgcaatccttgtaaataccgagccgactggatcagggctgcctcgcgagcttcctctagtcagttaagatcatccactcggtcttctccgtagcgctcctctttgaaattgcgaaaccttagggactcaaattccaccttgctcggcaacattgcttctgcaccataaactaaaaagaatggtgattgcctgttgacggtccttaaatcataatatctgaccgtcaatacctgcatataatgaaataaaacatggtatccaacttagtggtaggtattattactaatcatttccactagtgttggtgaaatatgtttatgcaggtaatttaaggagaaaacacatccgtcatgtgacaaaatgcacatccgcgcaattcaggacgcgtttacatggattagagtcccaataagtcaataaaaaccatttagaattgggccaaaacatagcccaggttgttgggggcccaataagcaacctcccggccgaaggagaggccgggaggagagattttgggttcggccgaacccaccagttcggccgaataaatcctggcgcttcctgccatctgctttcacctggacggctcgaatttctccccgaaggtggttgcagggtgttttggtcatttcccatacccctaaccgtcatttggagcctatataaggagatcaccttctcatttccaagacaaacaactttgagctgaattacaagaggctctattatatatttttgtacactagaataaggtagagagtgaggagaagctctggaggagtgcccggaagtttggcgctcattcgacttctacctcaacgagtgtagctttctatgaggaattttggaggagtaccggagctgtaggtacacactactccgggttcggagaaccttcttctataaagtaagcattcgtgttcctttcttatgttatttaattacttagtctgagtaagatatatttccatctttgcgggttcattgtctagtattcgtactaagtgctatagtactaggactctgcataaaaaggaaagttcctgtacaagtattagagtagtaattaataacttagacgtggtgtctaggttagagattacctgatgcggacatcactacctcggatgtacacaacaatcctccaacggtcattcaaggaccgataacaggagctcgtgcgcgacaattgaatttagagttgagctcgttcctatgttcttctttgtatgtattcgagaatagattgctacctaataattatattgggattaggaacaatggaggggacaaggagacacttggagaaggacttagagccatggaggatcatcgaggacgtccaagtcaaggtggaggcccaaaccaagtcgatctcgggtgcaattcgaagtccaggatcagtctgcactaaaacgggcacggcccaggtcgtatatgtgctcggattggggcgttctttatatggatggaaagctaagaagataacatttccaatggttttggtcccacgtccaaattctttccgagtcaatgggaatcgaccgaacaagttgacgtccagaatctgtcccggtgctgcgtcaccatatttgggcctttgggccgtgtatcgtgttggaacccattagggttgtgtcgagagggggttgcacgaccctaaactatatatatcagtacccgccgtcatctttaggtttttgggttttgcttagattattctgtcaagaacagtttcgctgctagatcggtttgtggaaccctaaattcgagtgcttaatccttcatatgcaatttggttgcaatctatcttgttcttgcttgtgttcttcgattcgcatgcagggattagccttctcggcgaggtcaaccgggtttcggcacggctgataaccagaggagacgtggtgctccgattgtggggctcaagagcgtgcgcgttcaagaagccggatcgatttgtgtcgtgactctttgtgtcgtgactccgcccaaatcgttgtttatcataacctttcggaagatcgggaaccctagtgcacatcattacctttgtttgttatgtatcccacggatttgtcagaggcaggcggcaggtggtgacagccctgaatcccgtccgagtaatcctccacgtttggatacatcatagagctatagcagaaaccacgctagcagaccagcaggggtcggtgcccgaagcaacagatatgaaattaccttgcttagcatagaaaattaaaacacatacatatagttgttgtccttggatcgtcttagccttaggtagattacacacgttccctgagtacgatatccttttggggtcacccgaaggtgaagtgctacaacggtattccatgcgcttgcggatttatctgtggtcgtaagaaataccaacaagcatttctggcgccgttgccggggaacggttgctaatttatccgagtctaggtcatcctcgtatctttattcttatttcttcttcttttattccttcccttgatgaagcaacccacaattcaaaatctttctgctcctcgggctgatctttgtgagccgtcctgttcttcaaaaccaatcctttccgatggctacgaaatcggtcctagctttatagccattgttcgagagcaaaccttctatggtggtattggtgaaaatccatacgtccatctttgggactttgagctagtgtgttcatgtttatcgatcgtaggcatgacacatgaggctctaaagtggaagttgtttcttttttctcttagagatgaagcgaagcaatggcacactctgtctgtcaagaaattccacggtgaatgggaagtgcttaagtgcaaattctgccttgctttctttccattaacccgtgtaattaatcttcgattagacatcctctctttccgacagaacgagaaggaatctctcggtgcaacctgggccaggttctcactgttaactaagtctggcccagacttgtctttacccaaccatatgttgcttcaacattttcgatacgggttagacaaggagtctgccgtaaatctcgatatttccgccagaggatcgttcgcacagaagacaaccgacgagggaagagaactcttagatctgatcttagagaacgattcttttggccgaagcggagccatctcggaggtcgagattatccatgaggatcctctgcatgtggagtcggaacccgactcaactgctgaatcctcattcgagttgctgcagccggaagaagaagaaattcatcctcaggaaattccattccgattcaggggtgatctttatgaagactatggaaacaccctgaataattccagcaccaaagaggctcatcccaagcatgaggcgtacaaggaggtgatgtttgtatcttcgttcatttcttctgaacccattgtccatcttcatgaaactgaacgaccctcatcacccttgatcaagcctaagccttgtctctctggccctcataacattgttcttgtttatcatcaagaaacaacccggttcttgcacgatgcatctcttgagaaagagaaccttcaggccacggacaagcttgagacatcgactctagaggacgagagaaagcattccacttatgagcatgaaagtttctctttcaaaatcccccaggattcatgctcacagaaggaatccccagagtcctgttcgattagtaccacttccctgtgcgaggaccacaaccaccttccggtcctcatttctaacatgtttagaaggatggttgtggatgcttatatttatcataaatactgcaaatctcgtatttgtttgtggcactaatcttgcagaacgatgtcccgttggtcaagcttgtgactataaacaaagcactaccgggagataccccggattatcatggtaagttttctttctaataaaagcaagaaccaatttttaggatagtatgcaccttcaggtattcttggtcgctaaccattgcaggttgagattaagaacgagggtcatgcgatgcctaagaacatggtagctacatcaactgtacgctttggtgatccttggtattggaacacactcgataggagaatccgacatcacacacttggtttttgatgtcttgcgacacaaaagtcgaagtgtgggggaggtcgacaagcttttcatgacgagttccatcaaccaaggtcatcttggtttgaagttggtgttagtcctagcttgcctgaaaaaaaaagaaaaaaaaagaagataatgaaaacaaaaagaggacaaaagagagacagaagaaaagaaaaaaatgggagaagaagaaaagagcaagagagctgatgagatacatttggatcaaagaccgcattatgtgcgtgtctttgaaatatggttatacatctcactagtagcaatcatgttgccaggctacacctagtccctctatcgagctcatgtgtcgccttggctcaagctttatccactcctagctgtgcacaacttctcactcccgcagcactttcgcgcatacaagcaagaggagttgccctcttcttttctaggcatttgctgctccactccagttggcagttctacatttgcccaaaaaagagagatatcctacgtctctacagcattgtgccaacggatcacgccttcaaggcacaaggttcttgcacctgaggtgtgtgcatgaccaacttgcttgcttgagttggcatggtcaaggtgccttcctccgctacaatttgcattgtgatggaggagaaaacgacaatgatatgtgaccatgccactgccctagagatttcaaattatccatcattctggcagtaagtacaatcaggtatgcgaaaaataaaccaaggttcaccaaacctttacttaatagtaccactatgtgaatatggcttgatcatacatggttatgtttcttatgtctatttgcatatgctctggtttgggtgttttcgtgagacatctataggatttttaaattaagcatggtgcttaggtgaaaatagtctactttaatcaaattggacatggagtttagtttgactaatgaatttcagagttaatatgttcatagacattggatatatatcttctgtggactaacccctgcaggaaagttttcaaattgacgggtgagtcctcaagttcaattcacaatggaggtaggtcagagccgggaacaaatcaattgctaacatacaaaggagacagatatcacctatcaaggtgcacggtgcgtatattactaatcgctcctttagcatgttcatgcaaatttacctcagccctgtatgagttgtgcttaaacgaaaatttggtgaataataaaattttgaaaaaaaaggtgttttcagaataaaaaaaagagtgtctctcggaaaaaataaaataaaatattggcaaacttgtgggatccacgcttcttaagttttgaatccaatttcattttagtgtggatgtgaacaattaatcttgaggctacgataaaatcttttcaaatcattgtagtgcttcgagtatttgttgtccactaaccttttgcaggaaataaaaagacaatcaaggagcagtgtacaataacttcaaacacttatatcatgctccttatccatgagaaaagatatgcacagggaaccaagtagaacaaatgcaaaacttgttgcattcttacattcggttcaaatcttggtaagacctatctggtaagaatctcatacaccatgtgcatcctcatctcatgtctccatcctgccaggatacccatcatatccattgttgccataaaaaaagagaaaaaagaaataaaataaaataaaataaaataaagttggctccttggtcttccaaccaagtgagtcctttgtgcttcactcatgtctttgtttttctttttgtgtccaataaagaacccccatacaaagatgtcacatcctgattttcgtcttaggatttataaattatttaataaattattattagaatttatattatatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagagcagttcagcaattatttaaataataaattaatccttaaatggtctgattataatcttgttacgtactttgagtgtccaattagtttcaggattcatgaaattatttgagcattggaagtatttttaacaatttaaagatcattttggtgattgatttatttggaaaagtaataaaaatcctcctcctcagcttgggcccttttcggcccattccttcctcccttctctctgttcctcagcccagcgtaaagtctaatctcctccctctcgctacagtgcttctcctacctccagccggctggacagaggccgtgttcatcccgataccggcgccaatctccgccgaatccggtcgcttcgttgcttcccttccaaaattgattgcaaaaacggattcctctctatctcctctatcttatccacaagaaacccccatcaaattcgttatctatctcacgaattttggccgtttttattcgggtgaactcgagataaatcctaatttccttcaccaaatccatctgttcccgaggcgatctctccctcttccgactataaatagaatcccctcggcctcctcttcggtttccccctgtttcccgaagttttccctaaccctagccgcctccccacgctcgtcttctctctccgtcgccggcagtcgctccagccgccgtttgccgtcgccctcctacgccgccacctccctcggctccgcaaggtcgagctctaccccgtccactggtttccctctgccaaatcccgccggaagccgctgtcaccgtgaaggccgagttcgccacccctgtttgatctccggccgagcctcctcgctgttgcggtcgtcacccgttcaccccgaggccgtcgtcggcatcgcagcaccaagccttagcccgtccacccctccgttgccgccgctcatcgccggaaagccgtcgccatcgtcaacccaaggtcgccgtccttcggagctcgtcgccggccatctccctcgccgtctgtcgtcgcgtaagtggtggtaagggtcgccttgatatcctctctctctcccggtgccctccgtttgcatcattgtaccgtggttcgctggtaaccgccgttcttgtgctcgccggcgtcgatctggcgtggtagccatgtcatcgctgacatcagcgctatcttggccatcaaaatcaatataaatcctgttatcccttttcaatagcatattagttttttttactatatgtcgtctactaaattcattccaataatttccggaggatgttttagtcttttatctcagatataaattatttgtaaattgtttaattaatttggaatagtcttttctttaataggctttaattggaattaatcttgtaaaattcataactaatccatatgaaatcggaatgaggtcgttcaagtctctaaattcatctaaaatcatgatctacatgtttgtttactttttatgtactgtttatttggtttttattaatctttttctttgttttgcgtgttagcttgtcgtttccgttgttgcgaaggttcatgagtgcgtcggaagtgttcaagaagactaattgaagaccgattattgcaaggcaagtcacacagatcctaaacaaccctttgagcattctgaacccgtttaaagctaatgttttatttcaatttatgcattattttagaatagcatcgggtggtgagcctttcccaattaattaatggccgaagatgactttattttcctatgggttataatttgattagctagaaccttatatattggtttggttcagctaaatgctatatatatataattgcttagccatgcttagaaacattaactcattaatgggatgaatcatattacattatttcttatggttatatttaatggtagctcacgatggtcaatcgtgctatgataattaattaataactaaaacctgattaatggtgggttgtgagcatatggttttgaaggtcgtggtcatgacaattaaggatcggttcacaagctactgttgtgagacattaaccgtgccaaccacaagccagcgtgggcaatggctttaccttttgtatagcatggttcattacggggcaccagactgagaagcggcgagaagtccgtgggggtcgctggggagtccatgcctctgttttttttttttgagggggtgattatgatccaggaatggtgcactatggtgagttgtgttgtgcgaggggtactgtcacagttcctttccgagataccgtggtggtattgaggcgcatggtaacatgtcgtggagctgtgtcttgtgggtacagtggtacacctctggccagagtaaaactattcgaatagccgtgcccgcggttatgggcgggttaagcagtctttttcgtgattagtctcatacctctcacaataattattaatgctataattggtaataatttgtttacctcctggtttggagttagatctgtgcagccgggtttggttgttcagaatggttgggcctgagcagcatgggtgtgctgttcagtgttgattaaaattgatgattactctactgttttactattcttaaatatttgctaaatgctgcttttgcaaatgagcctatattatgccatcctttggtatccttgtgcatttgcatatttgttgtgtggcttgttgagtatgtcatatgctcaccttgcaataatcaatcaacctcagttgaagaaaaaggatccagaaggagaagacatttggcttataccccagttgagctgcctgtgggagtggagctgaagccatcgctagactgttattccgctgttgtttttcttttggtttgtaagtatgtaacgttattattatgatagatttgtatattaaattatcagtttgtgtacctcggctgattcctggacgaggaatctatgcacaaattagttcggaaattactagtgaatttctgagcgtgacaaaagacaagtgtgggggtgatcttgcacatcaacgctataaccaaagcaagatcaccctagaagtgatgagccatgacaaaccacacaaggggaattgatgtagtcaaacccaatgaggggtcagttgaacctccagttcggctgaaccacctctatcgtgaatcgtcctctgttttatacagagcgcaggtttgcacaatttttcctttggaaatccattctatcttgagtttaatttgattatcaattctaaaatatcgaagataattaaactcaagctagagatggtacaattagagtttatggtctccctgaaaataacatgcatgcctattattctttgctcattacttgttgcttgtggtgacatatccaatagggaccccatgttatctaggtaattaatgaatgaaatatagtctgatgatagaaatcctgctcttcatgtggcacacttgggaattttataaaaagaaaaaaaaacatataatgatgctaaactcctcattgatatttttattcccactagagccataggttgatcattcatgattagcttgctacatacgctgcttgtcattacattgagcgttgtcaagttttgtgaccctagtgaaatgcttttcatactttcatggtcaagatcacatacactccaaatacacccaccaatgcttgacttctacactggaagttagcattgctcatttgtcattcatttcatccatagtccacaaaataaatactccatgtcatttatgcatcttcctccaaagttctttcaaaaagagagatagagagagaggcatggctatgaaaaagaaagaaaaaaatgctcatacaagtatggagcatgatgatgaaaaaaaaaagaaagaaagaaaagaaaaaaaagagatagccatgcattctcccaaatttcaaaagagaataaatggaggaggaggtatacaaaaaggagttatttttattttcctttttccactcacaaatttaccacacacatatacatgcacattcttgactagaaagtatgactagtatttccatggatcctttatttgactttgcaatatatgtgatgcaagtaatgctcttctcttttccatactctgagctccacataagccttattagatggtaggaaaagaaaaggcacaatcatatgcctttgtggggaatcatacaccttgagtgatcaagagaataaattgaggagcaaaccgaagttataattttgtgttacttgagaaaaaaccccaagttgttcttcatgaaaagttagggtgacttaagtcaagattgttccatttctcaattgttcaagattgcatagtagacactacaaagatcctcaagtacaggtatgactttgaataatttgtttgcatgattgttagtaaggaagtcataactctattgtagagtccatagccttcactctagacgagcaaaggttaagtgtgggggtgttgttgacggtccttaaatcataatatctaaccgtcaatacctacatataatgaaataaaacatggtatccaacttagtggtaggtattattactaatcatttccactagtgttggtgaaatatgtgtatgcaggtaatttgaggagaaaacacatccgtcatatgacaaaatgcacctacgcgcattcagg

SEQ ID NO: 69528 - DNA, 3388 bp, Oryza sativa
aaggcctatgcaatgaaggagttgactagaaaaggctttatattatacagtgtcacacgataatccttccccctattgcacatctcatctttccaaagtcagcttcccaaaacccctatttatccatctgatcctcgtgaaatcacattcccctactgcctatctcggctacattgccctttgccaactatagggatggtgcggaataaccgaatataatttcagctacatcgcccagtgggttcccgttgatgcctggttgatttagtacaatgaaatcaacctaaagttccctccgttttaggttataagacgttttgattttggtcaaagtcaagactactctaaatttaactaattttatagaaaaaaacagtagtatttttaacccaagacaaatatattataaaaatctattcaattatagatttaatgaaactatgcttgtgttgtaaatattaatattttttctatatagttagtcaaacttagtagtttgactttgactaaagtcaaaacgtcttataaccttataacctgaaacacttataacctgaaacagatggaagtatattgtatattcagtgtattatgtaacagatgcagtaacctccccacgaaaaaggaaaacctccccacgaaaaatgaaaagcaaaaggcactagcccctgcactatctgtgcgccatggcgtggagactatcagccgaaagtgctgaacttaggggcaggaataggaaaatcgtaaggctgcataagaaaaatggaggattagtaaacaaaggaattttggctgagtttttttctctaagtttccaactcactcatctcgtttttcgcccgcacgctttttaaactgctaaacggtacattctttttttttcaaaaattctctttacgaaagttgctttaaaaaattatattgatccatgtttagaaaagagctaatacttaattaatcacgcgctaatggatcgtttagttttccatgcgtgggaggcgaagttcctaactcacctcccgatcacaaacacaacctttgtaggattagatgttccgaatatagggatagaaaaatgaggatttcatcttatggctgcctatgatgaaaaagaaagaggttggagtggtgttgacgaaaaaatagaacacagcggcctgagagatctgcttaactcctgtgcaggtccaaagattgatgagatgcgggcgtgccagtcagtttgatcctgcaactgacaagatatgcaaataatagacaaaacacccgatcggctgacaagccgatggagtagttccagccgatggccgataatagccgatgccaataccagccgatagcgatagggtttaagcaatcggctatatgtccaatatagataatgatataaaggcaatcggctgatgatgatgtaataaaataacaatataattcagtagaaatcaatcggctaacaatatgatatagtagaacaagtattgatctaaaggttaaagcacatatcggctggtggttcgatgtcattaaatccacaagattagataaaacagtgaaacctttgttgtcatcggctaaatccaacttatatgtatgtgcaatccttacgagccgatgcaacgtccagataactcaccagctgaaaccccgatgaaatccttattggcagtcaagcagcaggctagagattatggttctaagcacgacttagtaggtcaaacttaactgatgcagcactaagtatgaaaagaaacataatatctagacaatcaagccattgaccgagtttttagggtggtagatgtctaagctaatctaatctagcaacgcgatttagccgataccggcagaaaccctaaaatgagaagcagccgatagagctaaattgatatgctaagactagattaacagatatatatgataaataggtaaccagagcaatccaagaggtcgaatgtactgatgcagccttaaacgacgccgatgtagatgagacaattgcatgggccgatggaacattggatttaccccttcgccggagatcgaacatcgatgcagccccgcgttaagtgccaagtcccgccggaacgtaaaaaacaaaagtagaagtaaaaagggtggcgatgcgccgaattgtattgatcgtgaagatagattacatagaccccaggtgtacatatttatacccatgggttgatacaagttcttgtcggacaagaaagaaactatcctaaagataaaaggaaactaacaaactattcctaattaatagataaaactgccttcttcggactcgatccatacgtggcagtcatcatgaagcacgtcaactcaatctgacaatgattctaatatcaccttgccggaatcggctacatcggcttgccttgtccgattcggtaactgtcgatgcacactgtagccgatgcagttccgaagccgattcatatcctgtttctataatcgatttccctccaaatccacttcggccttagctccaaatccgatgtaaatttaccaaatttggttgttaacaagtggatgtttggaatcatttggaactcctatgttttcatgggaacattacaatattcttccaaaattcctttgtgtgtttcctacaattcaagaacacgtgaacagtagcaaattcaaaggaatcataaatcctacaaaatcctttgtaaattgtaaacccttttatttgaacaagccataaccaaagagataaaaacgttaacctccatcactagttccctaccgtactactactcctaccgtacaagtaaaatccaagaaacattatggtgcgccccacatgccagccgattttctttcttgcttaattattatccggcgtcttaaaacactgcgtaatcatggatggctaggagaacatgacaactgtataaaataataaatcgattgaacctctaaaaaaaatactacgacaaaatcgactgaataatacgacctgtacctggcagggtgggccccaccactccgtccaaaaaaaaatgttcccagttaaattcggacccatttcgcagaggcaccccacgaaacctccgaattacccgaagaggcttgcggttccattttaaaatccaaccaaataaagaaagtggaggtgaaaatcgtggatcgaaagggacgaagagaggaggccagggcaagggaccaaaacctagacgaaccacacgcagaagaagagagagaaagagagagagagagaaggcccaaacaccaccaaaccctagccctcacctcgccccgccgtccatggaggcggcgctgtgacccgccgccgccgccaccgtcgtcgtcgtcgtggcgtgcggaaccgatagggcggaggggatgacccgcagatcgggcgaccccggcgtct

SEQ ID NO: 69529 - DNA, 4105 bp, Oryza sativa
  unsure (1)..(4105): unsure at all n locations
ctgatcggtcggccacaatttttttggaataaactgcttattgcgattttttttatttttaaatggttaggtcgttgcaatcaaaagtgaaacggctcaaggaggagagggaaaagagcatctccggcgagacgaagccgccgccggcggcggcggcggtgaaggaggaggaggaggatgtacggaagggatcaccggaggaggccggcgccgtggaggacagggtctccggccacgaatccggccggtcatgcaaggagtcgaactcgtcagatctgaagcggccggagaacgaccccgcggtcgccgacgacgacgaccgggaggcggaggaggaggaggaggcggcggcggcgcccgcggccggcgacatcgccgtgaaggaggaggcgtcgggcgagtcggtggctgggtcgaaggaggcggacgtcgagaaggagagcagcgacgtgcagagctccgccagcccgtcccgccgccggcgacggaagggcggaggcggcggcgaagaggcggaggcggcgtcgccgtcggtgtccgtgcccctccccgccgccgaggccgagccgctcgtcgccttcctcgagtcggtccggaccagcaaggccggcgccgtgttcgagcggcggctcgatagccaggtaagaaaaaaaaaactcctcccattttcactcacagtaaaaaaatgaaaaaaaagagaaaacatctggtttgcttctaataacatttcaattacccgcactttaaatttttaactgcacattcttgcgatttattattaaccgtttggcgattagtgcctcaactaatcacgaaattatagcggctgatcagagtaaagtacaatcttaaaaggggtcagcctcttcgttcgtcacggtcgtcatgagcaaggaaacaacgtggaattttcgcttctcgtacggccgcgatttggtcgacgaatctgagccgttggatttaaatgtcccacgaggatgcggagataataataaaaactgagggtgaaaaacgagtggcgttgggagaggcgcggcgttgtttggttccgtggcggtgggcccgggctggctcagcatgggcccgtcatgtgccaccacatcatcgttgtgggggagatgacgtgtgggcccatcatgtcggccactcgctgccaagcccaataaaaatgatgcaacgatccttgaccgtctccaaatgcgagtcgcccaggattatgaattttaagctcgttttttgtcatttttttaaactgatttttgaatctttgttcattttgcaggatggggagaggtacagtggcacgatcaggcgccatgtggacctggagacggtcaggtcgaggctggtgggtgcaacggcggcggcggcggcggcggcgtgctacgcgtcggcgtccgagttctaccgcgacatgatgctgctctgcgccaacgcgctcgtcttcttcccgcgcggctcgccggagcacgccgccgcgctccagctgcgcgcgctcgtctccaagcaggtctccaaggaccggcagcctcacgccggggcgaaggcccccgcggcggcggcggaggaggaggagaagaagaagccggccaaggccgacgccgacatcgctgggccgctgctcgagaaggcgccgatcatcgtctgccggaagcggagctccatcgcgaaggccgcggcggcggctgccaagggggagaaggcggagaaggcagagacggacaagaaggagaaggacggcagcgaggagaagaagaaggctgcggcggcagcgacgacggcgacggcggcggccactgccaaggacaagaaggctcggggcatgaggacgaacaagagccggggacccgcgaggaatcagaagacggcgaagctctcggagaccggcgaggggaccaagaagtccgacaagaagggcggcggcggaggcggcagctcttcggcaggggcggcggcgggcgaggttgccaagaagcgaaacgccgtggatttcctgaaccggatgaaccagaacggctcgccgtcgacggagagggtgtcgttgctggagacgctgaagctctccgcggcggcgacggaacagcaagagacagtcgtagtcgtcgtcatccgggaagggcgacggccggaaggaggccggcggctcaggctccaagaagggcgccgcgcctcgacgccaccagggaggaggatcggtcggccaccgaagcgggcggccgcgccgcagacgccgccccgttccaagagggccaaggacgacaagccgaccaggaagcgcgggaagaagtgaacggtcgtcggaatggggaggtggcgggaaaggctgcgggtgtaaatgtttgtaggggttggcggtagaaaaaaaccttttgtttttgtgttttggcgccaattgttgtagcgaggaggtgggagaatttttgttgctttttggcgggagatgaacgatggaacatctggtttcactctcacctcgatacttcatgaaagattaagaactttggtgaaagaatcgtgttcaccttaaggctggttttgtaggatatgtttttgactggattctgtaacctacactgaatcaggacacattggtgtcaatatggcatgaatcgaatcaagaacatatggtgtcaatgtggcatcatcatttaaccgcaataaactcgagtgggattctgtaatctggtattgctgttggaagttgttacatgcatatctgaatgcacatgtctcagctgagctttaacattcttcacctggctggcaaaagttcgaagaaatttcacctgtgtttcagctttgctgtaacatttttctctggctggtaaaagttggaaaagggtggaggtttaacgtttttcacattgctggcaaaagttggaataaaattcatctggcttgcaagaaatggccaaaaaaaaaagaagattttaaatcatgcggtgagcgtggatcgaacacgcgaccttcagatcttcagtatgacnnnnnnnnnnnnnnnnnnnnnnnnnnnttgttcagtttattacacgagtaattctgttttcttcgcagaattcattaatgctgtgcccgccgtacaagatgcaatcactgagtcacatgccagatcgctttgcagaacgtgttgcaaatgagtttctccaaacctttttacacagattcatattagtcacaggattcataaaataattttcttgatacaggatagcgcgctgcatactgtacagtgccgcaatttctttgcaggcacggatggcacagaagcaaataatttacaacctactaatttatgtccccatttcctgaaggagaaagggggtttcatctacgctctatttttagggcagttatctctacatttgcaaagaaaataccattgcaacaatacaagatatggagatctctaacaatatatattccaaccacaaattcacaattcatgtcgaccaatatatctggccgaccttgcattcttcacatgagtttccatcttcacccaccgtctgaagtgggtatccagttagtgcctgcagttctaaagctcaagacgtcaccagcaagtgatgccatgaccaccgatgtcatgcaacggtagtacctagttggcttgcaacgagcacaatatcttctgttatataaagtataaacagcggttagtgaaattgatcaagatcataagtaatgtgcaatgcatcatgttattccacatgttcgctgagtagctagacagtatttgggtttggtctagcttaagacgtcccacctgagaccaaatcgatgatgtgcataacttagcatacccgaattgtgatttcattttacagcccttcatagcaggatatagtactagcatctattaataacagtttcatatattgttggaggtagaattggtcttcaatttgaataaaacataaaggttctatactatgtccagcgttccagacagactagtgagaggtaaggaccaaatttaactggtcatttcccacttttgctcagaataagaaggcaaggggattttgaaaggtaaatacacatattaagccatcagttaactcaaactagaacttttgatactttattttcgaaattttggggg

SEQ ID NO: 69530 - DNA, 39723 bp, Oryza sativa
actagtggatcccccaaggaggaccttgcccaccgaagaaagagaggggagatccagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttctcagcggcccgaacctgtctacatcgcccgtgtcttgtgcattggctctctcgcgaacattcccagatcgagggtgaagaacctcacttagcgcccccggccgaaccggcaaagggggacctgcgcggtctcccggtgaggagccccacgctccgtcaggtggggttcagtttctgctcaggggtggcagcagcttcagtccgccgccatgcggaggcagggaggggtcggcgcggccaggggcgtggcggtggcagcggcggatctcggtgcgcgtggcggcagagctcggcgttgacctggccaaggcggcgaccgggaggagggcgcgctcctcctcaacgttcttggcggcggctcaagaacgggcagcgtggtcgacgccgccgcctcgcctcggcgttctgtgttcttgatttttcttgtgtgattttgtgtgacttgattttcttttgtgattttgttggtagctcggcgtcggatctcggcacgggagtggaggaatcttttcttggttttgtgtaatgtaatgagatttgatttcttgtgggaatgggggatcctttgtgagtgagatttgggttcttgagatgggtggtagctgctccgacgccattccaatcgatgccgaggccgccatggattttgtcctcatggcggcaaggccgatgccggcgcgggcaaaaggactcggtggcggtaggatgaatcgcaggcgcgggaagggattttttcgtgggcgaatctggaatttctccgagtgctgcgtgcgcgaggtcacgggcggccaagcatcgacgcccacagcgctcgctcctcgtgtttttctggcggcgcgtggattcgaccgagcaaggttgcgcgttgctctgcttggggacgagcaaccaagtttggtcctggttccacgcgacatgtcggacaaaatcctccgtgtcgccccatagcaccggtccagggtagagcactgtgaaaggcctcatctatgataacatcaacgagttgctcatcatgattccactcgctgatcaacgagttacttagtaacgattgtcgatgtagattgcacggatggcattctcaacaactactagttccatagaggtcgtgtcagtcgtggcctacgtgaccaccacaaacaataggggaattgggcttgacgtcggagctagagcattttgtcaaacacatggtgggcgtcaccttggactgcttgtcccaaccgaattttgcaagtcttcggcattcttctggactttggtcatccacgcttctaccaccgtcttgagagatagcaaatcagcgctcgtctgatctgcctccacccgccttcacttgaactcctcaatccgcctcaaaagcgtgtcaaatttatcctcacttgccatggtagcttgtttggtaggcttggtgagctctgacaccagattgctagcaacccaaatcaaccaatctcagcaccaactcaactaacaatctagccgtacaagtagcagcaaagtctagtacataggagatatttggatggggaacaaataggaagatacaagtggtggaaggtgccagaagcttctagaacaagtagtggtaaaagggaggtagggagaaatcgacaagggagcccccgaccacccaagtcgtcaccaccgccaagagcttccgctcgccaattgatttgttcgatgatttcctggaagtgctgctgcttcttatgtatagttgtctcttgggttcgcttggacttcttgaaaagtagatgatccactccaagttgcagcccagctggttcctattccctccgtcccaaaatataaatatttttgaactctgacacggtcttcaaaatgttactttgaccaataatatctataaaattaaggtgttttaaataaaaagagttgcatattatgatagtttgttcaatgataaatctagtaacatcaattttacatgattgattttttatatatttttgctattaatagtcaaagtttaaaatgttttgacgtgtcactatgctaaaatgcttatattttaggacacggagggagtaacacaaagttatattaacttatgttggtgttcaagccccttcctagggatgaagttctccgggatcaagttagttatcatgcaaacaatcacgagaccgttgaaaatttaaggaatacatgaacacatgatcaaataggtaaactacgcaaatatgcactctgttatcaagtgcttaattattccccatttttgtgaaatgatcaaatctgaccatgtatatcacatccatgttgcctgaagatgcggtatatgtaccctctaattcgcctgcgccaaagaaggcccaaaaaagagacgaaggacgtcatcggtaggaaaagccaccggcgaggaaaaaaaacgagagagacgacgacacacgcaccatcagacgaacacggacacagcaacactgtgaacacacacgcacaccgaaacaaacagaataagcggcagcccgaccgcgtccgtcggtgccagaggtatcgatcggccaatcagtcgcggtagcacacgagcagcgcgacgcagcggaagatgatgcggagcctcgcctcgttcccccgcgcgaccctgcagccgccaccgagctggctggcgcccctgcgcttcttcgccccgtggctcctggcgacgacgagctccatggtctccgcgcggcgcgcgctccttcgtcgctggctctctctgccgcgagagcgagtgagctagctagcaactactagcaaatgcgtccgcgcgcgagagccagctaattaaccgggcgctggcatgccaaaaaaacactttgacgacggtgtgggtgcgcgatggagtcggggctgcttgttgatgtgtttatataccgcgcggcgcgcgctagctctgatcgtacgtacacttggacggacgctggaaggttcaatgtaggtcgcgctaggcgctagctaggtgcagttccagtgcagctatcgagctgtacgtacgtgcaatgcgtacgtacgacgccttgaccgtgggtagctcatggtgagttccgtgcaaacgcatgcaccaacctgcaaactttcctggcccgatccagcaaccagatggatcatcgatacgtcggctcgtccatccggcatttaaagtcaaaccgcctggtgcttgattattaacgtccgttcgttttgttcagggaggttagaaacagtccaggatacacgatcggatcctgcagctaatgttgccatccgccatcggccatccgatgccgggtatgccgatacagccgtcaacccgcttgttgttcgtcatcgctgaccaatgcgtcgtatcgcgagccattaattaccttttctttgtaggtttgcgaatacgtcctgtctgcttccatgccttgaccgagcggcaagaatctttttctttcatctgcagtgcagtgcaatcaaccatcgatctgaacgttagtatcagttcgtcagggttgctatgatacacgtctactccctccgtcccaaaaaaaaacaaactctggttttcgtgcccaacgtttgaccgtccgtcttatttttaaaaaatataaaaaaattaaaaagacaagtcacgcataaaatattaatcgcataaaatattaatcatattttatcatctaacaacaacgaaaatacgaattataaaaaaatttcatatgagacggacagtcaaagttggacacggaaacccagagtttgtcttttcttggacggagagagtacacttccatatggttctgaaaatttaaggagcgcaactaatccagtatatatataacaagccaccggccctatccaagttactctttgactggccacacaataatacaatggtcttgtttggatgctccgagctattaaatagccctccagaatcttgctatttagaagtattaaacatagattaccgataaatccgattccataacccctaggctattttgcgagacgaatctaatgatgtatattaatccacgattagcggctgattactgtagcatcactgtagcaaatcatggattaatataccttgttagattcgtctcgtaaaatagcgtaggggttatggaatgggttttatcaataatctacgtttaatactcttaaatagcaagattctgaaaggctattaaatagccctccagatccaaacagggccaatatatcgatgctactcccatgagctaagcacgatccatccattttggacatgcatatgcaggatacatcgcatcaggacgaagttaaaacggctacgggatttggccggcacctcaagtttaacgtacgtcctataccatcgcatcgatcactcgtctacgggacagaatcgctacattggcgcacaagccagttgactgaaaacctcggtgggcacaaacgctaacgttggcataacaaattgtgtgaccacggctctgtgtgtcttttaaaagccggtcaaagaagagcgcttgccgttgttgcaatccagagaaaagtgagaaaactgttactactactaaactggcttatgaactcctagtagtcaactgacagcacactcaagcctctctgcagtctgattattcaaccagcgattcgtgttcaggtgacgtgccatttagtcctgcaaatagagagagacgctactgccagagtgtgctgactggcgagaatttggtagggtttcacatgcatatctacggctgtgtggttagttcgtattccctttcagaaaacaaaggcgaaatgcttgcaagttgcaacctctatagatagattttaaagaaatgcaatccatatcatgtacgtgtctgtaatctgtacaaacaagagcttgttgttaattgttgcaatttgcaaacatgtatgccgggccggccaaagagtaggtcggccaaatttcattaagaaagagagtgtttttatacaggttttgcactttgagtctttgacaagaggctgtcaaagctgaagggagagtgttaaaaaccctcccaaaagataaatttgcaaacatgtaatccagataaattgttaatggctgatgagctcctcattgccaacccgtaacacatttacaatcttctcttgctattcaaccagtggtcattgttcgtattacgtccgatgatttagcccaacaaatagaagaacccaaaatccgctattactctctacagtattggtgctgctactaattaaccggtaagaattaggtagggatacacatgcatcatctacagtatgtggtcgcaaaactgccgacgcctgcgttagtttgtgttattcctttaggtgaggtgcttgcaagttacaaacctctatagactgatttgaaacaaaatgcaatctacgatcatgtacttgtctgcaatctttgcagacatatcaataacacagcagatcattgatgaccagaagttagcctccagatcattaatttgggggaatctgacgatctcagcacatcaggatcttgcaaaaccgaggacagaaactcagatatgtatggccagggccagacagaaccaagttagtgtcaaacaagttggaatgttagccatacgtatagctaaacaaatcccagagcaagattcatgaggcattataggccacaaaatttttagaggcgttgtcccccagatcgatcttgcatcacacttcgtgcaagttgagaaaccgtggcatgtgctctgtggagtacttgcagctacccactctaaaaatattaccagtacatcaaaatgtatgatatattattggtagtttacagctagacaatagaaggcttcttttaaagaaaaggagctagagatttgggcgcttctcctctatataagcacgccaaatgcaacaggcatcaccatgctaagcagaagcacttaagcactaaacacttgtgaaggagggctgtcttttttcttcagaggtgtgatctgatttctccaacagtatgggcaatccaaggagccaagggagaagaggaggcctcggcagaatgttgaaggagcacaaggcgaggctgtacatcatccggcgatgcgttgtcatgcttctctgcaaccgcgactgatcagtgatcatactgatcatcacgcatttttgttgtagtccgggtcctccgggatatggacggacaacttctttttgttctggatttcacttccagaatctagggttaacaattctttgatcgatgtatataatcatgtatggagggctagcatgttattttccaatattttcaccttttaacaccggtgatttcgcactctactttgttagattgacataacagttctctttttgatcgttcagaaactcgatctgttattctggatccttcagaaaaacaaaagtagttcccggatagtgttttatctgaagttctgctacttgtttttctttcactttctgctccaaagaggaaacaagtctccataataattcacacactagtcaccagcaaattagaatactgtcatcaagttgacaatgaatattttgtgcataagttgggaaacaagtttacacactagatactctttgttgtcttgccaacaaagcagtgcaatttgcagcagtggacaacagcaactgaacctgaagcttcaaggcagtagtagtctctagcttgaagaggcttgtagcaccatgttctgtactttcatagttgttccccttcgcatctatccttgtggtcttccttggtactttctgcgtttggatgttacgtttggtgctgttcttttctctaacaagaattgaatgaagattaaaatttttatggtacatttttcaaaccgctaaatggtgtgtttcgtgcaaaagctttttatatgaaagttgctctaaaatatcatattaatctattttttaagtttgtactaattaaaactcaatcaatcatacgttaataccacctcgttttgcgtaaaaaacttaatcttcatcttcattttcatcttatcttgattgcctgatccgatggctatcaagaccattttagaccttaaccaaaaatctagccatgttgaaggatttttttgtgcgaaagcatgaatgatgtattgttgaatactatatacatgaatacatccaactatcctacaaatgatttcgattttaggcactgaacctttaaaaggtacgggcggttttggggtatgctctaaacccaaaccttcttccgctctcgcacaaaactgacaaaagaaccctcaaaccttctgtcaacgccctgaagtagccttgatttgtttccagtattatgaggggacctgcagtcctgcaggaatgatgcattttggtgttatagttctatgctcacgctttatagctacattaggaggatttctgacgaatggtttttatatgattcaattttatctttcagtttttttatttttaattttctatgtggtgggagaagtatgatgactccacttttacagtagtagaggtagtttttttttataacacaaagttaagattttttttttgacattcaacagagataagaaatgctattgaagcattgagagtttgagactaaggcttaagtatgtctgcaaaaatgccacgccgcctcaccgcccttttgcaggcggtcccaaggggactgcttgcaaaaaaaaatcggtgtcccctgtggccggccgttatgggagggcaacggccgtctgccatatcggcaaaatcgtcttctaggagggcgagggcgatggcgtgactagttttgtaaattttttaaatagaaaattatttttgtaattattttaataataaataaaattaaaaataaaaaaattccacttaactgatcgcttaacgggcaagatgggcctccgctccactggcccaaccacgtagcaagctccccttgaacagagtggaattttttttatttttaatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggcatggaattttgcaggcgacccccttgccgccctccgcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatatttaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatgtttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcattttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaattctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggatctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagtcagtaagcctggtcgcgtgtgcacaaggacgaaagtcctagcggtgctctcgcagcgacggcctcttctgtgtacggctcccagatgacgtcgctcggctggagacggtcaaactcgaacacgaagtctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaatatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctatcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatcttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgaacatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatagatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacaccttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctatgatgaattgagcgaaccagcagggcttcgccgctccccttctgctgccctcccctctctctcttttgttttttttggatttttagtgaatataataaaatttcacagaggagggactgggctttatagggggagaggcaaaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgcccccctcgccgccaatttgcaggcggccccccgcacagtataaaatcgccctagcggagggcggcaagggggccgcctgcaaatttcgttgacggccgtcgcccgagagcgaacggtcgtctgccacgtcattttcgccgccctctgagagggcgatttttcccagagggcggtaggcgactccttccgtcaattttcaaaatggaaaattatttttgtaaaacttttaataaaaaaaattataaataaaaaaaattcaacagagtgtacggaccacacacttacacgtgggtcccagctaaaccacagggtccccacacgccagtatcccactcccccgcctccataatatcgcgcaaaccggtgtgggcactctctctctcctcgttgtccctcccgtcccgtctctctctctctctctctctctcttcccccgtccccacgtagcccgcgcctcgccccgccccgcccggttccaccggccgcctgcctcctccgcggcggccttccctcccaaatcaaaaccctagaccagccccccatcgccgcaaccgctgcttccacctcccagccagccacagatacggggggccctagctctccgcggcggccgccttccccgggagggggctgcagcccagagctagggttttgggggggggggggggctcacaccccccggggccatggagttcgaggcggacggcgcccggtggccggagccgcgaggcgacgctgccggggcgccgccgctggagcgtggcgatgcgccttcccctcgcttcgattcgtctcgtgccctaaggtaagcggcgaaccccctctctctcttgtctcgagaaataaaatcctcagacgagtgataaagctctcgcaccgtgattcgtctcgtgctccggtagaacttaatttatagggtttgctgtgggatttattattgtaggttgatgtgcttagctctgcttttgtacgattacgaatttggccaagttagagattttcaataaaatgcctgttgagtgtgtggggaatagtttctagtgtttaggcgagcactggtaatagcatgaatatggataaattttgtatacgctgccaataactgatgattggttttatacgaactactagatgctatctagcttttcagaacaaggaattcatattatatgaagtactaaatgccatctaacttttgagaacggggaatttattttatgcgaggacagggcagtgaagaaaagtctgtttgacctcattgtattgaaaaactcacgggatataatccatactcaggcactaatttaaattattatttgaactttgttgagaagatttagggtcaaaacacggttggatgcagaaatatttttgtttaaggtaatataatctatctgattgcatggtttggaagcgtgtactttgatcgaatatatcttttttcagggttttgcatgaaacgccttgatctcctttgacttgttaaagtggaaataagtttgttaacttctcaagcaataaaaaggacctaatttttaacatatagttcactaatatatctaatgcttatttctgtgttctctagttacccacggcagaaactattttagtgttcttattgatttctttgttgatggcagattgctgagagagcttggctcaaatgtaacagaagatttggttgtgctgatgccaaatttgctatcatttctgaaacatgatgatcctgtggttgttaatcaatccatagctagtgggacaaatttatttgctgctgtattggaagagatgacacttcaggtcttttttgtaaaacagatatttattaatgaataaatccattgttgttgtaattactaccgttgcgatgctggtattatcgtttgacgaggtttattttacttgcttctcctaattgttttgggagtatgtctcagaaataaacaaattgtgccaaaggaaatacaaaatattaaattgttttcttggaaaagacgtgtttataacctcagagaccagcacttcttgattgcaatgcatgttttgctctttcagtattattggaggcactgcataaacccagtactttgctgtttgctgttttcatttattctgtttcacatgttcccatgggtcagttttatgcaggacagatacagcctctggctatcataaagtgcttatgaagagtagtactgtctgttctctactgtcagtatgctaaaagtgctcggcaatcgcaaatcttattgtgataccactagagggtcaaaccatttcagatggtgcatccagtgaacaagcctttaaatccttgtgactccattaatactgtgtctagcttgcttctattattcacttttactcccagaaatcattttttctgatgatttaccaatggtctatgttctagacgattggtgaaggagcgtgctttgtctcgtatatatttgtgctagagtagttggaccagaagtagttgcatgtcagtttggtgctagaatagttggaacagaagctgttgcatgccaatttggtgttcttttcttaaatcaatcagttaaagtgactttactacagtaagtcgacaatcttacacaactatatcacttacaaagtgacaaaagattctgcataaatacaacataaactgtaccagctgtatacatttgaagcagtgtgaaaaatgtgtcatgtttgttcaattcatatttaataactagtgctgattgatactagcaaagaataatatttccttttgtaaactgtgactttataaccttgaagaagcttccaggaaaatgttatccactggatcacatgttaaaacattaaacttacatttgtactgtaattataaaaaaaatattactatcctaataggactctatgtgatcaagaacaacttgaagcttctttcagtagttaaaaactaattgagccatacaatgctcatagatttgtttgttagctatttgttttgactattttacaagcaatggttttgtgattatacccgtgaagatttaaggtagtattttacacagtagggtcagagaaaacccatatgttttcatttagttctgaaaatgcaaaacgttatgtagaatcactatgaagtaatgtctccctttcaaaattttctcctgattgaattgatgctacttaaagtgttatcactaagatattactgatagcttgctcttggtactcactttccattttaatgctgaatgtagattaataagtgtggaagggttgatgcttggcttgaagagatgtgggcttggacgaagcagtttaaagatgcagtccataatctgatccatgaggttagtagcatacaagttcatgcgttgcgtaatttcaataatacgttgatactgtggttgttctgttgtgtatttgcaagcactatttagcagataaaatgaaagtacaaaacctacatatatcaggttttttattatactgtttctctttattttatgtaaaactatgatctagtgctctggaaaaactttcttttgtggagtgtatttgtgactatgttgagcacagagcactacgaaagtgggaattattccacagtaatcccatccctgcccttgtgatatgatatgaagaaaaggagccagactacctcttctttgctcatcctactgaaaatacacagctttgtaactaatgactactttcctcgcaaaaaaaaaaatgactactttgaaacttgaattgatggtttagttctttgtttctgctcaatccaagactaatgctattcttcatgtgatatacaacagtctgtcccagttgctactaaactgtttgctgtaaagttcattgaaacatggatcctgtgtttcgcacctcaatccaaaagtgaccggatgcagccaactgaaggtattttaaggcagatttttgcaaagaattaatgggcataatgtggtcctgcaatcaaagtaatgaaatgtattttcgctgtacaaacaggaaggaacaggaggttgtttgatagttcaagattatctcaattccatcccagccttaaccctgctgttctcgaagctgatgcaaacagggctctcatcctccttgtggatatactgcagtcagcttgtgctcatcaaggatccttcctagttggcaccattaattcgtaagactctgtaccagttccctctaccttctgctcgttttgagttgtcgcctccatatatggattggcggatagctatttgtgtcatttataaactgttgtttctgattcagtttcattttatgcacagtagctatttcttatgttgtctctgacctgtcacacatctatagtgatatccccatagtgttgtactttgtgaagtgggtaccgtaacatttatttaggcttttgtgttctttacttcagttatataattggccgcaacagacatgggcagtgatgaggtttaccaatgagcaaagcttgcaactgtactatgtccatgtggttgcctgctactttaagattttaatgttcggaatgtctttttcctgttggaagttatcttactatcagtacaaccttgcaaactatgttgttatcttttggaaatataaatgtttgtcactttccagtcttgcagctattgcaaagaatagacctgtttactacgaacgcatactgccagtgctacttggttttgaccctagtttggaggttgcaaaaggagctcatcctgcaagtctgcggtattccctgaaaacagcttttttagggtttctaaggagtccttgccaggcaatgattgaggtgagctcaccttatagttatatgccatctttaccattttctagagttcaaagtatacaaaatgtactcatctatcttcttcttcttcttctttttctttttcttttttttttgcatgttctcctgtttagttttttaatccttgagcttgttttgttagtgttacatgcctacactagtagattctagtgcacggtccttgatttaactgtttaaataatcataccgaaagccattcatttcagtaaaaaaaaaagtaaagttgtccttgtggtttattgtcacgaaaacaaattaacttagctaacttgcaaaaatgtcatgtgaaatgattgtcacttgattaatgattatctaatgataaattttgatgaaattagttagtgacactgataatagatgtaggacgtatagttgtcttaatggctgctttccttacacatgaaggatggctgtgtataataatcaactaatgacttatatggtccagtttgtgcatttctgttctaattatttagtggatatctggttatcttctttcatctattaagttccatgtaactgtgccatcacatgaatgctaataatacttaaatactcgtagtatcaactagtgagctgtgtgagcttaaaatgcttcttggattttataatacatataaagtagcttgtactgcctcccattgctttttctagttaactaaatgaactgggttttttagctctgttctaggatctggctttactactttcccatgtctatataggatttgtaaatatcatgtttcctttcctgctttcatgttgtttgatggacttaactgtgttcgtgcatttaattgggccttgtatgctccctgttatttctgaaattaattgtggccattcttgtctggacagtccaaggatactctggtaaggcagcttcgtgttctgagccctggtgaagcaacagaacagattattaggcaagtagagaagatgactagaaatattgagcgcgcttctcgtgctagcaaggtaatgcctgtactgctgtatgcatatatattgcagcattaataaatttggtatttgcttttttagttttccttggttgtgcacgttcctttgaggaatgttaaagtgttcttttatttataggatgaaccttcaacgttggatatgccttacggagatgttagtcggaaatatcctgctgccagatcaagtgatgcttttgctacagctgatggcgtagctaaaagagcaagatttgatacctctgctgctttaaacccaccatttcagggagcatctgattattctaatatgcaggttgacaatgaagcgaatgtggatcattcctctgatccagctctcttgaattgtgatatgtctcctgttgagaagatgattgaaatgattggtgctttacttgctgaaggggaaagaggagctgaatcccttggcattctcatctcaacagtagaagcagatgtcatggctgacattgtaatagaaacaatgaaacatctacctgaaacttcaattctattagctaccagcaacaatggccagcaaaagaaaattcaatcttcctccagtcccctgacagaaaacttgccagcaaactcccactcaatgccctacagtacgcagtttgcacttcctgcagatggagtcagcatgtcaatgtcagatgtgcctgttgtgtctggcgttcatgattctaagcgtgacccaagaagagtatgatatgatctatctttaattcacattttttgcagtcaacagaaagtgcatattgtgaaaactgtcaatgtattgcaggatcctcgtcgccttgatcctcgtcggacagttgcccctgcagccactagttccatacatgtgaagggggaaaccaccggcgtgcatcagacaaataacttgtcaaatgtaccttatcctgtttcagggaaggttgaaaactctttagactattcaggagacctatctaaaaatgaagacgtgcagcaaacatcttgtcaacccaatcaatcactcccaaaggaaaatagtgagattttggatgatgccttggaactggagccgaaatttgaagtgcaggcattagcagatgttggatttcattcttctggtgttgataaagagatggtcaatccattgtctccagaagctacttcaaacaatgaattggatagcgtggaattggaggttgatccattttccccagttttgaaggcatcaacgctggaggatactactaatcatgatttgccagttcttccatctcatctggaattaagtgacgatgagaaaatcttgttgcacaaattagcaattagacggataatcgatgattacaagaaaaacagcgttaacacaagattttccctccttgctcatttgattgcccaggtattcttttggtactgtaatatttatggcctgacatattattacttgtttcttctctgtgacatatatgtttagtaattttaatccccaagctaactttgctagtgttctggaaatacttcaatatgtgctgttctcacaccaggtttctgttattccagagtactgctgatgacaatattatggatttgattcagagacacattatataccattatcatgatcaggtactttactgatagcgtactacttctttctttgcatttagcattatcggaggcggttatcatccagtgttcaatcgatcaaatttgctaggataacaaaacctggattaaaaaaaggatttggtttgggtttaggttctttagcatttaaacattggtattggttgtggtctttttatgattgtaatatgagtttagatcattctattttgtcagatatcagttaagaaagaaaactgggattagctctttttttatatatatatttggactgaacttgtggaaccaaatttcagaaggagctttatcctgagcacaacattatgcttgaaatatatttcgaggtgtctgagctggatttgtttgaatatgcataacgttgagctaacgtcatttttgcccattctatcctatttgagctatatatcttttggcagctgttgtgtttctctagggttctcaaccattctagtgattctgggtttggtggactcacatgtgatatcctattggtgaacgtcctgtctgtagtgcgcttgagctaattgaagcttccttctggttgaccttgtgctggttaatcaaccttgatcagagagaaagacacacacacacacacacagagagagagagagagagagagagagagagggagagagagagagagagagagattttaactgtgtcgagtttgctcagtttgtcttgtctctagctgcagttgtcatatgcaaatttgagcccctaaatgtcatcacaatccatggcaccacacgttaggtgcttcgtaactatcattgcatgactatttaacttctgaagcatgtgatttacagggtcatgaactggcaatgcatgtgctgtatcagctgcacagtgtgagtgttgctgattcaccagaaagcaccttacctgcttctaaaaattatgagaacttctttatatcacttgtaagcaagaaaactttattttgatatttgttttgtattttctctgaaggttgaaatttgggtggtattaatatatgttcattctttcgttcttaggcaaggtccttgattcactcgctacctgcttcagacaaatcttttagcaaatttctgtgtgatgcaccatacttgcctgagtctatgcttaaattactggaggatatttgtgtgtcacaaggcaacagccagcaaacaaaggacagtgatggtgatcgtgtcacccaaggccttggaaccgtgtggagtcttatcttagcacggcctccacttcgacaagattgcttagatattgctcttaaggtttgcattttcttttcctttttaactggtagatcttatcataaatcattttgagtgattaatttttttttgacatcttttcacattctaatgtaacgaaaagggtaagacaacttgaattaaacctgcttctgctttttacactagaagcattttggtgatgtgtatatggaaagttacttttgtctgtatgtctgttgcaatccaagattaaacatatttatggctgatatgtttacttatttttgtgaattaaggacaatgttgatatgggtttactatgtgtctatgttcacttatcatgtttcctgtattatgaatttgcagtgtgccattcactctcaagatgaagtcaggggaaaggcagttagattggtctgtaggatcattgcctctatgcttatgttctgttaatttgccatttttttatttagtgctggttttgtaatgctaatccttgtatttttggtaggttacaaaaaaactctatgaactaacatacgcatcagaaagagttgagcagtttgccatcgacagtcttttggcaattgctaataaacatggtgtggagacggacattaatttcacatccttgaaagaatcttcacctgaggtaattcttgatgattttccttgttatgcttggtgctttatcatgcactcagactcaactaggagtgggaactgatgtgccatcctaattgttctatttctgaactcaacagtagcaaatgcaatgtatggttgaggcctacatattttctccttaacgatagtctattctgtttgtatttgttttactgtaaaaaaaaatatggacgtcaggatgggaactgttactgtcccatccaaaatattgtattgtccacacttcaactctagtttgataaatcaacattagtatttttgttgcagtgtatcaaaataagtaaacaccttttcacatttaatgtcaattcatgctcaagcatttgcccaacttactataaatgttctgtgggggttaattatgacacaatcgagtgtagcccccccccccctcgccgccgcacacaccacacacagaaaaaagttagtttagttgacttctaatatctcctcctaatcaaaatttcccctatacttctttcaattttccactgtagtttgactctcaatgatacaagagatcaaatgtcctaattttcttcagatgccattgaaatgtcttaagttttgacatatacactgcattttgattgaacatttgactgatattgaagtttttttttttctgaaagcagtttgaggcaggcagccaggaaacttcggttagtggctcccatatttcagatgctgaaccttctgaaagtacatgcaataagaccgatttggtttcacctaagcaatctgcagtatctgtatctgaggccaaacgccatacttcattgttctttgcactttgcacgaaggtctgtagatgtaaacaatgttagcttgttctgttttttttttctgccggaggtagtaaaaccattttccttcttccagaggcccattcttcttcaacatctgttcaatgtttatggaaggtctccaaaagttgtcaagcaggttctactttcaacttctaaagtcctgaattttgactattggatcacaaccactgtctgctcattacgtcgcaaaatcatgcagtgtatccattggcatatacccaatcttgtaagaaacctgggatcctcatgttctgagatgctggctattattcataacccacctgaaggcagtgaagagcttgttaccttggtattaccatcctttctcttgattcatcattatgcattattgaagcatggatattccttatactcattatcttctcttcttaaagatattgcaaactctgacagaagattcaactccttcagccgaacttgtagcggcagttaaacatctatataaaaccaagctgaaggtttgaagaatttctgcctgctctgtgctctgtgtatcatcatactgcaaattgttttgtttgtcgtcttagtagtattggttatttagtgcttttgctgaatcttgtaattttctctggcaggatgcatctattctcattccgttgttatcctcatttccaaaggaagaggtagtggtctcttgtattttgtttatgcatcttctaactgtctaactgtctagttgcttgttatctgagaaatataaatacttgccttgccatgataatgtttgagaaatagaaatacttgcatgccttgcacaatctggattgagttgtcaggatagctaatttagtcgctatgcaatggcacttagaaattggctggtggcatggaccacttaattcagatcatgcagtgtgcagtttgtaattctctccttgtatatgctactacctccgtctcaaaatgtagctatttctagcacagtactttgtcccaacatgaagctatttcttcagctacttcctcctctcaaccaatcacaaccattctccttcacctactttctcttcttgaccaatcacataccttgtccaaccattcacatctacttttttaatatccacgccaacctaaaaaatgcttacattttgggacagaggaagtagctcgctagattcactactccctccatcccaaaatccaaaatacacttttgaggttttccgtggagattaagtaggtcgatttgaatgaggaatggttgtgattggttaagtggagggagtaggcggagaatttgctatattttgggacagagggactataatatttctagccaaaggttaaaaaaaaaataatttctgctatcatatttgtgataatctgtccaagtccaagcaagtagaattctagctgatgcaccgaaggtctaagcatcgattaagatttcatttctggtgactcataggtattcagtttgtacttcgtggatgctttatcaggctgtagactaagaataatcgtagggtgtcaacctgaaatagttctaatttatttttgagttacacatcaatctagaaagcaaaattatttgcagttgataataaatacgtgccaaaagtcattttgaagttattatatcggattttggaatatgttttatgttccgttgtccttttgtttataatctattcttctcaaaatcatttgtttatgtctacggagtagcaagtactgaatgcttctcatgattgtgaacttaacatttttgtcatcatgatatggctgcattttgctgcacatattgacctgattgttttacactggtcccaggtgctgcccatatttccaagactagttgatctcccacctgatagattccaagatgcacttgctcggatattgcaggtgatcgtatttgtccttattcaacattcagttaatagatattacatagatcttacagaattatgcaattgtttgagtagaattgtaactataattgtttgagtagaattgtaactatggaatatatattgagatcatcatagttggtgacaattaatcatagcatctcatttaactgttgagggaagaattttgccgattcaaatgccagtatagaaggatagggagttactaattatcttgattcttgtggcacatttggcaagtgattgtaaattacttgcatactaacgcgaaaattatttaatatttgtattgacaggaaacaaccatgtcaatgcttattattaactatgcattttgtaagttgatttttattaggatataaaaattttcttggatggggtttaagtaaatttccttttgacagggatctgctcatactggtccggctttaacccctgctgaagttcttatagccattcatgatattaatcctgaaaaggatagagttgccctgaagaaggtgagctattggttatgttgatgtattcattatattccaacatctcaacagcataaattagtgcccagtacacaaattggatgtcttgatggattttgtatcaagagttcaagacagacatgcatatgcacctgtgcagtagatatcctttttcttggttgacatgagttttttctcgtttctgatggaaatgaaaatattttcaggtcactgatgcttgcacagcttgctttgaacagcgcacggtatttactcagcaagttttggagaagtcactgaataaattggtactaacttgactgctgttattctttacctattattcttttacatattcttctctttgattaactgtttggattgttatgtaggttgacaatgtaccaattccacttcttttcatgagaacagttattcaagcacttgatgctttcccagctttggtacagtgatttccattctaatttatgcgcaatttatatatcttgttatatgttggaaggttatttgctatcacttttcatatcattttagaatatatgaatatgattgtctatcagtaagatgtaataaaatatattttccatatagatacaaccttttcttgtcatttttgtttttttattaatattccaaataaacctctttaggcaaaaccatatgaaaaccttaaaatattgatcattatttttttcatcaggttgattttgtcatggaaatactctccaggcttgttaataagcaggttagttatggtacattatttgtttgattttccttgccagctactgattaaccattcacttttctgcattatcttggatacctgtctgtgctatatctaatatttgatgtttagggcaagatttgctcaaactaaatcctgagattctgactatcaattttatattagaataagtttatgatattaattattatgatagtacttttcgaggcaaatctacatatatgatttcttttgtttttaaaactaagcgtttgaaaaaatgttgatggttgggttttaaaagtttgactgaatattgtcctaaacatcaaatactgaccagagggtgcccttaagtgttgtaacttaacatccgtagtttagtcacgctccctgtacactaatcatgtgtatgaaaacacaaacttatcagtgcctcaacaaatcaatgataatgctaacattttcatctgtcacaattcttattgttatcctgtttattttgcgaaaacagtaggatggaatttctttgagtagttcttttgtttgcaatattttttgagtagttctttatctgctgttcttaagcttcatgctatttttcatgctgcagatatggaaaatgccaaagctgtgggttgggttcttaaaattggcatatcagactcagccacgctcgtttgatgttattttgcaggtacaatgttaagtaactgaatgcattcttgcatgtatgttataaaaaatatgcactccttgatatacaatacactactgtactgacatggcttcacaatgctacttttagttacctccaccccagcttgaaatagctttgaataagtaccccaatctacgaactcctctttgttcctttgttaatcagcggaacatgcacagcatcttgcccaggtactttcccaatattattattagtcttgacagcttgctcctttttcgttttacatttttgattttatgggcagtaaatacttaagcatatagttaccaccaacagactgattcaccaaaaacgactagttgacacaaatactagcagagcacccacttctcaactgtttattgccttgttttatatatgagtaaatttcacaaaactacaattatttggtcaaaactatcactttgttacaactttagctgggtattttacaaaactgcaattatttggtcaaaactgtttcattgggtcctattgagtctttgatcagtggcgcgttaatacacgatattctgcaaaaagattccatagtatcacttgtcttaccttttcatattcataacatgccttttgtcattgatttctgcaaatgcagacagattttgaaagttctgggcttcatcaatgaaccgcaccaggcaccaattccatttgtgcctgctgcaatgcaaacggcagatgcaacctcctctcttcctggtgcaactcttatgtgaaatgtgatgtataaactccaatcagatgcgagaaggctttcctgatcacaagtacacacactgccttgtgaacaacgatgatatgtgagtaaaacagagcccagacaaggacagcggtgtcactcaaaagggtctgcgtttgctggacttgtttcaaacaaagttacaggttgtcagcaagggataccgaggtggtttcttaaaggttcattgcgcttgtgctcgaggggctcctatgattttgcagcccgtgcaagttgtacagtagttgtactctttcgtcctgcaattgcggactgaggcttctgtgacaagcaaagaatagaaggaatattgtttaggacgatgatatgacttatcatcatcatgtcttccgccaaggaaatgacatggttgcaagctgcggcaatgcggcattcctttccgagctgcacggagacggcatccgactgattggctaaccatttcttctgttctaatgctaacaatgtctgagtattgtacattaactatttgagtccgctgtcagccgatgttaaacctttcatctcagaagataataatttatagatgttttgattgactagcatatcaaaggtaatagacaatattagcgccgttgattttcttcggtgctgcgttactttcgtaactgcgtagtgcttactactccaaatttccagtaagctcggggctcgtttcctaactcatcgatctcgttttgcacgcgcacgttttttaaactgctaaatatttttcaaaatgttaaatggtgctttttttttgcaaaaaatttctatatgaaagttgcttaaaaaaatcatatggatctttttttttaaaaaaaattagctaatacttaattaattacgcgctaatagactgttccgtttttcgtgcatgaaacttgctctagcgaacacagccatatatgcagacatgcagttgggcaatgtctttccctacaatgatacaatagaaaaacaaattaaatcaaacaaaaaaaaatctaacacatcagataaatccgttcgaaataaatagggtattgctagattttaagcgaactaaatttgtaaaatttaaatttttctaagtgaattgtaattttgcactttggaccatcttttattatctaatctaagtttcactttaaatcatctttttattaacatttgctcttcgtactacgtttttcttttgtcttttttttactgctctattcatgagtccaacgataaccgcgaggacatcgtcactgacttaggacctgtttatatcccttggtaagttttttcacactgttacatcaaatatttagacacatgcatgaagtattaaatatagacaaaaagaaaaactaattacacagatttgacaatgtgatttgacaatgtgatgctacagtaaacatttgctaatgatggattaattaggcttaataaattcatctcgcagtttacaggcggattctgtaattttattttgttattagaccacgtttaatacttcaaatatgtgtctgtatatctgatgtgacacgacaaaaaatttcactcctacatctaaacacaaccttactcatgttgacaatcttcccagtttacacgcatgtcacatttttgcagagggagaagttggaagtacctaggaaaaagtgttagggtctgtttggataatggaaaatgggggatgggattgggattgggaaataaatgaagggttatgattaaatgaaagagggggaatgaatggttaggatttaaagatgttttttggtgggtggaaaattatttaacatttccattagacaaacattgcctcggggtggtcaaaattacaacaaattcaaaaatacctagtctaaaatgaaataattgaataaatggattgccgaaagttaaatttcggtaataaaagattgccaaagtgtaattcacatcgtaaaatcacactttcctaagcctaaatctgtagtactacgtaaagtaacaaaaaaaaaagttgtactccgtatggattgtgtaattttacttcttttgactttaattttgttgttatatatgacttttatcagtttgaatttttttcatgtattttttttcaaaaattaagaatcataaatttatttcatttaattttataatttttgtatggttaaatatcttgttcaaccatttatatgggaaaaaaggagaagtagtgagataatggcattttggtacttttgaaatatgccaaggatttatagatagtctccgagtgtgtgagatagtagtcatattcttctatttcattttatccacatagtatatttgtttccttccttctatttatcatgaattcgcaactctcaggttaatccattactaaagagcttattcaacttattcatataattgtttactcctacttcaaaaaatacatttattcatttttaagctattggttaaatttattttcaaaagtatttgatttattccttttcgaacggtcaggccgttgccgacgttttatattaagaagaaggtgttccattttaaggagaaaacaggaccaaaccttacagtgtctagttaattaggaaaaactgagcgaaaactacaactacaacaccacatcaatagctaacctaacttacactaccatgacggagcccaacataagacatcggtcaagcttgccatagaggcgacacggcaacccacacatgttatcattgccaagcttaccacccaagcgacacatcagtttcgacttcactgcaatgctaccccaacgccaaataaacaaacaaaaacgacacccatgaaggacatcagcccaaattcctacacacagttagcatcaacaaccctataaggagatcgcggtgtgtgtcatcgttgccaagtttcgtcgcacccctacagcaaagcagctccgactctacccagtagtaaccaaacaaggatgatgaatacctgccacaaagcaagaaatgaaaccaaggcggcaaaggcctcgtcaaacacactaggcttgtagagcttcaaaggcattgcaggagcccaccaatggctaccgttgcacgcggaaggttcttggtgctaagagaagtcaacgccaaaacgacacctccaaggagggaaacgacgcctaatggtgccgtcgttgtcataccggcccatgccctagcaaggctttcgccagtgattcccaatcaaatccctacacaactgtcctgcccaacgaccgttgttggaccaccacgctatcccttcagcgcccctgtgcgtatagtaaagtagataatggtataataaagtagataatccgagacgatagtttgtccaattatctaaatcgaagcatgtgaaccgtattccagcttttgcgtgattgaactccgaaattaggcgaatcatattgatttcagatttgacaggctagctcaaagatgtttattaacgtgtgcttctcgacgccactgtcagccgtttggggtcgagctacaatttgagcaaaggacaccaccggcctttgttgtttaactgacagtattaatacgagttatttaatgcatagatcaagagattacatgcctcccatagttccatcgacagtgatactaactatgagttaacaattgaaccagaaataagggccctttaaatcaaaagatttatgtaaaaattttctaggattctttctatatgatttttttatttggccctttaattcaaaggattgaagcttttcgaatcctatgaaattcatatggtcatgggtagcaccttaggtcttgggtttaactcctcatgggagcaaatttcctaggatttaacggcatcgtgctttcagtggtaggtcaatctccaggatttgtcggccaagtcttcgaagatactcataggggtagcgcttacgtgcgtgcgtttaggttgcgtgcgtttaggagtgaatgtacgtgcgttgtgagtctctaggttatattgcgtaattctaaaaaaaaaaggtaaaaatggagattttgtggtaaataacagaaaatgatgttccctgccgatgtgaccaaaaatacacccatcgacatttcgatgcaccgatatgcttggttttaagttattacaataaatacacctacttaacacccacttaccaagctcatgccatgtgaatgtgatttacttcttttgatagaacaccttttctgattctacatcttttgcaaattacaatacttaacatccacagatttttgtacagtgttatgttcctaaatcctaatcggtcatctacttcaacatctactcgtaaatcctctactactccgtaggctgtagaagttgaaccaattacccgggcggccggcacgttccctaatcgcccgatctaaacaatacacaaaaaagtctcgacccgtttcgccccgaccggtcgccgcgccaccacccactccccctcaaacaccggcggtggtcatgccgcctccgcctcctcctccgccgccgccgccgccgtctcctcctcgccttcctctcaccgcccaccgcctccctctcccgcccgcgacctcgccccccgcctcgctcctcctcgcgccgcgcccttcccccacccgcgcgctcgcgctcctcttcccggactcctccgcgcgcctcctcccctccctgccgcccgccgcctcgctccccgccaccgccgtcccctccccgctcgccgctgccgcctgcttcgtgctcctgctgccctcctcccacctcctcttcctctccgcgcacccgtccccttcctcccccgcggcccacctccgcgcctactccctcgcctccggccgcttctcgcccgccccgctctccttcaagcgccaggcctccgcctcggggctgcccctgcacggcctcccgttcggcctcggcgtccgcctcgccggcggggtcaacgccgtggctctgctgtccctctccgccgggcagatctgggtgctagccccagggatggctgcggacgggcgcacggtggagctgcacaagtgcgcggtcgtcgagctcgagccgtcgcggccggtgtacgccatggaggttgccatggggaggctgctcctcggtgaggctggtggtttgcgcgtgttcccgctacaaggcttgatgaagagtgggaaagagaggcaggtgaggaaggagggtgcgggggcagcagtaaggaagagcctgcacaagaagaatggaattcggaatggttttattgtgccaattgggcatggcggtagcgagggaggtggcaaacgagaagctgtttccactcgtgagtatccttaattttccttgaagctttgattctagtatttgattatcttagtgctataatgtgaaaaaggttgatcactatctttgtgaatgacacctaggttaggtagtatttgattgcacttagaaaaagtgcaggatataaggtagctctaatcttcttatagtgttgttgtttttgttatgtctgtgtctaggcaaagcatttgagtgttcacttagggtcgcaatagagcaagtgtagtgtggcggaggtaccgatagaacaggatataccttcagttgatttgtgcaaaactgatgatttgataaaataatatttgccccaacacaaggagcaaagttgggaactatttttcaatatagtatattttttctttggtaaatcccatgtacatgccctttgtagcagaaaactacgggttcacaaatttcacataactacatggagcttgatagtactattaagtattaacacaaaaacacattgtttgatacaggatttgtgaaatttgatattttctgtattataactctcaagtttttctaacaattatataatactttctcagccccattggtggtttcatgagcaaaatgtttttttttaagaaactgataacaattgtttggtgtactactttgtatttaaggctaatatttgtaaaggatgaatggagctaaataattgtctctgcaacatgctgatattttttttaactctaacatatctggttgttaaagtccacttggattttgtttgcaaccttgtagttcaaactgctaccttattccttataatcatgatctgtacaattctatcgattgatcagtaacttttgatggagttaatgaggaataatgttagaattttctttctgacttttgtgcttttagctacttgtaggtgcagacataagttgcatggccaattactagggactgtaaaactataaatttaacaaagagtgcattatatatattttgtctatggctaattttacaacaaagcgaagaaagagaacatgaaaagaagggaaacccaactgtgtaaaaacctgtgatcatgttttctaacaactaaaatcgctgtttatcaaccactcacgacgacaccgagatcttcgacttagctcccacaggtcccaggctcgtcaccccgggaactcgcagcccatcacaactactcatactaggagccacctagctagaatagaaggaagaatctcgtaaatctagactatgatagtgtactcaacttgcagttttccaacagtattaaccatttgttaaactgccttcatcagaggatctagattcgatcacacaacccaatcatatcgcaatacattattctgaggtaatacttaccaatcgatgtttggtttctttcagttgtgtcaatttacaggcatgactaagaacaaacttacagtagaattgctgctatttttgggattagttggttagtttttactatgtgcatgtataggctatttgcttgcacagacttttcagctgcatttcactaaatcaactaatattagtccaaaattactctttcaggtaagctggcaactttgagagtaaaacagacttcagggagctatttctctttcttttcctcatgtagttctgaggatcatcataactcacaaggtgccgtagaagtgaaaaatgtagtgaaagttgtttcaatccgtcctctttccaaggacaagtttttggtccttgattcagctggattgttacatgtattcagtcttcaaaacaaagaattgctctcagaagctactagcaaaagatatagtggaaatcacacacactgtttggataatgccatgaaagtgcagctatttgctgtctttccaagtagctctacaagtgagtttttcatcctggatttgttgtttttgcatcatggtggtttacttcattaataaatgtgttcagagtgcttgtgcagagacagaaatcttttggatttcggatggtgggcattccatacacataatgtcagcacttgatgttgaaccccccaacagtgataatggaggtggtgatggagaaagagaatcaacaaccattaagctcacaggtttgtgtcgtaggtccttttttttttgtaccttaggcctttatttgtcctacctgctattttcaatcatttgattattagctcaaccacatctttagaaactgctcagataggcaagtttctagaaatttctaatttatcatgtaggtttcatattttattaattgtttttttaaaaaaaaattattgacctgttgtgttacattataaagtcatcccaggccattaaaaactgagtagtgttgcctattaagtcatgcgtgttggttaagctttccccagttagcatagatgtgcatgtttaacatcatcaggcttgcaaagtaattgttttaaaaaaccagcataatgtatgaagccctctttttcccattgactaaggtagtgagcttgtttgtttgtttttatcaggccatgatctatcatttatgttgtaactctctttctgtcatgttttttatcttgtgttttcttgcagctattgaagcaatctttacaagtgaaaaggttcaggacattgtgcctatctccaaggattcagtccttatccttggtcaaggtaatattcaatgatatcttgaagattgacattctagattgccatgaatctggatagtttgcttatcttcttctaaacctcctcctaacatcataaatattgtgtttgcaggcaacatgtttttgtatggaacttcttgaattttgttgattatatcatatattcggtaaatctatctgaaaagcttgatgtcattttagtccctttttgctctcattggtttgcctgcaccaacccacacattatctttggtatcaggtgggagatgtgaatgtttgtctagatcatgaatttgcagtttcgatgggtttttggctgaagacagggtgagtttggtgactacaaattgctttcaattatttaaccacttagagtacgatacttatttcttaaattccccccttctcttccatgatgcagtgttggagattttgaagaatgcagttgttcacctgtctttgaagtcatgagtatcattagtctttaatttcagttagcagatgaaatactcgagacttcaacagccagcaagagttgaaaggtgcaggccgttctccatcttgtcaactgtctgaaagcaacattacaaaactataggtctttcagcacagttcacaagccacagcaacttctgaacaggtgaagccagattattcccagaatacaaccacccagttgtttttgcatacacattttgcgtgccaggacaactgcagttctggttgcgatatctggaagaagataaggctgcaatcctatgcccagctcagctgttgtggaacgtggatcatcatcaagtgggtcggttatgaagctacaggtttggtgctccacaaggaggttgatcagttcagagactggaccttgagtccatggtgtcctggagttcagcgagtattttcgttccaagtgccaggccccgaggacttcagaaaccaataatgtatttgccatgttcaatgtcaggttttcacaatgcgcacgctagtacggtgtgagcttgcaaacatttacccgttgtgcctgtttctgaaatcaaaatctagttatttgccccgtttggaaagtttatttgttggctcatattgcagcagaaccttattatttgctcgaagttggattcgggacttcacgtcttccatggccatagaaattgtaacgctcccttttaaattgctagctccagtggcctcatatttcaggtgggatatcttcttccagcatcagaacgtactgtaccaatcatctgcacgatcgcacattcacaatggactagaatggcagcaaccatcaacccatcctttgttcgcccagccgtcaaatctcataggctgttcactctgaattctgaaaaccttacgacggtttgacaaaatttctcaaacaatctagtatatatatacttcaggtggaatctcctccctacatcatcagtagatcatccgaactgtgctgcaagcccgaaatgcatcctaagcttaccacagctgacaaatctcataggctgtttgttcattctaattctggatcctggaaccagacgactgtttgacatatgggtccccatggattgcttacgacttattataagccgtaatgtcttattagcaattaaaaaaataatatgtgagtaaaacttttgtatttatgttcttagagacttaaaggccaaagctgaaaaataatacgttgaataaacatcaaaatcaaattcaaaattaagttttaaaatttaaattttagctttggcttataaaaggcaaaggaaacaatgaagcccatagcccgttaggagtactatgctttccttctcacgccgcgcgagagaggggaaaagccagtgaagatggtggccatggccggcggcgacggcgcggggcggcgtttttcgccgtcgtgaggtgctgctttgtcggcttctctccgcaagacgctcccggcccgcatccgcgccgctccgcagattagcgggcgcatcggcaatgcctgtgacgggggctgctaccccgagtgagggctaggtatttggtcgccgagaatgcttccttgccttgatcagtaactaggggactgggattcgggaatgctggtaggtacgttcttcgcctcctcccgggcttgctttttgtggagaatttccctaatctagtattctagtgataatatgctttaaactgtacatcagtacatgttgtcctaaagttcatattacttcctgcatctagaacaccctattctaaagtgatggatggttcaagtatttccctcttagataatcatgatttgctaccttaagttgtgcgtggcctgtttttatctcagagctaatctcgcacggcaagacctgattgaacgcataggcattagctatttatttcctgcctttcgagtagtaccacactagttcagcttctgaaagaaaagaaaagaagctgcaaataggctgggcactactagctttatcacagaatgtatgaattttctttcttgatgaaaaatgaaagcagtacttgtcctctgtttaaaaaaagttagcattatgccgttttgattatttcatgataaggttaacgttctgtatgtttcaaggagaaattcatgtctcatagtattggtgattcttcttttcagttgctgctcaaagtaataccagaatatgttgtcagtgatattgtgacatgttttttcaaatagtaagacttgagctctactcatcagttcatcaaggaaagatgggactatgaagactactctaagcaggtaaaagtaaggctgtgtttagatccagaggtgaaaagttttggcgtgtcacatcggatatacggacacacatttgaagtattaaacgtagactaataacaaaacaaattacagattatgtctgtaagctgcgagacgatttttttaagcctaattaatcagccattagaaaatgtttactgtagcaccacattatcaaataatggagcaatagacttaaaagatttgtctcgcaatttacacgcaatctgtgtaattagtttttttgtctatatttaatactccatgtatgtgtccaaacattcgatgtgacagggtgaaaagtttttgtgtgggaactaacagggcctaagccaaaattcaaaagctacctagctttgctctgtggcataacctgaccctgtatgcgaaagcatttatatgtcaccttttgctagttgattagttgatcagagcatttttgctgcaaaccatcttctcaagccttcaacagagcctcaacctcctcctgcactatccatagttctgcagtgatttgcatttaatgaaaagatatgtctattcctctcttttgattcattacaagcgtgtggctcagatttgcaatttgcaactgatactacttacataaagccttttatatggacttgtcaattgtaaaaacctattataattcctcagagttcttttcttctgaaccattttgattagtttccagatgcactaaagagggtatttcaggatatttcaccaggtgagctccattgcttccacagagagtagtaatttgacttgaaatgggggatcca

SEQ ID NO: 69531 - DNA, 2085 bp, Oryza sativa
cagttcagttattagactttctttctcctacaaaagtcaacataatgttttcataaaagaatggtaggaaggggacaattacaatttaggatttccattgttgaaattacccaagttatagcatcagactgcactttaaatgctctgagaacaccagtgtacgcttgttgctcgatctgacgtatttctctgtccacgttgctgtgtaggtttggttgaggaagtgatccatttccattgaaaatcactcttggtcctctaggttggtatgtcggaggaaggtcgtcatcagtgcctgcagtcaagggcatagtcaataccattgaaatactgaatacacacattgtcaagagtttgaggtttcgcaaaatcatatctagatattctctacatatgtggatgctccttttaagtaattaattgacaattctaccaaaatagccacgtcctaattcctgacaagctacaattacttgtatgtaatctccataacagcacatcctcaattcctcacctcatactactctacaacgctacgaatctccccttcttcacaatatatatttaacacaaggcattatacacatttaggtgagttaatacccttcctcaaagattcccctccctgtaaaatccacctccattaatccatcacttatcttccatactcacaacaacttacaacgcacaggaaaagcataataatttttttagaggagcaaaaaataatatttgcaatttctgtatgaccgagtttaacaatgtggacatcctttcatcagctaatatatttccaaacgaaatttcccataatctaacagtaaagtacggccgcaagccgatgaactctcctacaaagaatcacacaaaaacctactggcgccacacaagaacgagcaaagactttcctctcagcaattctctctcgcgtaaacaacaacagattgatcgaattagactgatactgaccgctgctgtcgaggggttggtactgcatggtctcccggttcttgttcttccggggcacaccaattgcccgcgtgacctccggatccggtgctctccgccgaccagagctcgaatccggcgagaccagaatccaccggaggctggagccgcagctattggagaggaattcgcgctcgatttgaggggtttcggggtggaatcgggtgggaaacgcgagggtggtggaggcgtcggcgacgagccaaggggggaggcgtgttcaacttctgtttttttttttttttttgatcatgaggcgagttcaactacttcaacgcgatcgtgaaattagagaagtaaaattttcgggtagactcgctaagaatgttttaaaagaaaaacttatcggcgaaccggtgagacgagtcttgaagtattttctattttctaaggggcaacagaaatgtatattacaaatgagacccatttatatgaacttacattattattaggaggagagaagaggcagagaaaactaatatatttaattctctatgggtagcccatatgtttatgggtagttttcgttatttctttgctatggactagttgtctagtttcacaatattgataggtggctgaaacaaatattgtattgcttatggaccacttttagactatattatggatgctctaagagtagattaatttcgaggggattacctacatatctactgacaaaatttccataaaaaatttaacagatataattataattcaatcgtcataaaattacactgtaactttcaaaaatctctccgtaacatactattttagtgaaacggggatcgtgtcaacgaatcttctcatatgtgtgtgagtgacttttttacttcctcacatacataaattttgaaacaaatctaacaatttaaaatgatgtgaagttacatataaattacaatgtaattacatataagttatagtataattacactacggttgcactgtaataacatcggttaaatttatcgataaatgtgtagcaaaattataaagggtttttagggtgcatattagagtaacatccttgtcattgacgctggatatataacacaggaatttaccagtacaccg

SEQ ID NO: 69532 - DNA, 29451 bp, Oryza sativa
ttggtaactttaatagtagaaaatacatgtttggtttgctactaaatttttatcacaatagtttaaattcattactccctctttccctaaatgtttgacgccgttgacttttttaaacatgtttaaccgttcgtcttattcaaaaacttttgtgaaatatgtaaaactatatgcataaaagtatatttaacaatgaatcaaatgataggaaaataattaataattacttaaatttttttataagacgaacagttaaacatatttaaaaaagtcaatggcgtcaaatattttgggatgaagggagtactaaccagtttgatagtggccaaacttggcaaggcaaaaattgacatcaaaccaaacaaacccggcgtcttaacgaaggaacgcggcagccatgcaccgccaccacctggcgattgaaacaggagaaggcaaaaaaaaaaaaatctctctcacacacacacacaccaccgcgtgccccaccggctgccgttgcgagtccagtatgtgtgtgtgtacgtgtgatgcgctgggtcgatgaccttctttcttgcttgcttctccgcgttgattacaccacacgtgggcgcacagcgcactcggcagtcggcacccaggccaataccaggattcatcaaaccgttttaaaggctatggccttgtttgcatccttcgagctattaaatagccctttaaaatcttgctatttagaagtattaaacgtagattaccgataaaaccgattccataatccctagtctattttgcgagacgaatctaatgatgtatattaatccataattagcggctaattactgtagcaaattatggattaatataactcgttagattcgtctcacaaaatagcctaggggttatgaaatgggttttctcagtaatctacgtttaatacacctaaatagtaagatttcggagggctatttaatatatagccctccggatccaaacagggcctatgttccggagtactccggttctctagcatgtagaacggagcagtgtttatatgattaattaaatattagttaaaataatttttaaaaatagattaatataatcttttaaagtaacttttacgtagaattttttttaaaaaatacaccgtcagttttaaaagcttgcgcgcgaaaaactaggagggtgagctggaaaattagacataagaactcagcataaatagggttaccatcaccctatgatttgacgtaggactatcgtattggataacccgtaccatatccaattttacttatccccatcacaaaaatattatccatacctaaattaagtgggtattgctcaatgggttggataacccaatagatataagagaagagacatatgtgggtttcacccgtagaaatggatcaaaaattatactccctccgtcccataatataagggattttgacaatttgcttgcactgtttgatcactcgtcttattcaaaaaaattatgcaaatataaaaaaacgaaaaattgtgcttaaagtactttggataataaagtaagtcaaaaaaataattctatttttaagtaagatgaatggtcaaacggtgcaagtaaaatgtcaaaatcccttatattagggaacggaaggagtacaaaattgctcttaatatataataaatcatccctccaaatttcagttaaatttgataagattttctaatgtgaacgcgagtttaaaaattttaggttcaaattttacacgcagcaaatgggtatggacgaagtgggtaaaatggataataccttccccaaatctaaagtttaaatggtaaactttttcacctatacgctacccaaatactacctccatcccaaaatatttgacgccgttgacttttttaaaaatatttgaccgttcgtcttatttaaaaaatttaagtaattgttaattctttttctaccatttgatttattgttaaatatacttttatgtatacatatagttttacacatatcacaaaagtttttgaataaaacgaacggtcaaacatatttaaaaaagtcaacagtgtcaaacatttaggaaaggagggagtatgtgggtatggatatggggttgggtaatgaatgcccagtggaatgcttaaatttgtaagcatgaggtataccatggttttaaaaactgacgagattaagattacgtacgatgttgtaaactctgtaaactctacccaacacccatcgcctcgtactgtaccaccggcgtaaaggacggatgccaaaacttagaggctagagagtagagtagactaattattaagccaatagaattaaccttttttttcgtgagatttcattttcttggaaacttttatttaaccttttcaaataaagtatgatgcctttttaatcgtacgaaatattcgctacgaatgcctcgatacatgtcgagcaaagttggcaggagcgccttaatcatctccaaaattatcttttaacctatctctcatctaatttatgtgaaattccaacgacttatttaaacggtcatcgttgtgtttttttttctacttctccattttacatatgtatttcatataaaatcatgtgtttatatttatttccgtgtttaacatatggtttcattttaagtaacttggagtacagcgagcgaagaaccctgtaattaaattttggggaaattcccagttgaatatatatttcgttttaagtatctatctatcactttcttacttttaccatgtttttgtaaatatcatacgctaaattatttctcgttccgttcgtcacttgtcttcacccttcgtccacgggtcgagtctacttcatttaggtattacttcaatggacctttatagctacttgtagttaattaattagttttcttcattaacttatggagtaatatttttgcctagagttaatcaacatgagtgacgggtttgttagcttggacgtgtacaaccgtacgtgtgatcgacactactataaagttggtttttcatggcgataccattttttttttttgctggcagttttgtgcaaaaaccgctagcgaaattgtaatgaagggtgaggagctaagaaccgccagcgaaaatagattttcgcaggcggttgagctatatagtccgccagcgaaaatagtatattttcactagcggcccttataaacaaccgccagcaaaaatcattttttcgctggcggtagttaaggagacccaactgaggagagaaattccttatataaaaatttcgcacaggccgcctcccactccaactcccaccggtcttatctccttcctccctcctcctcctacgcccctagcctcctcctccttctctgcgctccttcctcctcctccacctatcgacgtcggcaacgaagaccccggcgaactggcgacgacgacggcggcgaccacgacgggcgggaggggggcggcgcgggtctcgcggatccaccgccgagaggggcgcaggccgtcgatccccggccgggaggggcgcaggcgcggtggatctggccgccggagggccgtgggcggcggatcgggccaccggagggccgcgggcgggaaacgagccaccggagggccgcggtccttcccctcccctccaagcgacggtggctccgatctgcgtgggcggcgtggtgggcgactccatgtgcacgtcgatgacggcgagcacctcccccccccccctctccgcggcgtcgggaggtgggcatgcggcgacggcgacgggaggcgggtgtgcagctacaacaagaggcgggcgtgcggcgacagcgatgggaggcgggcgcagagctccgacgggaggagggcatgcggcaacggcggcgggaggcgggccgcgggcgcttcttctccttctcctcctccccctccccctcccacagtctcgccaccaacacctcctcgccggcggctggggttcccagattcagtgtctcccccatcggatcgagctcggctgctgctcggtcggcgacgacgacctccttcctatctcctgcccagatcgatggccgctcctctagctgctggtgatgatgtttttttccatgttctaccattgttcaaaatgcttgtatgcctgttcacttgcatgttaattgaatctaatgaactctctgggatgaggatttgaatcgtttcctggaaatttggatgtggatttgaatctaaacatgctgcaagttgggattgtgattggggatttgggacaaagatttgggattgtgattatttggcacaatgatttggaatttgtgatactattttggacctggattttcattgtttttcgctcaaaaaagttttcgctggcgggtctcttaatattgccaccagagaaaaccgattttcgttggtagccgtcttactgttgccgccagagaaaacccattttcgttggcggccttcttagtatggccgccagcgaaaactcattttcgctggcggttggctgtccgcctgtgcaaatgcattatttttactggccttttgttactggcggcacgccaacgaaaacctaatttggccgctagcaaaaatcattttcctagtagtgcgatgtatgttaattagcacataattacatacttaattttgctaatactgagttaggagagggacaagctagagatatgatgcgagccatgtacatggagaaagcaactcatgaaaatttcaacttccaaattaactccaatgcaaacagaaaatgaatatgaaaaatagtaggatatcttttatactccatatagcatcgtttctaaaagtcaagattttcgaacaaatggagggaacattacaaattccatttctaatcatgaacgcgtgtttgagaaaagctgggaacaatccaataattcagtgtagcacgttgatcaacaggatgaccaaaccggaagtctaacgttgccagtctcgtgtcaacattagatggtgtagtggtgtactcttcataatagcatttttcttgggaaatgttttcatatacaccataactaaagggctcatttaaagaaaatcttgacaaccaacaaatgccttacaatacatttcttttattgaagaaatctagctacgaatacacttgcctttggaccaatctccttattccaaaatgctccccttctctcgcgtgaataaatggttgttacttcagcgcgtacgacgaaacatgttatactccccctacctaaatatattgattttattaaatatgtttgaccattcgttttattcaaaaacttttgtgaaatatgtaaaactatatgtatacataaaagtatatttaacaatacattaaatgataggaaaataattaataattacttaaatttttttaataagacaaacggtcaaatatattttaaaaagtcaatggtatcaaatatttagggtcgggtggagtattagtttttcaaaagtagagtaagatggaattatttactcatgatctaattgcttagctttaacatatgatcaccaattctaagattaatgtggaatttggatgattaaaactgaccggattaagactatatattccaagtaactacaactatacgtttgataacttatcctatgctatctacgtattgtatacggaacttattagttagataaacaattgtttgagtactcattgaatatcaaagctaaaaatagaattcaataacctgtaacaaattatctgtctttaaccgttattaattcctccgagcagaaaaagagacggtttctccgataacatgtaaaaccccataacatctactccctccgttccataatataaggcacaactattttttttaaatgttccataatataaggcatgcatgcatacatataattaattaggaccttttctccattaaattattacttttttaaatcctccatactcaagatctctaattctattggatgcatgcattatatttattagagtgatccaaactaggagatgataataattgtttcttggtctttaggttaagggtggttgtgctttatattttggaatggatggagtatctatttagtaattgctttaaccaacacaacaacgcttacctcctcccattcgagtctcctgtgtcactcaacgcgcgtcattgatgtaaaaggtcgttttttaatgagtttgtgacaactgcagctttaattcttcaagcagttgagttttttttatcctgattttgagaagttatagttgtaaaattcagaaaacgaactcaagacatctagattctcagaagctcatataaagtgttgtttagaggagtttctagctgctatatcttctcataaatccccatctccactaaatagttttgattcttagaatctatagttacatagaattcatagaatgaattagaagcttagaaactgaaaaattcatcttctcattctaaaagttgattaccaactatccgtttctcataatcttaggaagtgtttatatgcagggctgtaaagttttagcgtgtcacatcgggtattatatagggtgtcgtatggggcgttcggacactaataaaaaactaacatcagtaaaccacgagatgaatttattaagcctaattaatccgtcactggtatatgtttactgcagcatcacattgtcaaattacggagcaattatgtttaaaagattcgtcttgcaaattaatcataatttgtacaattagttattttttagcctagtagtgcttaataattcatactggtgttcaaacgttcgatgtgacagggtgaaaaattttagagtgggatcaccttaataagctttaaaagcgtgcgtgtggttgtagagctcacaattcacatgtgctgccattgcggagttgcggtgtttggtgttccacccgccgcagctcaccaccgctagcgccagcctcccaacacacaacggtcaggtcccccgatccccgttaagtccaatccccgacaggtattagtaccaccccgcatctccccctcctccactcgaaacggctacttcctccccttcctccccctccaccaccttctagaaccttccacgatgccgccgccgccgcggaagcgcctcggccgcgcggccctgctcctcgccgccgccgcctacctcgccttcctcctcctcttcgagctcccctccctcgacctcttcccctcctccgacgccgcggcgggcgcggcgatgcccacccaccgcccacgccgccgcgagctcgaggcctcgtcgtcgtcttcggcgttcgcttcccccgtcctccgccgccccgccacggcggtgtctcccgcgccggcttctgctgctgccgcggcggctggggcgctcccgatcttctcgtcgctgctcctcctcccccggcccaacgcgacggccaccccgttcgacgggaccgccgcggaggcgttcgccgcggcgaggccgcacctcgaccacctcaggactgctgctgctgcggcggcggaggaagcttcgtcgtcgtcgacggcgccgacgtgcccgacctcgatctcggtgcacgcggacgggttgcccggggacggggtgaggacggtggagctgccgtgcgggctcgcggtggggtcgcacgtgacggtggtggcgcggccgagggcggcgcggccggagtacgacccgaagatcgccgagaggaagtccgggcaggagccgctcatggtgtcgcagttcatggtggagctggtcgggaccaaggccgtggacggggaggccccgcccaggatactccacttcaaccccaggatccgcggcgactactccggcaagccggtcatcgagatgaacagctgctaccggatgcagtgggggcagtcgcagcgctgcgagggctacgcctcccgccctgccgacgagacaggtgagctcgcagcgcggagatcgagctcttctgattcattccattttactaatttcattcggttcgatttgatttgatttgatttgattggattggattcggatttgcttcaatcagatcgtctggtggtgtgattccatgattgcattccgttagtttagaatcggcaaattcgatgttgatgatctggagttaggtgtgaagggggcggtttgttagttaggaaaaattagaggcgtcaacttcagtggtctaaattgcgtggaatagctttgcttggtggaaattggccagaaaggttcagcctttggcaagaaatttctagagaagggctgggtttgtttaccaatttctggagaatattttgatggtgattgtgtttgacctgaaaccgtgtctgttgcctgaatgtcgagtttgacttgataacgtgctgcggtgtcggtgggaagtgttaacttattattcttctctttttcttcctcaattagagggagctcaacgggttgattgcttagtttggcttgtaatagcctaaacgtcaaattggttgcaattaatctaatttagcaaatattgtgggagtgtagaagcttccaacttgcaagcatgcttgataacagtaggtctattttttgaatgagctataccagagtttgttctaaaaaaagagagctatacgagagttgcagcgagcatcttaaagcttgcagcatctcataactgggcattcttcaagacaaagttggaacatcattttttgcagcagatctagtttcttgtgatacaggaaaaagacttgtacttacaattaaagttacactgaagatctcttctactttaagagtgtagcgactttgcttcatggtgatgtctttggtctttcagttgatggccaacttaagtgtgagaaatggattcgtgacgacgacaagaagtctgaggaatcgaagatgaagtggtgggtaaagcgtctaattggtaggccaaaggatgtgcacatcagttggccataccccttcgcagaaggcaagctgtttgttttgactctaacagctggtttggaaggttaccatgtcaatgttgatgggcggcatgttacttcctttccttatcgcactgtaggtttttcttaaagcatcaaaaagtcattcagttgcatgagttcttgagcaccatcctgagatctccataactaattttgcccaactaatggtctctgcagggttacactcttgaggatgcaaccggcttatctctgaatggagacatcgatatcgaatccatttttgctagttccctgcccaattcgcatcctagttttgccccagagagataccttgaaatgtctgaacagtggagggcaccaccactaccaactgagcctgttgagctttttattggtattctttcagcagccagccattttgctgagcggatggctgtacggaagtcgtggatgatgtatacaaggaaatcgactaatatagtagctcggttctttgtggctctggtaactatcgattgacttaatggttttactactcttttgagtaaattcataatctaaccaattaaagtaaatttacagaatgggaaaaaggaggttaatgcagagctgaaaagggaagcagagttctttcaagacattgttatagttcctttcatggatagctatgaccttgttgttttgaagaccattgctattgctgagtatggggtaagtgaattgaacatgtaggactgttttgttattagacattagctgctatcccatctcacatgcttctctgcgttccaatttatccatatttatgctcatttaatttggtctgtttatgcaggtgcgagtcatacccgcaaaatacatcatgaaatgtgatgatgatacatttgttagaattgactcagtactggatcaagtgaagaaagttcgaagtgataagagtgtgtacgtaggaagcatgaactacttccataggccactaagatctggcaagtgggctgtaacttatgaggtaaattgttctttcccttattttaaagcaactactatgaatatcacattagacaagtgcaacttgaaaggatattgtgttgtgaaacatgcaataccctatttgccttgcagttgtgttttcatatgcttgctagccaatcattagatattcaccaactagcacatgttgttcttattttctcttcttcttttgatgaaatcgtcgacatgcataccattgttcatgtttccccttttatatgactatgaaccattagccgtgccactaaattatattcaaatatatagtatcttcacatatttaaaatccatgttagcttggccctttgaacaaggcaaacatgccggttgttcaaattgtacatatctcatgaaaaagctggcgctcaatcttctgcactgtccttagctgtcagcttttagcataagaaatggatgagacctcttcttgtcatcatattggatagcttcttttatttttgcaatagtaatattctaatgttgcaatgataactcctcttggcaggcatcatattagatagtttttttttttggcaattgtaatattctaatgttgcaattctgattctattttcaggaatggccagaggaggcatatccaaattatgccaatggacctggctatgtaatttcagccgatattgcacgctacattgtatctgaatttgacaatcagacacttcgggtaagcatcaactggacctagtatgtcctaccgtacatcctgctgtaacttgaactaaactgtagtgtatttctgtttcagctatttaagatggaagatgtaaacatgggcatgtgggtcgagaagttcaacaacacgcttcggccggtcgaataccggcacgatgtcaggttctaccagtctggctgcttcgacggctacttcacggctcactatcagtcccctcagcacatgatctgcctctggagaaaactgcagtccggaagctcacggtgctgcaacgtgagatgacaatggcagcaaaaattagccgtattttggagcaaatagagacgatgttaactcgtaagctcagctcgctgttggaacaccagaaaatcatcagcattcagcgatgctgacggttcggaggagcgctcatcttctggactggacctgatatatgattcgttcattcttttggtcggtggctccgtttcaagctgctgatttctgacacctgatcaatgatgttcttgccttcttggggattctttcgcctgttgatatttatactcgcgtcaaatttatttgacctaggaatttttgaggctggtggtggtggtggtggcggcggtggtatgccggcggcatgttttgtgtataaaaaggattttatgagttttactgtttgtgagtatatattcggtggactcctattggctgacactcttaccattactgtttttatgagttatttttagctggggagtgttattagagagatccttttgaacgggcagtacattcgtgagggaattcaatatataaaaatataatttatgcttaaaatactcttaataataaaataaatcatgacagaataaatcatatacatgtaatttatttaaatatgatgaatggtaaaacttaattaaaaaaaatcaatggcattaaacatttaagagatgagggagatgagggagtatgtttgatgaatgtagtccctatgcttaattcattgctatgtcaaaatacgtccaattttttttattatgacagcaagttgtaaccctttctattatttaataaagagtaaattgcacttatggtacaacaacttgacatgtgagtgtgatatagtagagaattgaatgtctgggtgcaacaacttaacaagtagcgcgttatagcataagaactttgacaatttagtattttggtgcatcaacttggctaagtatatgctaggtaaatttttttcaccatgtcaatatgctatgtaatcctacggatattatcatattaccttataatattgaatttaatctttaagaattatactgcacatacaatttacatccaattaccttttaatttttttttattttcttcaccttctcaaatatcaatcgaaatataataatttctacatcagtttaattgacttttaggaaaaaaaatataaatatgcttatacaaatacactactgtatattgtcaaagtacttaaaaattgaatctatataaaaaatgctctaaataattaagttgccgcataacttgttaatttattgtatcaaaattatagctatcttgcaagttgtcgtatttatatgatcacttataaagttattgtactaaattacatctacatatcaagtttttgcactagaacactcatttcttaagtttttgcactaaattgcacccacctgctaagttgatgtaccgtgggtacaatttactctaaagaataaatctattctgtttcgataaaaagaaactcctattctgagttgtttcagaattctgtttgttgatatcaattgaatctttttatattttattctctccccaaaatttttttttgtatagtttagccgaatttaacttcagtggaatggattttccaaaaaggttcaacggaagggagtgaaaaataacgaagcagcacgcatggtatcatatgatgagttgcactactcttctcagttcagacttcggactgcatataacatggactgggctggacaacatactcggcttggtagctcacttggcttgtgaacagctcggctcgttgagaaatgctaacaagctgagcaaggattgattttttttattttaaattttatttattaaaatattaaaaacacaaattttttaaaaaaggtttacaaatctacaccctaactctccttgagagggcttttttaaaaacgcacttccagagagcattttttataacgtgcacacatgcattggtgtggtccaacggttgcgtaaatattttacagatgacccttgcaactctctaggagggcggcaaggggtccgcctgtaaatggccaaccacgattgttttgcaggtggctctctttataaccctttgggagggcagcaccgcggcaaggaggttgcctgcaaaatgaccggcgaccctccatgtggccattagaatacactaacggacgtgtgccacgtcacaaaaacatcctcaggaagggtggcattaggggtgtagatttgtaaaacttttaaaaaatatattttaaaaatattttaataaataaatttaaaaatttaaaattcagatttagctcggtggctataacgagctagctcgcaaactgttgacgagcccaatgagccagagaaacattaggggaataagttcactttcggcctctctatttgtcgcccagttcgattttcatccctagaccacaaaattgggtacgacccgtcccccaacttacgaaaaccgggcaaacgagatccctcggcggttttggctgacgtggcgcctatgtggcttgtttgactaggtctccatcccacgtggcattgatgtggcgcttacgtggcaattatatctcgaaaaaataataaaaaccgtgggcccaccggtcagctacacacagaagaataatttaaaaatagtggggcccacgtgggcccacatgtcagcgacaaaaaaataaatatgggccccacagatcatcccacgtggcgggatctccgcgggcgcaccaccccgctccagcaccagcacgcggccgccgccaggaccggccagcgttgcggcgagcgggcacccgccataggggagccattggggagctggagtgggcacccgccgtgctgccccctgaggagtggaccaacctcaccgccgctgtcgcgcacgagggctccggcttctacgtcctcgccgtcctccgccgtgagcgccgcggcggtcgctcctgccgttctctgccatgagcgcacgcgacgatggtggtggaggtgggttacggtggagggtgtgtgccgctccctcctctcccgccggcgccgctccctcctctcccaccactgacgccgccgcacgtcgctccctcttctcccgccggcggccatcggggagaagggcggcggacggctaggcgagctccctagcctaccggtgagcgcgcgtgtgccgttcctttttctcctgctgctagctatcagggaggagggcggcggacagctaagcgagctccctggcctaccggcaagcacgtggaagagagagatggctggcggccactcttctccatttctaccgccgtcgttgtcgccggccgcatcccctccccccaacgcaagaaagatgaagaggggagaagggagagaggaagcagaagaggaggggtgagttagactgacatgtgggcccacatgggccccgctatttttaaattattcttttgtgggtagctgacaggtgggcccacagtttttattattttttcgagatataattgccatgtaagcgccacgtcaatgccacctgggacggagaactgttcaaacaagccacgtaggcgacacgtcagccaaaaccatcgagggacctcgtttgcccgattttcataagttgggggacgggtcgtacttggttttacggtcaagagacgaaaatcagagtaggcgacaaataaaggaacccaaagtgaacttattccaacagtaggagtccaggaccagggcccaagcaagaaaagcccattagtgaggtggagtcaggtcagccgagcagcccctttcaaatcagctttgtttgtccttatgcctttgatatttatatacttgtatttaatgaactaatgctaatttttaaactctttctataggaggtagatgatgaaaatcattgagtttgtggagttcccacattgtgttgtggcaagcagctagtaattctgtgatggtcttgatgctgaggaggatggtgttgtcttcaactcttggtgttgcttgatggaagggagatgttacttgcttgttttggtgttgaagttggcaacttggcatgtaacttgtgtgattctatgatggtctgatggacctgaagttctggattgtaatatagtactatctaatctagttgcatggcaacttgcattgtggcatatttgcatggaccatggacatgttattatgttaaccatggacttgaagttttccctattacatattggatggacatgtaatctgcgcacaaatgttgatatggctgacgagctaaaggagctggctgctgagccgagccgagctaactcgatatccaccacccctatatatgatcaaatgcatgctaactgctaatgactgtttgagtggtacatattcagttaagcgctcattctgttgagggaatagtaacatttttctaatattaatcaattagtaacgtccaattaagcacagcagcgtagaattgttgataaggaaactctggttttgtttttgtgtgtgtaggtgggtacggagtaactaataaatggaggcccaaatgatccatttgatggattgagatctgcctgtagcctaccatttcaagcccattgcacgtgagagttctgaccacttaattgtttgatttctatcctcatacgacgcctccaactgaaagtaaaagtttacttcacaaattgtgccagccatttggttcatctcctcctgcgtggcaaccacaaatatgcaagcctccttcgtcaccgacagtacatcttcagagagaatctgagttttcatggttttgtcatggaagcctcaacctccaagcggaggcccttttgagtatacttccttgcgttttcatctgcagttactcttggttttttcgtcaccattgcagccatggatctagcttgctatcttgtggagaagagaaggacttgattgaattttctagtttcttaggagtccttcctagcaaatttcaggagcttatgttaatttggctatcttcgtggggcccttttgcaaaactggttgtacttgcaattgattttccgctggggataagtcatgtgatatgtacttagttatctataatcaataaaatgcatgagtttttttttaaaaaaaatgttctccttaatagttaaaaagttaaacggttcattctgcctccttcgtgattttctacgctgattttatcttacatgatatcgttggctttatccacttttcatggacagagcagaaatataaggcccatctattaatgagcccttcgttctcttccatttccatttccatctccctctcttctccctccagcaaaatcctgctaataccgacctccaccaccgcatcggggctagagacaaggccgaccgttggcttacgacgtgcacccatggctccttagctcacgtagcggtgggacacaagagcaagacaagtacattgacctcgtccacccacatatggactcaacgacgttgaactcacgaagcgatcttggcgttgtctgccacctctccttctcgagctctggcagatcgatgttgtgagagaggagtgaggatgagggagagcatgatacgtgggccaatacgatatttttaattttgctaggagacttaggctttagttcttttttccaactcgaaacttcaacttcctcaatttccgttagcacgctttttaaactgttaaatactccctccatttcaaattgatcatcatataatttttttgaaaatattcctaaatgatcataatatttgtgttcactcattaagtctattcgttatttgtgcattggggtaaatgagcattgatgtatacatccatacacacaagtgttttgatttgctattggctaagaaatagtggggattgtgcatgtatcaagtttattgctaaagtaaatgtagcatgagagagttattatatttttttggtcttgtgcgctcatgtaatatgaagatcaattaggaatggagggagtaatgtgtttttttgcaaaaaatttccatatagaaattatttaaaaatcaaataaatttatttttcatgtttataataattactccctccgtcccataatataagagattttgagtttttgcttttaacgtttgaccactcgtcttattcaaaattttttgaaattattatttattttatttgtgacttactttattatctacagtatttaaagcataactttttgttttttacatttgcaaaaaaaaaattgaataagacgagtggtcaaacgttgcaagcaaaaacttaaaatcccttatattgtgggacggagggagtaatactttatactaatgagctttctcgttctgtgctcgctaaacatctctctccaaaaggtgagaacgaatgcaaccatatgtggtcatatatactttttattttttaaagtaaatttcacaaaactatagaaatattaaccaaattatctcaaaactatatatttaaaatattgtatcacaaaactaagttttttttaacattaaatataccacaaaactataaatttagtaacaaagttatcacaaaactatgggtttagcactaatttaattagaaaaattggacgtttataactcaatcatactattagtgctaaacatttaaaccctaaagatgtgatttttatgataattttattattaaatctttagttttgtgatacttagccttaaatttgtagtcttgtgataaatctattgttaaatatgtagttttataatacatcaacttaaatatatagttttgtgataatttgatcaaagtattcgtagttttgtgaaatttacttttttttttagctagaatgccacatagccgttacgttacataaaagaccagattaaagtgtcacttagatatcacatataacaaaaccaccatctcaaaagtatacaaggagataaattaatccgattttaccagttgtggaagcctttatagccgatagtacggtttgtgaacgtggatcaaactaaccacatagtttaaggacgcaaaataaaccttttccaacgggaaactctctgatacatcgatggaacacgcagttgagacttcagggacatatgaaggagttcaccggaggtccctcaacttaacaacgagatttttttaaagatcccttaaacataaaatcagaaatgtgtacccctaaactcacacaaaccatgcactcaagattctatggtagtatatatgggtggtttcgctgacgtggctcctagtcagcaaaaaaattaaagagtaaattgcatctccggtacacgaacttgttaggtgagtgcaattcagtgtacaaacttgtaaaatgctcgttttggtacatgaacttgtctgctgcgtgcggaggaaggcgaaaaggatactacatagctaatcttattgatttaggggttgattaggatactagtaaacatatatctgagaaggttgatattgacatacacctcttcaatgaaaaatagaataggatatagtgatagtataaaaagtttaaaaaaactgagcaataatataagggttagaaatgtatgaaagtcatcatttccatgataaaggatacaattgagaccaaaattataaatattgcatgtcttatgcatactcactacacgtatgcatgtcacatcctaatcaacatcagcttattttggtccttgttcgcatgaactagacaagttcatgtaatgaaacaagtattttataaatttatgtactaaattgcacctacctaacaaatttgtgtaccaccaatgcaatttactcaaaattaaaaaaagtacataacgcccacatgtcagctgcacatattttttttcttctcttttcttctcttttctctcttctctcttctcttcttcaagccggcggtgggcgagcgccgcggcggagcgctgctgcagagcagcagggagcgagtgcggcagcgaagcggtggcgggctgcgggcggagcacacggcggacgagcgcgacggcggcgaggaggctcgcacgacgacatcgggcgtcactgagatgcgcgcagctatggagtcggcaagctcgtcggctggtgcggccttcccgcggcagatcgggcacgaggcgtgggacgagagccacatgtcgatgcactcctggtggagctgcctcaccatctccccctcgtcgacagcgctgaggcaaaccgcgcactcgaccgacgccgccgtgtccgagatctcgccgttgtcatgggctcgcacgtacgggaacgacgggaggcacgcgatggtggcggcgtctaggccgaacctcggcggcgtcggccgctgctgctcctgctccatgacaagtggacgatcacgccgacgacgggcaatgcggagagctcgagagcagatgaagatggtgatgaggaagaagctcagggcgaatgacacggccaaggcgccgaacaacatcgtggtgctgtagcatccggaggcgcccgccgccgagctcacctgctgtccgctccgcccgtagcccaccgccgcatcactgtcgcacttgtccactgctactctgccgccgcggcgctcgcccgccgccggcctgaagaagagaagagagaagagagaaaagagaagaaaaaaataggtgcagctgatatgtgggccccatatattttttttaattctttttgctaactagattccacgtcagcaaaaccacacatatatactgccataggaccttgagtgcacagtttgtgtgagtttaagggtacaaatttttggttttatggttaatggacctcaaaaaatctcgttgttaagttgagggacctccggtgaacttattccacatataaatacattccataacatgcatatgaccttccacaatacttcaaatctaggcatttctttcgattgaagaaattttaaaggattttccttaggaaataaactaatttatatcaaatttatgtaaaattcatgcggtttaaaggatttgaaaatggagctctcaactcaaataaacaaaccattttctaaagaaaaaaagaaaaaaaatgagcatatgaacaaactcatgcaaaattgatgctcttaacacaaattagacaatcgcaaaaaaagaaaaacacacaaattaggcgatctactccggtcatcaggtcaatgcccctgatgccaacgcaaagtccacgaaccagttaaaatccacaaatttcactgcctccatgtcagtagaaaaaaaggataaaagaaagcttcgagtcaactccctttatcctgctttgtttccttaagtttccgccatgcgagcctaaaaccatacgcatatgtatataaccttccaacctaaattcaaatctagatcttcggccgagtttagttccaaactttttcttcaaacttccagctttttcatcacatcaaaactttcttacacacacaaactttcaacttttccattacatcgtttcaatttcaaccaaacttctaattttagcgtgaactagacacacccttctttagattggagaaactttatgggactttcgaacaaattagactaatttatatgaaatttatgtaaaattcatgcattttaaaggaggaaaaaagtcagcataggaacaaactcatgtaaaatcgatactcctaacacaaattagacaatctactccggtcaacgcatgtcagtagaaagaggattaaaagcttggagtcaaccccctttaccccgcccgtttcctcttgtttccgccatgccgtgggctcaaaccgccggcgccgccgcgcgccggcgaccaaaaccaccggaaaaagaaagtcagaaaaaaaaagtaaggctcaaatccaccgtcgccgcgcgccaccaccccgcgggcgcctccgtctccggatttcacccggtataaatctatgaccgagccgacgcgagctttcttgcgtgttgtagctggagtgttcgaaggaattactggctggcacgcacgcgcgcacgggcatggtggcggtggtgatgatggcgatgaggaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggtcagcacctgctgcaatcatagatgccaccaccatggctgaatcctatctgcgtctcgattgattggtgtgtgtggttggagcaggggaagaggaagatgcagaggtcgatggtggcggacaacaagtccggcaagagcgtcatgagcgaggtgcggaccagctccggcatgttcctcgacaagcgccaggtactacatttttggctatatatctggacgccataaatgcttatattttaggacaaaggcaatagtatgtcttttgctacaaatgacaatgatcttttagatattgtgttgtaccatgttcatatagtttgtgggaaattagtatttttggtggccacaaattgccatattaattgggttacaaacaatttttgaaaagaatttaaaatggttgcacaattgcagcgaaaaccgataatgcatttgtattgtggggagacaagtctgccagattaacagctacagttgcagtgaattgatttctagttaatcttcacgagttactactgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaaggatccagtggtgagcaggattgaaaaaagaattgcagcatggacctttcttcctgaaggtaactcttctgggcttcctcagattgtctcattgtttggttctattgattgttcaagtagcaaggttttccaagttaatgttactgctattttttttcatcagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggtaaatttcaaatatcacgtccttcacttttccaaatccaaatgatgtatgagtttttgtaacattgctggtgctaatcaatttaggggtgggaaaatcagcccaaggatgacactttctctgaatgtgcacaaaaaggattggcaggtaatggttaccttttgaagtgttttaaatgtgacacctctctaggctctagtttctcttcaaaaactgaaacataacacacttggaatataaccaggctagtttaattgcagtgaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctaggatgtgtttattttcctaaatctgatgtttgtgtcacttgctgaacacttgatttgtacatacttagagcattttcagatgaaataggtagcatttgaattttcagacagtgaacagtagcatactatttcttcaaaaacaacggcttacatcctttgcacatggttttgaaatctcaagtttacttctagtggaggtgaagactgtgaagtaagttttggtattttactgatgcagaaatggaatctgtccttctggcaacaatgctactgcctgttccactttaattttgttggcttgcataacagtggatttcagtacagcagtgtgtcaggctgtctcaaaaataacaaactcctttggccctttccacaatatagaagttctatggtctttatctcctgcatcagcctggcttttagacaaggaaactttgtttgttgctacctcaaaacatgtttctaatccacagagaacaagtttagatcctaacaaaagttttgttctactgcatgcgaaaaatcgtcgaattagtgtacattttcaacagtagactgaaaatgtccttgcaacgatcatgtaatccatgtagggcttatgagaacagtgtgatccatgtagtcacaatctaataataaggacagtgacatatcacctgaaagtggtagatgtgtgtatttcttcagggtgcttcacactttgaaggatctgcttttggaccttgctttaccagagcaatctctcatgtgtcatgcctcctcctagatttactcaaactttaccttaaacacttttgtgtaaactaaattatcctctaacttggttttgctccaagggtaactaagtaatccctgatggtccatcagacagcattttcggtttgccatcttaaaactccaattggctctttttaccaatcaagatctaagagaaagaaaaatgaaacaaaagaaggaaaacaacataactcaaaaagcaaaggacaaaagcaagcatggcctcacctcctttgatttctaccatgcctcttcattagctaggcccttcaaaagcacatcagagccagcagctcaaggaagaaagaagctgagaagaaaaccagaagcaagaaacacataccactgcctccacaacaatataatgtgctgagacaagagagaagaagcctcacatttgagggggggctttcctcacttgcaccactctatgagatgctcatagaggggtggtggtggtggtgacaataccccaagatatagaaattagggtattatgagcaggtttgccaggtcagcgaggcgggtatcagcgacaacattggccatcctatttggaggcctcattttggtgtcattgttggtggagacaagcgcgaaaccgccgtctccggggagtagtgttcttggtgttgggggtagaaggatgatgatcaatggaggactagttcacagtcacaggagcttggaagatttcaatgctggtgatgctttcagcagcatgaagaggagggtgccaaatggaccagatccaatccacaacaggtaacttttatagcgtgcaaacatgagatgtactgctctttttcttgttcctcttctccttttttctgtttcaccaaatttagtcagaatgttagcttgagatgtgtcaactacaagtttttttaatggccttttaactaaccttccatggatctctggaaattcttattgataataaaagattaatatagcagaaaagtattgtcgatgcctaatcgtgttatctgaggtgcggtcttgttcaagaacaccttaagttttatactgaaatctttctatcccacttcagtctaatttaaagagcatatatgtttcaaattatgttcatgctttttgtttcatcttgctgagtataagctggattggcttttgaaatctctatttgttcaatataaaatgaactatatctatgtcattccataatatgacttctttatggaattaagcttgcttgccatatcgaaatttaatactgtacaagtttgaaaggcatgacttaaatttgattgcacaatgaaaacaatgtataagatggtcacactatttgtattcactacacaaacagtgctcatgatgatgtatgctaaccttttaataaaggaaaacaattactccacccaatgaacaccctgcatgaaccttatcatatctgaaatgattagccaacatgcatctagcacccttaacgaactactactcatcaatcagagcaatatatgtgtgtcaccttgaacattatacttgcaggctttcaattccttcctttatttactctggttttctaatggtcttcaccttgaattcttcagaggaactggagaatcaggaagatcaccaggccgagcgtaggtagcacgcgccccgatcgatggaagcttccgaagcacttctgtggattagatcattgtgttggaagaaagggagggaaaaacaggagttcagcatttgtggtgggtctcttgcaggatgctggtgtaactaggggaaggtggcctatgctgttctaagcactggtatttaagacaattttaggcataaaactttagctttcttgaaaacaaaagctatcctactgattgggtttttaaagagagcaacatcaagcttccatctcacaaaattcagcatcaaaggttcttggcaaagggatatgggcaagagctcctttctttcagtagtgactttgcacatgtttgtagtagtgttgattcttctttttcttttaagtctcatttttgttgtattgattagaaaagcacattgcaagtttgctatagaggaaaaggtaaagataagatgagcaataatttcctggctttgtttcttatcttgtgatgagatgtgaaatccattgtagtttgtgccctagaaccaaagcaaggtagacccacttactaaagatgcttttggtttgccaattagcatgctccacctgcaaatagcattatcacttgagagcaactggaattgtctgcacaatatacgaacaagattataaaattaggtatatttcaattttacattacttaattgctagttgatttcctcaaaatatcttttcaagatacatctccttttcattcttcatatccatattttgtaatttctctagttctacatcaagcacttccaacaaaattactgtggtaaaaacagcaagaagcattggtagaagccaagatgccaagctaaagaagagaaaagaacatccaagctgccaaagtaaccatggattctctccaatgcacattttcttttctttcccttcctctgttttctctcttcttttcttgcaggagtgtagctttgaacagccaaagttgcaccctgaatgtggcctaaaagcaaagcttgtgtgacagtgtgaggaagactgataagaaactctgtccttggttaaaagatgaaccttcttcttcttggggctaatctattcttttcttgaccagtcttcttgtgtactgcatctgggagaataagatgtgtaccaagtgcctttctctgtatcagatgcatactaaagtggggacaaaagtgtgtgcagtttgtactgcattttacagccagcttagggaaaagtttagttactctcttgatccaattacttactatacttggatccaagaaatagtggggattttcagaatttttggggagttgatgaatctactaaaatttgaaaataataaaaccaagcaagtacccaaggctattaaacatcctgtaatcttgtaatgttgtgtttaccttgtgacaaggagcaagccacaaaatttcttcttcttaagaaaagaaatactacatttcatcccatatttattgtatattagttttcaccatgaggactttcacatatttgaactaaatcttacaaaatccctataaaactcctggagttccaaacaaaccttaaaatccaaaccatatatactcacatttcccttacatagaccaatgctttcatcctccctggcagttctgagttccttgttggcacaatatcatttattgtgcagcatagaccccacgtccccacctgtcaatgaaaaatatcacaagaatcctctatatcatcaattttttaagagaccttttaccatgtgcagcttctagcaaaattttccgctctctaaacagattacgttctcacctaaactttgagaatatgtgattatagaatgaaaaagtaaatcagaaatcagaaactaaaaaacttagcttttaaaaaactctcaccaaccaattacttagcggttacttattagaatctagatctcttcggggaagcatgagaggtatggtgaagtcgtggtgcatgactccacccaccagggtttaaatcctagtgcccacgaatattacgcacatgtaggtaggttttcaacggaactttagtgagataaggaatgcgccgttggtttccgtctctcaaagcatatgttagggaatacattcgcgggagtgtgagtgtagtgttacatgtgtagtggtgtgtgttcgtgtgcgtctgtcgtgtaatctcagaaaaagagtctaagatctcttcaaacaagaccaaaatttccatgtacaaattaaattaagagctatggctactgcgccatcgatcgcgtgaatgccccaaaaaaacaaaaaagaaaaagagaaaaagaaaagtgcagcccgtgagtaaacctgtactatgccttttgacctggataccaacgacggcaggtgacaactaatttcacatggctcttaaatttgcagctactccagacgatcagacgttagaaaattaaattttggtgtagatttcagttagtttgcttatatgtatggtgtagatttgcagttggaattcacatttagttaacgagattagtaaattttcactttacatgcatgcaatcatctcaatttttttctctcctgtgatgtttttttatgttggttgtagatggaaaatctaattaataacacgcacagtggaattctccttttgtgtgtgtgtgttagtgattgtatttgtaggccttcatgcttgcaatagaagtttaattgcaacttgccagcaaatcggcgatgatattactaactaaattctcttgctgcagtgaatcatagatctaacagccaatcttttttatgagaaaaaaaaaagaacagctagcattttgtggggccgcgctagatcaaaccaagaccagatgcatataacacatctattgcagatagtattgaaattaatagctgacacgatttttctttgaaaaaaatagaattgcaatcatcctcctaccgtccccttttcaccgtgcgcatgaggtgtccactcattcacaggtacgtcactgtaggatacagtattttattcccaatccatccaccaagtcaatctctaattatatggatctagccaatactttatttttaattcacgtacctagttagtcctcaattatttaggcttggtccgttgcaaaacacgaatatattactagacactgaaagaaaaagagttataatatttaattcacaaaaatatacgtacagttgtgatgcaaaccaggttttgaaaacctgtttcaaaatttcctaaattgcgggtaatttaccaacgtgtccagagaggaaacacctttggcctgaaaattcgaatttgtctgaatttagacactgtaactgtttgaattcagtgaaaatacgttcaaatctcacaaacagtatcctaacctttttgcattgcgaaaagaaaaatcctgatccaaacagcaaaaaagcaaggcaaaatttagaaacaacttttgaattcagcgaaattctgttcaaatatcatgagctgtccggattttcttttgcattgtgaaatgcaaaactctgaatcgaacatgacaaatttaaggcgaaattggggaagcaccaagtggtggaatcctagatgcatgcatgacttcatccaacatatttaaatgatgcccacaaatactatgcatatataagcatattttatatataacaagattttagtgggatatctcattggttttcgtctatctaaacatgtgttagccaggggacgtatttgcggtggtgtaatcattggtcctgtttggatcctccgggctattaaatagccctccagaatcttgctatttaagagtattaaacgtagattactgacaaaactcattccataacccctaagctattttgcgagacgaatctaacgaggtatat

SEQ ID NO: 69533 - DNA, 11831 bp, Oryza sativa
caatggggagtcatctttatggtttatttagactgattttgctaggactacttcatgtcaacaaattgagtgaatgatttttggttggatgattgctatatctcttaaattagattgaatgttagaaaatataaatattgtttcctaattttgttaggtgcttatagaccatttgcaaaagcagaactaattagttgggcatatagttttgtcgatctcttagaatgggcaacatcttgcatgagcatgtactggataactggtcaatgtttctaaattctaaattcataaatgcgagctagcataggcacaatttgagcgctcaccataacacatgtcccacaggtggtgtcgaggcactttattttcccctggataatttgatttcttgatctaagtgctaaattgaagtcttccacagcccatttccagctgagtctcttcctaaaattttaagttcaaatgaacccattagtgtttgtctcgtggtaccttacttagaaatactggatgcttgttctaagttgtactgacagattaccatcaattacacactccgtgcacaccaactaggccaatgtcacagaaaattctagaaaaatttgacacatacttccaatagtattacatctacgtgtaaaatcttatcttcaaattcattatattttagctgtaacaaaaaagacaaaatcctgacagatttttacccttaaaactgttagatttttcacttttttgttacggctaaaatatactccctccgtcccacaatataagggattttgaggttttgcttgcaacatttgaccactcgtcttattcaatttttttttgcaaatataaaaaacgaaaagttgtgcttaaagtaatgtagataataaagtaagtcaaataaaataaataataattttaaaaaattttaaataagacgagtggtcaaacattgcaaacaaaaactcaaaatcccttatattatgggatggagggagtaatgaatttgaatatgagactttgcagatatgtgtaatactattaggagtaaatgtccaatttcttatacttcctccgttttacaatgtaagttgttctagcatttcccatattcatattgatgttaatgaatctagatagatatatatgtctagattcattaacatcattatgaatgtaggaaatgctagaatgacttgcattgtgaaacggagggagtagaatttttcgtgacatttgctagttggtgtgcacggagtgtgctgaagcttgtgtgcaaatgatatgttctccattctatatcatattctatcagttgagtaatcatttctcttttttcctgttactaggtaccagaagaaggtttcgaacataattgatgatgttcttgagtggtctccaaagttagctttgtctgggatgatggaaaaacatactgggactaatgcatcagaaactagcaatcacaccagtggaactgggagtagtcctgtccctcccactaatgaagggaataccgcaaaagcagacccagatatggatcgtcagacgaactcagataaagtccaagatggtgatgagtatggtgatgacatgagaacaagatttagtgaagtttagaatcgacttataaactctaaagctctggtaatttggagtacttaccctcggggatttatctgcagaatcatatagataggttactgacaagttcaaattcagggtgctcatgttttgaccatgtttcattcacatattgccagcaatggctgtattacgaggttctcaaagcatattttcgcatggctatgatgtaaacgtgcctcgagtttgcccgagttgagaggttgagaatgcaatgtgtccgtgtccgtgcgtgtgagccgtgtgccaccgacacgtcctgtggcagtgagccaatatgtcttgcctatcgttctgtggctgagcctcagcaggcttgttacattcctcacactgatgacaccttgataagcgcatatgcccattgttcacatcccttgtcccttttttttttatgggaaccgatttcattactatgacggcccggccaggaataagttcatccgaggtctcccttaatgtcaccgaatctgattttcgtccttcaaccggaaaactacatcggatccctcaactattaaaaccggtgcagattaggtctctcggtggtttggaaggcggttttcattgacgtgatgtttatgtggctgatttgactaggtctttatcctatgtggcattgatgtggcgcttacgtggcaattatatatcagaaaaataataaaaatagtggcccacatgttagctacacacaaaaaataacctccctcactcctctcttcttcctttcccctctctcttctctctctcttctttcctggcagcggacggcacgggtgggtggcggagcagccaagcgaggcaggctatccgagatccagcggcggcggctcggcatgcgccacggcggggatgtgggacttggcgaaagggaaggaggcgaggcgacgggagcctcgaccaggggagaggaggccggcggcggggtggccttggccttgggcggcggcacgggcgccttggtgggtggcgcggtggccggagccggggtggtgggtgccgaggcgggggccggggtggcggggggtggtcggcgcggcggcgggcttcttcttggaggagaccggtggtgtggtggtcggctccacccgccgtaccgggaatccatctcggaggagctcctcgagaacattgtctcccgcatctccctctgcgacgtcgtcctcacctcggcgatctctcgttcctggatccaccggtgggagtctgcccctaatctccgccactagtggccccaccgcttgcgccccgatctggagcggcggtgcctaggtggccgtggcgggttcccttccaccaccagctcgcccgagtggctcccccagcctcctccccttcccacccccgcgccagcattgcacagcgtgggcgacttggccgagccagcggacgaggaggacgacgacgacgtggctgcggcgccaggccgcagccgcagcaatgacaccgtcgagccaagatctgcgaaaacatcacgcttggtgtccggcttgtccctcccggcggcatcgtcgagagccagcgccgcggattctgcgccgacctcgaccccgaccacacggtggcttcggcgccgaactcgactgcgccgcggccgtcttcgtctgcgcctttgagctctagcgcaccggtcgctctgctccacctgccacccctctgctccgcccgctgcccaccaccgctccgcccaccgcccctctgctccgcccctgctcgcccgtgccaccatcgcaagagaggagaggggagagagagttgaagagagggagatggggagagaggaggaagaagagtgggtcaagaatgacacgtggggcccacgtgggccctactattttttaattaatttatgtaaaactgacatgtgggtcccatgaggtttattatttttccggatcgaatggccacgtaagcgccacgtcggtgccacgtcagatcaagaccaagtcaaattagccttgtaggcgccatgtcagccaaaaccgtcgagggacctaatctgcaccggtttagatagttgaggaacctgttgtatctgtatctggttttgcggttgaaaaacgaaaatcgaattcattgacaagttaaaggaccttagatgaacttattccgcccagccaaatcactggtcaccaaacactctagaccaggcggggtactggcccagctaggggagttctgcaaattacaacccaacgctgccaattcgtgcgcaaccttattacattccgtggggcagtaacgaaccgagaaagaaagaaagcagctggagatgacattcttaatctccaaaatcacaccccctaaagccgacaaattaaaagaattctcgtggagtgccgttttaagcatcatcgagtccgtttccagctcaaccttcatcattcgcgggtacgaattacaccacaaaactatcatgtacggtcgatcgaattactcccctaaactcgaataccggatattttacaacgtcaactatacaaaccggacaaataacccctctagctcaatccaaagtagttttaatcctaagtggctgtccaattagcaaattttttttttaaaaatagtgtgggcccgacctgtaagtctccctatctatctctctcctctcacctctctcaatctctctctagtctctactctctcttcctcaatcccgattcactctctctctttctctctcttctccctccctttgctgcagcgagcggcggcggccgacagagtcggagcttgcactcgcacgaaggtggcgacaacggtggtggagccaaagctcgcatgagtggctggggtggcgaggcgtggctggatgggcgctccgatcggcgacaggcgctgcgacaaaaggggaaccagtcgatggtgagcggcggtgggtgtggatgggagggtgctccagtcggcagcgcgtcgggtctaggtgtcctcttcctcccctccaggaggcacaactacgaggcgagccactcgacgaaggagccgaggtcagggccaaggaaggcgttggcgtagacggtacagtggtgcggcccgaactgcgccgcctgttggtatttcttacgaccacagataaatccgcaagcccacggaataccgttgtaacacttcaccttcggatgaccccaaaaggatatcgaactcagagaacgtgtgtactctacctaatgctaagactatccaaggataacaactactggtaggctatctaggctagagaggattttctatgtgttttaattatctaagcgaagttgaaagtaatttcctatctgttgcttcaggcaccgacccttgttggtctgccagtgtggttccggctatagctttatgatgtatccgaacgtggaggattactatgacaggatttagggctgtcaccacctgctgtctacctctgacaaatccgtgggatacacaataaacaatggtaatctctaacctaaacaccacgtttaagttattaattactactctaatacttgcacatgaacttccttctttatccagagtcttagtagtagagcacttagtacaaatactaaataatgaacccgcaaagatgaaaatctatctcacttagactaagtaattaaataaaaaaaaagatctcgaatgcttactttatagaaaaagtttcttcgaacccggagcagagtgtactgatagcttcggtacaactccaaaattcttcctagaaaggtaaactcatcgaggtagaagtcggagagagcgccaaactttcaggcactcctctagagcttcccctcactctttacctattttctaatgcacaaaagatacaatagagcctcttgtaattcagctcaaagttgtttgttgtgaagtgaagtgagctcctccttttatagcctctatatgacggttacagctatgggaaatgtcctaaatgctctgcaaccgtcattgggatgtcatcagcagcgtacacgtggaaagctaggatcaaaggtgccagtggtggtttggccgaaccctaggcgccacctcctggcctctcctttggctaggagaccagctgggggactctgatggcggttatgacagttatgacccattccatggtggtttcacctgacttgggggcacttcaatccgtgtacatgcgtctgattggccggatgtatgtttccttgtatgacggttgtgttttctccttaaaatacctgcatacacatatttcaccaacactagtggagttgattagtaataatccctaccactaagttggataccatattttatttcattatatgcaggtattgatggtcaaatattatgatttatggaccgttaacaacacccccacacttaacatttgcttgtcccaagtgaaggctatggactctacaatagagttatgacttccttactaataatcatgtaaacaaattattcaaagccatacttgtacttgtgggtctttgtagtgtctaccaggcgatcttgagcaattgagaaatgtaccaatcaccctagcttttcatgaagaacaacttgagtttttttcaagtaacacaaaatttataacttttctttgctcctcagttgattctctcgatcactcaaggtgtatgattcctcacaaaggcacatgattgtgccttttcttttcttaccatctaataaggcttatgtggagttcagagtatggaaaagagtagagcattacttgcgtcacatatattgttaagtcaaataatggacccacggaaatgcaagacatactttcttgtcaagaagtgcatgtgtatgtgtatggcaaatttgtgggttgaaaaaggaaaatactattaataataataactccttttgtatacctcctcctccatttattttctgttttgaaattttggagagtgcatggttatctttttttttctctttgcctttttttccttttgtctctctttttttttttcatgatattgctctatacttgtaggcaaattttgctacaggacaccgtgactttgcagtttgtcatggctcatcacttctagggtgatcttgctttggttacggtgttgatgtgcaagatcactcacacacttgtctttgtacctgggatgctttattggacataaaaaaacaaagacaagagtgaagcaaaaaggactcatttggttggaagaccaggaagccaactttattttattttattttactttatttttattttaatagctagacctaagataactagagggtggcctaacgactcaggccattgaaaactaacggatcaagggggatctaaggactccgggtagaagctaaaagcgactaggtttactacgtctaagtcatgatcaacttctaacggatcaaggaaaaattttaaacgatggccatttaccttgaaagtgttacctttgttgtctcgttgtgtgatggctccatgtgatgaagtgtcgacgacggtatatgggcccatccatttacttcgaagttttccatgtccgaaaagcttcacccgtgagttgaacaactgcactttgtcctctgctttgaacaccttgtgcttgctctgtctatcatgccatcttttggttttgtccttatagatcttggcattatggtaggacttgtccctccattcctccagcttagagagctacatcttcctgagctgtccagctccctttaggtccatattccaagtccggatagcccagtgcgccctgtgttccaactctactagtaggtgacaagtcttcccgtagacaagttggtatggtgacatgataatgggtgccttataagcagtcctatatgcccaaagcgcatcaggtagcttgttcttccatgccttccccattttattgacagtcttctacagaatattcttaatttgtttgttgcatgtttctatctgcccacttgtctggggatgatatggagtggcaatgttgtgttgagcctcaagctcttgcaaaaagcttcggaaggtcttatcgatgaaatgagaccctccgtcacttatcaccatccgcggagttccaaaatgagggaagataatcttgtggaacatccgccgagcgtgcttggcatctgcgccttgcatggcattgcctctacccacttggacacatagtcagcggccaccatactcgtactcataggactttgggaaaggttccatgaggtcgatgccccatacatcaaataactcgacttgaaggttgtatgtcagtggcatcgcatctagagtagtaatccccctatgcttctggcaccttgtgcatcttcgaacgaatttctttgggtcatcatacattgttgtctaaaagaatccactctgccagatctttgcatgtgtcctgaatgctccatagtgatctccatatggggcagcatgacacttttcaatgattttcatgccttcgtctgccggaacgcatctccgtagtacgccatctgaacagactctgtaaaggtaaggtgcatcccacaagttccagcggctctcgtagatcaacctcttcttattttctcccagtgttacatgccccgcgaccatgaagttgatgatggttacataccacgggtcggagtctgtgactttcaagtttcaacagcatgtcatctcgtagatagtcatttatcggtagctcttgcatgttagtgatttgcatacgcgacaaatgatctgcaacaaaattctccactcccttttttatccttaatttcgatgttaaattcttggagttgaagaatccacctaattagccgaggttttgcatattttttagtgagcgggtattttagtgcagcatggttagtgtaaactattaccttagctcccactaaatatgacctgaacttatcaatgacaaacactacagctaggagctcttttttagttgtggcataattaagctgagctccagtcaatgttttactagcatttgcgatagcatggtcagtgtaaactattaccttagctcccactgcaaagttactagcatcgcacatgatttcaaacggctgcaaccaatcagagggttggatgactagtgctgagatgagtgattccttacagatgttaaaagattttagacactcatcatcaagtcaaacgggacatccttagctagcaccactgcttgttgcccgtaaacatcgtcaagacggagccgttgcacaatctgtatgccttcgtctcgtcacaccgaagtcatcgtgaggcctgtgattatgccgaaatgagatgttgtccgtccgtggtgcttttcccctctttgtcaagaatcgatgcagtctgtccgtggttctctccctttccgtggagtatgacatcgtcgctcgtccgtgtattggagggtcgcttgtctacatcaacatgaagcaagaatggtaccgtctatgatgccagggaaccgttcgtgttgaatctacaccaacaatgtcctcagccgttccgccgacatggcatttacttcttccaaggtcgttgttgtatttcttaacgacattactagaaatataattccaagtaatggcacagaaatactactggtatattatggttacagagtttatccgcaagcgcatggatataccgttgtagcatttcacccgagagtattccaaggtatcatatttgtttaatcccgtgggaagattataatagagagaaccgtactaataatttatatattacttgtaataaccaaagtctaagcaggggttaatataattcatagggtagagtgtcactaagcagaagcagtcatcctcttatttatgattatctaagctaagtggaaagaatatagaaagatcatattcctatacttatagtatacatacatattatacatacatcctaattatattattacttagctaataccctctatccgatgccctcctgttgcttgttgacggtcgttagcgatcagtttcgactgtcaatattaccaaaatagagaactagttatggttgcaatgcatattagtgttagaataataatattccacgtattgggtttactaaccttttgcagagaataaccataaagtggaggagaatcaacatcaaattagatgatcaattaatcggacgatgtcgaggatcagatttatgtatgaatgggccaagaacttagaaatgacacgacgaattgggccaaaattcacaagtctgtggaggagagcatgagaggaggccaccaaccaaaatttgggctggttgggccggcccctggttcggccgaaccttcctcaccgccgttcgatctaggtctttgcctggacggtgtagattggctccgaacgggtatttccgaccattccaaccatcacaaccgtcattgggaagctataaaaggagctctcatcctccatttcttgacatacttcaagcaagagctctctcatattctttctagtttagtttagtattcttaagcttgtggagtaaggatagaatagaaatctgagtccagatgtaagagccttaggttcataccaggtatttagaagtgcatttgttgtcctttagatttcatatttactatactgcaatttgattatatgcgataacaaagttaactctaatcggtaaaattgaaaccacttctatttgattaataacttgaacagaagtatacatgtttaataatttattcaaatactagtttatttatcaccaacaaatataaattatgtggaatttttactctctgtttaggcctcctacaaatccaaaccaactttcagcctaaccaatttcatcttttcacaagatttcaaatattaggaatttatgtgtgaaactttgaaaagtggaacctataaaccaacacctatcaccacaccaaattcctgaattgttgaacaaattttacctaatcaaattgaatttaccaagatagggaaagaaaataaatcctggaaatttcaagaacgaatctatactcagtttttcacccacctcgacttgggcccacttgtcactgaccttgggtgcctctttagccccacaacacacccatgggtgtgttcccacatcaggacttaagggggggcagagaaaacccattcttcttactcccctttcatcttcactgcttgctctttcttttcttctaagctgagctctcatctcacttctcctccccaaaccccatccaatagcccaagatcaatccctgcatgttagaccacaacaatccccatcatccaagctttccatccatcccaacatcttgcacatgcatggagacttgagagagatcgagaaggaataagagagtggtggtttcagcctgcagggctgcagaagcagcattttgttttcctccttttggtgagcttccttttcatccatggtgcctcttttgaattccctccatgttgaacatttgtagcaacgttctataggttgtccactccattactgcagctagaaggtggctgcaactcaccctgagttcatcttttttgatttcggttgaagcagccctacgcaatgtctcttgccgtcagcccgaggcctagctccgcctcttgccaactgcccaaggccttagcctcgcacaatcttacgtccaggttgctaccatgtgagccaagtccggtggaagttggagaaaaggggagtgaaaatagaaatcgatttctaaaacaactatcggactgaaagaggtatgaactttagaaatccataactaattcatatgaactccgaattcagtgaaccaaattcctatagattcataaacagagctcttcaatgttgtaaaataaaaatgaccaacttttgtactggttttcccagtaaaaatataaatagctatatgtatcccttgtgtctagctcttaataaattcgtatgaaattattggtaaaatctaaaattgtgcaaccatttttgttgagcttatattttagtactctttgctgttgtgaaaatgattttgacaaaactacctcttaaatcatgtttaggagtttatttagaattcctatgtttttaacttgtaaaatccttaaataaataatgacaacacatatagctttgaaataatttttcttaggacctgtgaatgatgttcttcccataaaaataatcatacttgtaaaaacttggtttgagttgcaagattcttggaatgctctaaagtagactcaattatttgcaaaactgccattatatgacctga

SEQ ID NO: 69534 - DNA, 973 bp, Oryza sativa
aattcctgcagcccaatggctttgatgcagtgtaatatatatagttctgtccttgtacacttcaggaggtgtgcactcacgattggattggcctgagatgaatgggagacacttatcaagacaaacctcacaggatcatggctcgtcgccaagcatgtatgtagacgcatgcgtgatgccaagctaaagggttcagtaattaacatttcctctgtttctggtcttaaccgtggtcatctgcctggctccactggatacgcagcttccaagtctgccatgcattatgccacaaaggtactatacttattactcaataattctcatcaggcgtttgtttaatgtgcttgtaacaaactatatttgatatgcttgtgcagctaatggctttggaattaggagcatatggcattagagtgaactcaatagcacctggaatcttcaagtcagagataaccgctcctctattgcaaaagaaatggttgagcactgttgtttcaaagatagtgccacttaagactcatggcactactgatccagcattgacgtcgctggttcgttttctgatccatgaaacatcatcatatgtgactggcaacatcttcattgtagattctggtgccaccttacctggtgttccaatattctcttctctgtaatattcatcattagaatttgctttcaaaaagtcatcggatctattgatttggcatcaaataaaaatcgaaactccagggaggtggaatttctatacaattgatttccaatatactctcaacctgtccacaagttgttttctgttattttcttattggcatgctactctgacaaatacattttttggtataaaatgacaagttatctacttttggtcctcttatattttataatctgtcaaagtatcaaccaagatgatgaacccattggcactttggcagcggtataattaagttaggaatattcttttttaggtgtt

SEQ ID NO: 69535 - DNA, 562 bp, Oryza sativa
attcctgcagcccaactgtttgaaaagtcgaagattgaataatgatgatttttggactttcaagtttaggggcggggcagtagaggtaaatttatcaatttactactaggtctggtgatatggtcttaggtgatgttgatccatggtggcgcaatcgatcgattatttgaggcgacatgagtatagagctgggacttgggccgtgctttcttgggccggcccaaggcacgatggcccagcacgagggaaagcacgccgagcacggcacggctatgggccgggccggcacggcccgtagttgggccgtgcctgggccgtaagttgaggcacgctgggcggcacggcacggcacggccattgggccgtgcctgggtcagcccagcacgaaaaatgcccgaaggcccaaggctggcccagcacgataaatggccgaaagtcacgagcgcaggagagcccgaagtcgccgcgagcgcgaggagatcacgagaccgcaggagcgccgaacgcgtgcgtgcgagtggcgaccccgtgattaatttcttactcttctggtttgaatgga

SEQ ID NO: 69536 - DNA, 37589 bp, Oryza sativa
ttataaaacgaagagagtatattcctatggaagtaaaccccctaaagtaatttaaaaaacgatttcttcaagtataatttgtatatgactttttcgtcccacaaaattttggattttgtagcgtgatgcacatgacaaagatacactgaactctttcgagataaggatatctgaacctctctaatttggtattatgttcaattgtttattattgtcttaataacttccttttatagatagctcaagcagtttttaatccatgatgatgtttgtaactgaaattgtgtctgcccccaggaattggagccatgcatgccagcataaggaaacgataaactttttccttttgaggcatttcgtttcatttcgaaatgtgaatttgatgcttctttcttgaatttcatacaataaatttcctgctaaaaacaccaactttaaacgcccttattagtaatagcaggagtttcttcatttgtgactcagctgaaggtagtaacggcagatgaatttatggaaagcattagcaagtgcttacctccatcctaaaataattttatttctaattatgcatcatttgtaactatgcatctggactaatacttatctatgtgcatacaaaagaatgaatctttcttaggaaacacctaaaacaaatactctcactgtaaaaaaaacttaaaatttagaataaaatttagttacattttaatactccgttcgccaataatttttatatatatgcttagtaagaagaagttgtatacatatatttgcctttgtcttcaaatacttgtcactggatacaattcatctttgaacttttgaccactcatcgtttttttagaaaaaatataagtacttaaaagtattatatttttaacgaagtgttttacatcctacatatattcattaattcttttgtaagtcatggtctaatcattttaaaagtatttgatggtcaaagataaaattatattgatcaatggtggcagttatttgaaaccagaagaagggggtgttcagcaccccttttcccaacccctctcccccgttttccacgcgcatacttttcaaaatgctaaacggtgcgttttttgcaaaaagtttctatacgaaagttgcttaaaaaaataaattaatcctttttttaaaaaaatagctagtacttaagtaatcacgtgctaatggaccactccgttttccacgcgtactgttcctgttgggaacttggatgagcgaacacagctaagaagaagtttggtacacttagggtgtgtttgaggagaaggggattgaggagattgggaagatacgcaaaacgaggtgagctattagctcatcattaattgagtattaactattttaaatttcaaaaataaattaatatgattttttaaagcaactttcctatagaaatttttacaaaaaacgcaccgtttagtagtttggaaacgtgcgcacggaaaacgaaacaaacaaactcactctctcaccctctcgaacgctgccttattagatagtatgaatatgttctaatataaaactgttggtcaagtttggctgaatcttatcctagaaacatcaagtatttacatccaaccagatggaatcctttctccatgtggtgtcaattctattgttcagactttaaccaataataatttatatattattaaattttgtaaggttaactgccaaattgttagatttattttgtgggtttgaaatagttgtaggcttaactatttagtgccacgaaaaacgagatgaacaatgattcattatatattaactattataaacttgaaaaataaattctgtcattttttaaagtaacctctatatggaaagtttttgcacgaacacactatttagcgatttagaaagcatactcacggtaaacgagggattagcccacccaaacaccaccttagaactcaattcagccttagacatgttttgatgaaagccattttttatcctactatttttttggcaacttcaatagtattttttttaagagaaggcaaagaagattgtcttcaacagtattgtatggatgtttgattggatgctaaattttgctcacactaatacaaattctactataacaaatttggtagtgccaagattttagcactatcaatattttattttaattagtaggttaaaattaatatggggtatttgatagtgcaaattaaccttttattaatacaaattctactacaacaaatttggtagtgcaaaaatcttggcactaccatattgtaagatttggtactgcatttcattggtagaaattggggttcaaaccaaaatagccctcgaaatccattcttgaattaatagatttataaagcgcctatcttaaccagtgatttttttctcaggaacattacaagtcaatgggattatgaaaagtgcatcgtgcaaaatcttgtttttctccctggctcacgtgcaagtgcatatcaggtctcacgtagttccctgcacttctactatacttcagctgtgtacaacctcctcctctacagttttcactcgtactggagtacaactgttgcaagatgtgacaagacgccatgtgattcgattcaactgggggtgttaaatgttcagttgacagccaattcaagaagaatacgctctaattggcgcacttaattatgttgctactacctgtgcaaagtctgtgtgtacgagatggatgctgatcttgtgccaaaatctctgaaactgtgaacaaagagaatgctaattcattggtgtaccggtgattaacataactgttgctgagaaaatgtgttgaaggacactgaactaatcggtttttcagcggcgaaaattggctggtgcattgcatttgcatatgcaataacttttagagccaaatgtcgcaggcttgaatcttgggtaaaatgaattaaaatatttgaattctaattttattcataaagggggattcacacgaggaagaatgcccctctttttttgtcagaataaattgtggattaggacgtattagtggcgtgcaatatgtatctcatcacagacaataattctccgctagaatttgtgttcaccagctttcccacccaacaagagaacttgacaagtattgacccttttgatcgctgacttctaaatggcaagtagtcaactatggctcgtctaattcaattgctaccgcaatcattatgactattaaaaaccagtataggtgatggcgagagctcgagcaaaatctcgaacagggacttgtagatgcatataactctattgttattatagtacgaattcatgctaacataaaagaaatgctgatcagttctacaaactgtgtgctaaaatacaacctgtgctacaatatacaaatatataaactactatctctattcaaaagtgttaggagctgcctaagttagcacgtttaatactccctctgttccataatataagagattatagtgcgatgtgacaccagtcatatgaatataaacacctctctatcaacatgcgtgattctataatgtgtgatataccatcaaaattacttatattatggggcgatataatgaattttaccgtaatgtgacacattctagtattatgaatctagacacctctctgtccaaattcatagtactaagatgtgtctcatcccaccaaaatcccttatattatgggatgaagggagtagtatagccaactactagctctaattatatataaccaatttaatagtccattcatacaatagttaactataaatatatattacaccattaacatatggtcacacctttcatacgcacacaatattttagagtctgtgttgtgttacagctaactacaagtccgctttttttctctctcttctcttttcttctctacatatgcttatagctaattggtagcctgcaattgtactccgctattttttttttgaccggaattgtactccgctattaggcgctaggggttgggtaacctccatgactagctattagatggtgtataggttgctagactactttgggtgttacttatactgattataaaaacaacgataacgttgtaaaaaataacattaaggtgaaccataactattatgacattgaaaaagaaaaacaaccataagattaggatcgaccataagtgaataaaaaaaatctaagaatctctcctctccctatgttccattcactccccacctagtaaaatattgatttaatttggagtcttttttatttgtaaatgtgcccacatctattatccacgtagaactttaacaactgaccaactggcataggatgttcggcaataaacattggtattgcgctatgccgtaacaacttattaataacaaaaaaaatattgtttataaacttttatactcatatatgtgttgttagtaatttaaagcaaaggctgaaaatgaattacaatgaaaaacttaaaataaaccaacaaattaagtttcaatactcaactctgtttctttcttttttattgttcatttttttaggaaaaaaaagaaagatgctctctgtttgactctttctgtttgctaataatggcactacggaagtagggaacgaagcaggtaggaccagaaggcaggaagacgatagatctgtttgagattaagcctaagcaaattccacttaatgtagtaaattaatgtaagcttatattacacccttttctgttcgttcaagtgaactgcatcaccaatatatgtaacattcaaaaacttaggctctgtcattttccgctcgcacgtttttcaaactaccaaacggtacgttttttacaaaaagtttctttacaaaagttgcttaaaaaagtcaaattaatctatttttttaaaaaataactaatacttaattaatcacgcattaataaactgctcagttttccgtacggaggggatgggttcccaatccatcctatggaacacaaccttaaggctgtgtttggaactccaagttcccaacccctctccctcgttttccgcgcgcacgcttttcaaactgctaaacggtgtattttttgtaaaaagtttctatacaaaagttgcttaaaaaattcaaattaatccattttttaaaaagaaattagccgattcttaattaatcacgcgctaatggaccgctccgttttccgtgcggggagattgggttcccatccctactatccgaacacagcctaagggtgactgatatgtttactttactaattaagacatagtgactgatatgcttactttactaactaagagggctaaagatgttggtatcttaaaggggttatccctcatttagtagatgatggtttatcaatattgcaatatgtggatgatatcattgtttttttgagcatgatttacaacaagctaagaatctgaaactaactttatctgtttttgaaaaactgtctggcctgaaaattaattttcacaaaagtgaattattttattttggtcatgcaggggattattatgatcaatattctaatattttttgttgtaaattaggttccttacctgttaaatatctcggtattccaatgcattttagaaaacttagtaacaatgattggaaacttattgaacaaagaattgagaagaagtttagtagttggaaagcaaaacatatgtctgttggaggagattggttttgattaattctgtactttcgagtttagctatgtttatgatatccttttttgagattccgaaaagggttctttaaaaaattaattattatagatcacatttcttttggcaaggggatgataataagaaaaagtacatgcttgctagataggatattatttaccaacccaaagatcagagtggcttgagggttcataatctggaaatatagaacaaatgtcttttgagtgaatggttatttaagttaataaatgagcaaggggtttggcagaatttattgaagagaaaatatctttataataagtatataacccagattgataggagacagggtgactctcatttctggttaggtcttatgaaagttaagaatactttcttgaatatggattcttggatagtgaataatgaggaacaaacaagattttgggaagataaatggttaggtaatatggcctttaaagataagtatccttctttatatgctattgtcagaaggaagaattctttaattgctaccgtcatgagttctgttctacttaatgtattttcaggagagctttagttggtcagaatcttatattttggcatgatttgtgtgtttctattgtacatatccagttgaatcaatcttcggattgtttctcatggaattataatcagaatggtcggttctctgtaaggtcaatgtatctagctttgattaataactgctatattgggaggaataagataatttggaagcttaagattaaaggggtggtgttaacgaaagataatttagcaagacgaaactgaaatggtagctcaagatgtcgtttctgtatgaaaaatgagacaattaaccatctttttatcgattgccattacgcaaaattcatatggagagcagttcagttttattttggcttatacattcctactagcatttctcatattttttatgggtggttgttaggagaggacaggaagaaaagtaaacttatattgctgggagcttctacgatatgttgggctctatggttgtgtaggaatgacgtagtttttgataaataatcatatgttcatatatgtaggtaattttaggggaacatattggctccggttttggacacagttacaaaggtttgatgaagacggagagtttttaaagttgcatgcaaaaagcttgagtcgatggttatgcatttttttaccaattatggatggagattcacaaatagacatcattctccatatcttttattggttatttttatctttatgcgatggttgctattatttttagagtacaattgttttgagtgctagattgtaattaataatgggttatagctcttttgagtaaaagccgggatgttatatttcattattaaaaaaaatcaccaatatatgtactgctttaattccacttaatgtagtaaatttgcgcctaacttgactaaatgttcttcaggtggaagctctgaagtcgtatcaggtaatcctaacgatgaattattgactgaaactgacaagatgggagaggaagggaacagcttgcaagttgcaagcgcgaaggcgactacgatcacctcacaccagccgagaggcgtttacatggagcagaagcagatgattgataaacacaagtggccaacaagtcacacagggaatcgcatcaagtatttcaactaatacctggcactacgacatcccaaaaagttgggccccggttaaatcttgaatgttcttcagaggttttatgctggtatgctttctgtgctgctgacccatccagccatctgttagcctgtgatgctcctcctacctatatggtagtctttgaaactcatgaagataaagattaagctggcgcatcacaagactaaacgtttggttagtcttgggaagatctgaagatctgagtgtggtatttcgaaaatccaaaccatgtttaatacttggatgcatgtatgtgcttcatatgtgtccaaatttacatgtatgttagtgaatctagacaatagatataaagaaaaaaagtcttataatgtggaacacagggagtacggttttaaatatgaaatgaaatataagagagccgccatgttgaatgatgcaagttttgctatgtaacaagtaggttagatgcattagcagataacacgattaaaagggaaactaacaacttcctagatgattcatgcaagtttttttttacatgacaaaatgcttcgggggacggattttgtcatgtaaaaaaaacccctcaaatctcgtattgaaagatgtaacaaaacccaagctagaaaaatgcaagaactacagggtctagcatattgctcagagattcatgagaaacaatcagagaactttgaagactatgaatggatttagatacttcagaacaaatagcctcttcatttgtatttccatttcccagcaacaaaaagacaaagatacaacagtttctattaacatcattcaaaacctcgtaaaggtatatcactatacagccacagaattggaaaaacaatgaagctttgataattatcagagggaaaaatatcaaagattgcattgagataattgtcaattataagcaaccacagaacttgctcattttgtttcacacctatgttattctttgaacacgattaaaaaacttcctccgaatcaactaatcaatcatcccaaattactaatagctacagactaaggaaagactcgaaaaagatagtttttgaacatgaggtgatcagagaaatttgaagacacacccatacccttttctcgcagttatccctgtacccaatctcaagagaacaggggctaatggtccgggtcaaacataagaaaataccatccaagaacagcatgcacatagatgactatcaaacaaaagtaccttaagtcttggtaataacttacataatcatacaagaaataatatcagggaagcctatcacacaagatcattgcatgttgcgatctaagaggagaaaaagctgaaagccaaacaaaaattacccactggaattcaagttactccactccccagcatggactaaaaaccatattcaccagcttcatacattttaattagagcaggacaatccgagtacaaagtttataactgaaactaggaaaacacagcaagccagccagggttcagactcctagaatggaaaacatcttgcctctcaagattggcaagaagataattggagtaagaagctcagacagtaacacaaatgcagctcctagctcaaaatgtctgaactccgaacaatgatataatctggtaaagaagttcaggccacactactcttaagaaccagtggatgtgttgaactgaccaaggacacagtaacacatctactacaagttcacaacccctggccattctgtatgctcaacaagcttcctgaaaagaaaccaattgagtgaatattcttaacatccaccaagtctgaacccaaagtgtccgtctccggatcatataaccgcatcacccgcctcgtgtattgcccttcgaagttggctaagtgcacagttatgtagatgagtatcctgccatcatctagaatcagtgagggatgtgcatgagggaaaatgtgttcagtgtcccaggtatccatctccaaaacaatcctatacttcttctcccaaatctgcttctccgagtccatcagataccagaggtctacgtaggatttgatctccgcgcttcgataatccgtgtactgagctacaaccaatgcaccactcagctcggacaatgacagattctggtacaccgacatctcaaggggctcagggaggatctcatcgatgttgttcatctccggatgggtcgccattggtccctccaggtatgatatccacctctcggagcagagatcgaacagggccatgtgatccatctcgtaggattcgcgatgcgcgttcttgacgccattgggacggccatccagcaagaagtagacgacgccattgatgacgacgccgccgatggcgtccctccggacgcacatcggcagcgccttcttggccctccaccgcatatggtatctgctgctctcgtccagactcaagatctcgaacagctgttcggggaattgcttgttgtggcaatccgtgaggacgcggagcaccttgtaatcgccattgctgtccctgccgtacttgaaggagccgtcgaagtcgctcagagatcttccccggagggagtgcggcgtcgacagcggctccggcaggtggacggcggcgccggtgatcgggttgaggagggtggccctgcaggtgtagacctcggtgacgcagaggaggtcgaggttggtggtggggaggacgaggtgggtggcggcttggcgaatgcacttgaccacgctgccggagaggtccatgaggaggacgtcgacggaggggaacacgtcgaagtcgagcacgccgccggcgaggagcgggccgcggtggcgcgcggcgtgcgcggcgacgaacgtcgcgtcggtggtgagcgcccgccacgacctgcacacgccgcggaggcggcacacgtccttgggccccagccgcagcagcacctcgaacagcacgtccgccggcagcgccgcgcgccgccttcgccgccgccggcggcggagggggaagccgtcgtccccgcctcgccgctcaccttggcgcactggctccgcgacgccattgctgacaaacacacaccaaatcagcaagacactttactacctcgagcacataaatatctttaaaccgataatctttccgacttacgtgtagactattcttttatgataatcttctcaacttacgtgtagactatgtagatgtcgctggagaagtgatttgagatgatccaaaagtgcaacaacgataatcttatctggtccaaaatgaaagtattagctagagaattatccaaagtgaaattttaataatataaaatatggatcaaagtacaattaacttaaaaaaacaacgaaacggaagatataaaagaacagtcgatgcgacgacgacgacacagcgcgcgattctggtggcgaagaaatcaagaaccctagctagctagatagtacgaaggggaagattagcgggggttggtttcagatccgacgccgacgaactccggtggaaactaaccttcgtctacctcacctccggtgcggcggcgaagagaggaggggatctccttgcaatggtggcgatggtgggaggaggaggaggaggaggagcaccattatttgtgtccgtggaaagagtggggcagcaacaattcagccaatgagaaggctacaactcctgtgtgcatggtacgacgacgatggagtgatactgaagattttttttttttggaggttagttcaagaaaaacgtgggaatccaatatggatgtttgttttggaagaaaaaaaatgaaatgattattcaaatgcttggaaggacggtttgatagggactggtcgctggacgggatcggttttcgacaagcaggaaaccacggctgatgaagcctgttgtggtttttctttttctttttttttttggagaagtctactttacgtccctagaatatgggtactaggtaggttccaataatattcttcaaccgcaaaattggatagagcactgtcacgcccggaatttctatacaaaattccaaacgcttacatgtgtgttacatcctcgtccaggaatcagccgaggcacacaataacaaattgataatagagtactattaaacagctaattaatattcgcaaaatagcaaattattacagaggtggatagttcctctcaaagaataaaattctacgcagcggaaataaaacaaaatacagaacagctatggcgactccactccacaagcaacttaacccggacaaagcctagtcctccaaatcattaccttcactgaaatactcctcctctgatgaatgaatattgcaagaatgagcatatgacatactcaacaagccacacaacaaatatgcaagtgcacaggataacaaaggatggcatagtaaagctcatttgcataaataacatttattaaacctttgagagaataataaaacagttgaataattaatcagtattaaataaacaccatacaacacaactgtgttgcataggcccaacctcatctgaacaaccaaccccggttgtacaaatcaaacctccataccaggaatatatcattccaaaccaggagtcaaattaacacaatattatcattaatgagtagtgtgagactaatcacgaaaaatattgttaaactcacccataaccgcgggtacggctattcgaatagtttactctgatcagaggtgtaccactgtacccacaagacacagctccacaacatgtcaccatgcgccttagtaccaccacggtaccttggaaaggaactgtgacaatacctctcacactgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcgtccctcgacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggacccctagtcctcctctttcgtttgccccctctcccgtggtctcccgtgcctcgtagcgccgccgccacgtgctccaccccgccgtagtcgccggccgagctccatccgcgtcgcgccgctgcctccgccgtcgccgccggtcgccgtcaccaccgttaggtgcgcgggagggtggagaagcccggccgctatctccccgaagccgccgaccaccgcagccccgtcgccgccgtcgaccgaagccgcgccgacgctagacctcgtcgccggccgtcgtcgttcgtcgtttggttcgagggtgagtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactttttatttggtttttattagtctttttcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaaactattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcatgttatgataattaattgataactaaaacttgacaatggtgggttgtgagcacatggttttgaaggtcatgctcatgataattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccaggatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactataaatagtgatgattctgtatattaaattgtcagtttgtgtacctcggctgattcctggacgaggattttatgcacaaataagttcggaaattactagtgaatttctgggcggcgtaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttccacctctagcagccgaactgagaccgatttggctcggtttttctcctccaaatctgacctttccccttgtgtttttctaaaattagttgaggggaaatattcctcttatcctcctctatctttcccctcaagaatcggagcaaatggttgagtatcttgcccgaatcaaactcgttttcgagtttatctccaaaaccgagttttctcggatcgatttcttgcgggaggagtccgatctcttcaatccaaggctataaataggaccccctagttcccctctttcgtttgccccatctcccgtggtctcccgtgctccgtagagtcgccgccgcgcgcacctagttcgccgccgccgccggccgtcttcagccacgccgcgccgtcgcttgcgtcgtcgccgccgcttgccgccgccgccgttaggtgcgccgtggtgaggagaacctcggccgcccgtcccccttcgccgccgaccaccggagctccgccgtcgccgtcaagccgagccgccgccgccgtcctcttcgtcgccggccatcatcgttcgtcgtttgtcattgtggtgagtaccgttgggttcgcctcgtcgtcctctacgcgtaggtgtcctccaatcacccggccaaggtccctagctccggcgaggtcgccaaccctagccggcctccgtgggtgatgtcatgctgacatcatcatcctttcttttttttccttttttctaatagatgaaatcttcggaaaatcataactaaataaccatagatccgtttcaggtggttcaagttgctaaatttttctaaaataaagatctacatattaaaattgtccataaattgaattaaatttatttaagtctttttaaatggactttaattagatttaatcttgtaaaattcataataaattcatttgaagtcggaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgtttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatggatttgtatattaaattgtcagtttgtgtacctcggctgattcctggacgaggattttatgcacaaattagttcggaaattattagtgaatttccgggcgtgacaagttggtcaaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaaactaacaactcaccacagtgcaccgttcctggatcataatctccccctcaaaaccagaggcaatggactccccagcgacccccaccgacttctcgccgcttcacagtctggcaccctataatgaatcatgctatacaaaaggtaaagctgttgcccacgctggcttgtggttggcacggtaaatgtttcacaacagtagctcgcgaaccggtccttaattgtcatgagcacaaccatcaaaaccatatgctcacaacccacccttaatcaggttttaattatcaattaattaacaaaacacgattaaccatcgtgagctaccattaaatataaccataattaataatatagtatatatgattcatcccattaatgagcttatctttctaagcatggctaagcaattatacatatagcatttagctgaaccaattcaatatataaggtccaagctaatcaatttataacccataggaaaataaagtcatattcgaccattaattaattaggaaaggctcaccacccaatgacattcgaaaataatgcataagttgaaataaaacattagctttaaacgggttcaacatgctcaaagggttgtttgggatctgtgtgacttgccttgaacttccgcaaatgcttccgaaccttcctcaacgaaaacgctctcctccagaacgtcggaaactaaagcaaaagaacaaaatcaataaaacagtacaaaaacaagcataaacagtacatgtggatatttttaacatgtagatcttgattttagaaaaatttagcaacttgaaccactcgaatccgagttacggtgatttagttatgaatttccaaaatttaatcgattttcatctaataaagaaaactaaaaagaggtttatgacgtcatgatgacgtcatcaccgccggccatgacacgggtgatgtgaccaccggcgctagaggggtcggccgggctaacggaggacatctacgcgtagaggacgacgacgcgaactcaccggtgcaaaaaaaactatgacggacgacggcgaacggcggccggcgacgagctccaacggtgactcggctcgggtcggcggcggcggcggcgctctggcgaccggcgacggcggcgaagggacggctggggtgctcctcctccgtgcgcacccgacggcggcgaaaggaggcggcggcgacggctagggcgacgtggcggcggcgctacgggcgacggctcgacttgggacaagaggcaaacggaagaggacgactagggaatgctatttaaaggcttggattagggagatcggactccaaccgagaggaatcgaagacggaaaatcttcgggttagtttggagagataaactcgaaaacgagtttgattcggataaaatacgaagcaattagctccgattcttgggggaaaggatagaggacaacaaagggataaaaacccctcaaccaattggactcggagatggccggttggggtggattcggcggggaacggcggcggcttgggctcgggcaggccggccgaaggttgaagacaaccccgacatgtgggccccacatgtcggcggttgaaaggaggggggcgacggctaggcttgggccgtacggccacgcgcgagagaaagaggagttaggccgggaacagcctaggagaggatttttaagacttttccaattaaaataattcatgaaatgatgtttcatttattaaaaatacttcccttgctcataattttcagaaaaatctagaaaatagataaacaagcaaagtatttaatgaaattttatctagctcaattttatgttgaaatttttcctaaattattagagtttaacttgtaggcttttaaaataatttctaattgaggcgattttcagggcgtgacaatcactcaaaacatttaaaaccagtgtaaattaagttccctcgatggttttacctaatataccatccacgtagtatgttgacctggtcatcatccttaaaacagagctgcacgatgaggggtgcccaagaaccattcatctagggcaaaatttgctacgggacacttaaagattgtggtctttgctgtgagacacctgaagatcatgtatttgcttgtggacgctgtaaaaaaatactagtaattagctgctgacacttcttttattattttattattttgcatgaaaacggaaaggaggtccgatgcagcggcgaggcctgtcacggcgtcatcgataatctggccgtgagatttgcaaatttaagtgcgaaaatgataccgtagcgaacatcatcagtataaccatgaaatttttatcgaatctcaactttcagcaatgggcatacattcatattatttttttctcggtgggaggagtaccattccataattgtgtccgtgaaaagggtggggagcggcagcaattttaaccaatgagcaggatagaactactgtggatgggtactactagtagtagtacgacggattcttttgcaggcaactcatcaagaaagcgtggaatggaatccaggagtgggagatactctcttcgttccatttcaagtgtagctgtgattttccgtgttcaattttgatcgtctgttttatttaaaatatttttataaattagtatttttttgttatagatgataaaatatgaatagtacgacttatatttttaatttattttcaaatttttttcaaataagatatatgattaaagttgggcgtgaaaaaccatggctacacttaaaatgagacggagggtgtaaatatttgtgaaaaaaaaagaagcggtacaaatgcttaaaaggacggtgtttgagaaggactagcttcgctggagtggagggactgtggttttcgacatgcggagaaaccacggccgacggccgggcccgttgtgagggattgattggttttcgacatgcagagaaaccaccgctgacgggcctgttgtggttttgtggggggactggtcattattcagtggtcacttcatgctgtattcctacatagagtaagggcaggggcggatccaacgtgggtgcagggggactcgaggctccctacacccacaagacccatgaatatccccggagcacccccttcaaatttttcaccatgaataataaactaaaggtttctagatagctggaggtggaagaaactgtgtaattgaacccctccaatttttttgttcctagatccgcccctctaagggccactttgaatcgtagggtagaaaaaacgaaggaataggaaaaacacaggattatgacaggaattgaagtgtaaaacagatgattgcaaaacacaggaaaaacataggaatggttgtttgattggagcacaagaaaaacgcaagaatcagatgagagagatagactcaaaggaaattttccaagaggttgaagctcttgctaaatttcctccaaaatccacatgcaatgtgccattccataggaatttcataggatttagaaagcttcaatcctttgaatcaaagggccaaatagaaaaatttcttataggatttgaatcctatgaaattcctacataaatcctttgattcaaaggggccctaaagtttttctggtccgatgtacaggagtagtactacctccgtcctaaaataagtgcagctatgagtttccgcgcccaactttgatcgtccgtcttatttgaaattttttataattagtatttttattgttatgagatgataaaacatgaatagtactttactcgtgacttatgtttttaatttttttaaaaaaaattcaaataagacgaacagttaaagttgggcgtggaaaaccatggttgcacttattttgggacggagggagtactaatttactctctcgatctcatgaaaacctaaactagcatcggatgtaataagtactacctctgccttaaaatatagcaatttttagctataaatctagtcacatatgcgtccagatttgtagctaaaaatacttacattttaggacggagggagtagaacttttagtttagacagagatatattcagatttatgagatagaggaagtgctacgtttttaaaatatagttatttctagcatagtgacttattctgaaatagagctatttctacacgtattatcttctcttaaccaattgcacctattctccatttaatttcttccgtcatcttcttttctcaacaaatcacaaccttcatcctattatttctacctactaatttaatattgtgcccatcttggaacgaagaaagtaacttcgtatcaccgaaacttcatctttaaattaacgaccatagtaagaaattaaagtcgtcctcgttaatatgataatagtatcgtgaattgataggtaagagatggctgataggtatctaaggaataaaactaattgatttatgctatgttttttctaagaaaaatcaattatgggccttttgaatcacaggaatggaaaaacagaggaataggaaaaacgcaagattctgacaggaatatagctgtagaacagaagattgaaaaatacaggaaaaacacaagaacgaccgtttgattggaccttgattggaccataggaaaaacgaaggaatcaatttttctaagagattggacctcttgttaactttcctccaaaatctccgtaggattacccattacatagaaattttaaaggttagtataggattcaatcatttgtttcaaagggtttcataggaaatttttccgtaggattgaaacccttcaaattttctacacttttcttacaaatctaaggggcccttaagtccttccgataaaagttggaaagttaaaataaagctttttctaaaggagggagtacatgcagtataaattatttctatttttttctcttcatttcagtatccattttcctaactcccgtgggcatgtgaataaggaattcacctatggttgtaaatgataacttcattagtatatcgccagctaaaaagaatcaaagaactggttctgcacggacaacttcctttcttaaaaaaagaagcgttggaactcaatctgttcatactatttttttggtacaataactgatggctctacacacagtatgtacaatctgaaaatttcgaataaacatgtagtgttgcattacaaacaaatggattttgatattcttcaaatgtgtcaggcaattgagctaaagtgaacactttaaacttctggaaaatgaagagataaaaaaagggaaggcaaattatccaagaatgcgctcaacatgctgcgccactcgttttgcaaggcaatcagctgcttcctctgaagatgcctctgcatatacacgcaccacatcctcggtaccagatggccgcacgaaacatcgcccatgagagtaatttgctgcagggtacctcagaattcagtaacacttcaatttatgccaagaaaatcggatgtcggaaagaaacataagtattatatgctcagagaagatgttacttacatatctccccatctatcagttcctgcagcccattaggctggcaaacccttctttctgcatctgttgtaacaatagaatttcgatcttgaactttaacctgaaatcataattatattatgggagcctgatatgacagtgataactagaggcgtatcttagaaaagaagaggtaataactccaggtactttggcgaaaataccttcaattgtctactgggcagatcagtgtacaggtcacaccaattctgaaacgaccagcccttgtattgcaaaacagcctccaccaaaagcattccacttaaagcatctccaactgcctgattaattagctgacttgtggccaacaatctcatagcagcttggtgttgtgaagaacctaatgtgaaaaggtaaaaggaaagggggaaacatcacgacaaccataaacaaatagatccaacaatgcaaaagagaaaagaaatgctggaaaaatcatgaagagttcacctgcagcctttgaagaaaactcactggtcaaagattccagttgtgagacaaaatgatctgagaatagcactgtcccatgtccattggcttcaaagtagataccgatatcatattttagggcttccttgtgaagatatttcactccagttggagtgaatacaacttcgagaccaatgttcttgagaaaatctgttgatgcaccatttgcataagctgtttgaattacaccaaaacgtgtaggaagtacttcatttcctttattgtcttttccattgataatatctaattgctctctaataaacagcacgaatagtgataatatcttgtcaccatcaacgagatcaatcctagtgtcactagaggatacgatacggaaataaacaagccggtcagcgtcgccatcaaaacttgcacacctgaaagttagatcagaatggccaggtaagatcagtgacaactgacaagtagaaatttaaggagcaattaactgactcacctgaaaccgacatcttcaggaccaaagccaagaggaacaactttctccttctgaacaaagtctgcaccacaactctcattaagtatcccttctcccttccctgaattcctcacatgaatgtctaatccagagatttttgcctttatttcttcaagtttcaacccaccaatgccattagctccatccacaattagtctattgtttatcacatcagcttctttatcttttgggactaactccaataaacacctattgcaatatagttaaattatgcaaacaaatagatgccacatatttattacttacagtagcagagaattaaattcagaagaacctgaatgaatcaataacttgtgaaaaataatccgtctcagaagacttcagtcctttgtttttacttcggaccatccaatgcagctgtggagtggtgaggatccccatgtcaactgctactgcacctattaccgcatttactcccttcatgcatgagttccagaaaactattaagattgactcatgaacatgagacatacagtgaatacagaataaaggatgtaaattgatgtcataccttcaccgccacatcaaggaggtactctccagttggcctcgtgtctcttgccagcagcacttgtgccgagtggcttccaccaagtttaatatcctcatcttttgcaaactgaagcactatctacaattcaacaaacataaaagaaaactgagggtaagagtaggcagaaacaaaactatcaactatctgaacaaacttaacatctcaggcagaagatgccactcctcattagttccatagttcaatccaatgataatattgaggcactgaagttctgttttccaacagtatcaagtaccaattagcaccatcagagtctttaacattgatcaaggaatttaaacattactataattccaatatgctggaggtttcatgaggatgatgaccactcatttttcaaatgcaagaatgttcgacaatgctggagtgaactagatcttgaggatttaagataaaaactgttgatgtgttgttcacctaaagcagcgatggaggaaacctgaaacctttctaaagagaaacgattgaatataactaatttgctttggagatggtggagtgaaagaaacaaagtaaactcagaagaggaccaagtacaaccacaaggttttacgacttgcagtatattttaccctagaggatttgtttcagctctgaatgaactttgacaagacaatggtgccaatactgtcatctctagagctgtcagattcttgttagcaacatgttttgttcatgttagagacttaaagagtcatgcactgtcctagaaactgtgaagtgttatccatgctctagcacaatttggagcatcccaagaactcgagcatcacctgctctggttcaataaatttctagagtttgtaaggcctggtttagttcccaactttttcttcaaacttccaacttttctatcacatcaaaactttcctacacacataaacttccaacttttccgtcacatcgttccaatttcaatcaaacttccaattttggcgtgaactaaacacaccctaacttaggtgactggcgatctggctagctcatcctattaacaaaattagctctcatgttacaaaaatcaacacagaggaaagagattacgcgtcagacagtaacaaatcgaactgactagctagctgtagtacgcaatctaacaaggtcagggcatgtggtaagctgagatccagcgaaggagaggcaacctggaggagggcgtcggggttgggggcattggcgagtgcgtcggcgaacggctcccagtcctgcgacagcatcccgccgtccgcgtcgacgatcttgacgccgttgtcgcggaccgggttgtgcgaggctgtgatgaccacccccacggcggcgccgcccagcttggccgaccgcagcgccgccaccaccccggcgcggcacaccgcggggcccatggcggccccctccgcgcggaaccccgccgtcccgtacgagaacctcgcgccgtcgggcggcggcgggaagagggtggccgccgcgagcagcgcggcgcgctggtcgcctcccgccgcgagctcggccatggcgctgcgggtggatcgaaaccctctcgccgccgacggagaggtctgcggcgacctgctgagatctgggctcgccggagtcggagaaggggcgtagtagagggcgagctctgtagaggtgtacggtcggtatcgtccgttcgatttgaatcggatggctgtcaacctcccagagtgtactgtatatttctgaattttttagagaactgaaaaaacgttcgtacgatgttttttttttctccagaattttcagtagcatacattaacagtagcaaatttgagatgtttgcttgtcaggtacagtaaaccactaatatgatagagtttgaacttcagattttggattagagttttgcatcacagatatacatgcacagtgaacaatggttaataatgaacaatggggatttagtcaacgcaggggatttctaaagccattatgcatctaacataccctgcctcgtatgcctcctgtacaggaactggatcgagcagcactcttaccttgttcacaggcaggatggatggcttgcagggttgacgagtcctgggatcggtggcggcgtgagggactcgaagcaggttcaccttcgaggtcgggacgacgatggagcgacgcagcgacggcgccgacggggctgcgggctgcggcggcgtggagcgtcgatagggaaggcccgacctcgcctcctccagccgttgcgcggaatcacgccgtcgatggagggtaggccgatgatgcggctgttgcggcgtggatcagggatgcgacgtggatcggggatgcggctgcggcgtggagcgatggcgttggaggggatgcggcggcggcggcggcgacggcgttggcgtggatgggggcggcggcggttgagggggagcgaccgagtgggtatgcggcggcgtgaggcggataggggatcggcggtttcaggatgagagctttgttgggttgtggggttttggactatttgccactctcccggtggcgtgttttcaaatgccgctctcaaggttggcttcgctattttgtcatcggagagaagatttcttgatcgtgtgtcatttttgagcctgcaaagtattatttttgagcctgcaaagtgccacgtcacctgatccgagggcaaaataaccgtcttgcctatcttcttcctctagctcggggtctctctcctccaaccttcctccttgcgtgtgagctggtgacaccgccaccaccaccgccggaccgacctcctggcgctaggtggcgaatgacaaggtaggggaagcctcgaggttggacttgacacaaccgccgacatcggggagagtggaaaagagccgagaggagaaagaaggcgacgacggtgacgatgaagcaaggcaccggcgatgacacaaaagaaagagcaggggccgtggaggtaaggagcaagcaaaggagggagaagtgcgaggcggggagctcaccggagcccaataaccttggcgccctgggaaaggaaggggatgaaaaagaccggaggagaaatgaagaagaagggtaagatggttattttgtcattagatcgggtgacgtggcgccttgcgggctcaaaaatggcacacaagcaagaatcttctctccccgatggcaaaatagcgaattcattcgggagagtggcaaatagtccaaaaccccgagagctcgaggaaaagaaaagataggcgatcgaggcgttggatttcgcgatccaatagttcatattccatggggctgcttggatggggattcaagaccaccactacacttttttaagtagtagagatatatgttaaacaactgttaagagctaaacaataaattaaaatattgatatcactatacattataattgaaaaaaagtaagtacaatcctaccttagttttaggtaaaattcattcctttctctatgtttagccctagtctggttcgctatctcctacctcattcggcttgacctttatctctttggctcggctcacaagtggagcgtctagctagcactgtcagctgtctcctctcgttgcgctatagtagcgtcttcaacctctgaacgacagtcacgtaccttgtatgatgctagagctgatcctccccatcaaatatgccgaatctttctcgatctcccaaaattggttaagagcttttgatccactcaatttgctcttttcgtttcccaaaaatcagagagaatccacatgcaaatgtcacaacccaattccgcaaaactcgggataaaagcggcaaggaagctcgccgaccggccatcattagcagttagacggagattaaatccggcaaattaaagccgaattgaaagggaaaatcatggggaatgacaagggaggagtggggaatcgatttttgcaatcggttggaggatgaggaagcacacagggagacggatcgacgtggcaacgatgctagggtttggctgggagataagaatagatgtcggctggaggcgtgtgtcgaagtagaactagcaacggctgggctgagcctaagcatagctaggccaacggatagaggagagggagcaggccgaggcaaggagacaagtgaaaaaggacttttggccgaaggaggaaaggtccaaaaggagagagatggaggccatgagggagagagaaaagggagcgggaggaagaggccaaataagtcagctgagagacgacgacgtatgcaccaaaaaaagctaaggaagccttagattttttttttaatttggtatagatataatacgataatatgagtaaattgcgctcatggtgcgtgaagttgtgtgatgggtataaataggtacatcaactagcaaattgctcaattcgatacaataacttacctagtccgtgagaacttggggcaaaacggtcattgtaagcaaattgagctaatgtggcgcatattactattacacaaaatttagaccgacaaaatgtataattattatgcgctcgatatttttcagatttagattgaaaaaaagtgaaacaattgaaaaagcccaaccatggaaataaacttctaaaaacaagtttttggtgaaatggagtatttgagaatgaaaattaaaatgaatttttcaggagactatggcatggcagaaattttgttgctcctgaacatataagtgagcattatacagagttatacagatgataaaaaaaataaattcttgtcctgtacatgaaaatttctgcacaattaatttatttttttctttggattccaaataagatctctaaaacatagtaatacatgctatcagtttggaaccttacaataattttgtttgcatggataatttcggtgcgatttgtgatggactagtcaagttactttatcagaatgtgcaagttatagttgttgtagtacctattttgcacccaccacacaaatttatatactgcgagcacaatttactcttataatatatcactgtatttaactagataatctcacagcagtctcacccttctcctgtctgaactaacgccggatgtataccaactcaccaaagtgttgtttggtttgatgccaaaataaacagtatcaatctttggtaatatcgaattttagcattatcaatatttggtttggtagggtagaaatgtgtagagtgtatttggtttgtttttcctaatactggtaaagtgtactcggtcctaagttatttttagagttctccacatggctgaaaaattgacagaattaaataagataaatatgattggttgagatgaagaaataagtagagatactaaacagaagataattgtaattggttaagataagagagggagaaaaaaccaaattttaatataaatttaaatactaaatatttactatattacataataaaaggaagtatatcacattaattaacaatagagtaattaaaacttatactaaataaacttttttcctgtttttaaaaaagaaaaagaatctctccatacacacgcctgcccgttatatatgagcggcgcaagagactcatctctactattttaccatacaattcttttgcagtaacacttaaggtttcgtctagctacacacccaagtgctacctagaactcttcgccctgcgcgagagccccggaataaaagcccaggacgcagccgcccttttccacctgcgccacctcctcgcacgcccccgtcctcgggtcgtgcagccgcaccgccccctcgcaccccctcgcccacaccgccatcctcccgtcccccaccatcgccagcggctgcgccaccttctccctgcacaaccacctcacctcctcctccttcttcttcttcctcttcttgcttcgcccgccgcgcttcgcctccgctgccgccgccgggtggctcgtcggttcttcttcccacccgcggaggacgttcttgatcgggagcgagtgaagctttgtccatgtcgtggtgttcggcgttagggaccagaggttgatggtcctgccggggtagtcgtggtggacggcgacgaggcggccgccgagcgcggcgaggctgaggttggggcgctgcccgcggtggcgctggtcggcggggagcgggccgtccatcagcaccggcctccactgctccgtcgcgaggtcgaaccccgcgatggtgtcgcactcgacgccgcggtcgcgcggggcggaggtggtggccggggagaggaagtggaccaccccgccgacggtcgcgctgctccggctgatcccgtgctcgatcctcatcggcgggtggctccgcgtcgccctccactggcagccgccgccggcgccggtggtgatggtgaggacctcgcttgactgggacccgttggcggcggcgtagacgtggagcagcttgtgctcgccggtggcgggcaccttccccagcgtgtacccggaggagacgttcctccccgtcgccgccgagcagcccatcgagaggtcggtcaggtcgccggtggccacgtcgacgacgcggagcagcccgtcgccggggctcacgacgcagatcatgtcgccgccagcgcagaccctgaggcctggcctgctcagcccgtccatccgcctgacgacctcgccggagtacgcgtccatgagggtgatgtcggtgaggtcctcggcgatgtggtacaccgcgccgacgacgaacgcgtccccgccgccgccgccgccgcggtgagggcactgcatgtcccgccacgcgccgcaatacctctgcaacgcctcgtcgtcaacatgggccttctccgtcgtgcggtttctcggcggcgccgccattgatgacgccacagcgagctggtcgagacggcttatgaatctagttccggaggcgcactgattatgtagtacgagttatcgagggcaacggtggcgggcgcgcttaatatggcgcgagcgcttagttcgaatccgaatttaagcccgaacacaatttaatttggatccgatttatatgccgggacgcttagttcgaatccgaatttaagtccgaacacgatttaaattggatccgatttggagtgagatcaagactgacattggcacgttgtcgcgtgtaggaattgatttgagtgccttctgtagagcagagagtgaagagatgtactcctatatgagttttgtatatttcacgccagcacgttatttaattgagttcatactttttcttttgtttttttatgaaagattattggcttcaaatctttgcctaaaaaaattcggcttcatggactgtaggttttttttaagggaaagaccgtagggttctatatggtggaaatcacaaatatttcggggttactgatagaagcgaaattgtggacattacagaaatttcggttagaaaaaagttgaaatttgaacaaaattttgcttaattaaaaaaaattgaagagtggccaatcacttttggactgtacatatgctaattctgaatcttcagctcctggatccgttcttcctgctagcagaggagggctatctccccacaatcctaagttattaactagcattaacaaagtccaaaatttcagattgcatccaagcttctcaaacggccgtccctcaattggctttgtaaaaatgtctgaaaaacttgtccaaggaggagatgaggggtctgaactctgaacctgatgaacacctagtttcttgaggcaggtactgcacccaaacaatctcttcagagttcaaatcaccccccacaagcaccaggaaatcaaccattagatgatctgccatcatcagaacaacttgctcagtcggcgtccgaaaatgctctcacagaagtaaagagtggactgtgttttctgaattttaagcccagtgcaaaaccgtagcattcacattcagtatttcagatatcacaaaatccgtttgacagacaatcactaatggttgaattgaatgtgcttatgttgcattaattattgtaggctcttatctgactatctccaatgaaggcagtaaaaattcttgattcttttgtttgtgccaatagtttactctgcatgatttagattgagtgcaggctctaaagtctgaacttcagagcaattaagaacatagaactgtgccaacgggcggtaacctcatcaatgttcctcaagacaaaagacaaatcaagggacttcgaactttcgtcaacagctggatttgctcaattggtcaatttcttttggtgatattcatcctgaatctttcttatggctcttttcttcagtgtcagcttcaggccttcagcaattggcaatactgcaatagccaataggctgcaaacatcatttgttcagtgtcaccttcagcaatacgtatgtatagcttgagcagaactgcaaaattcaaaccaacctcacctcgaattttgaagctattttttttctaaataactttcatatcgaatcgcaaagataagatatttcatcaaactttccgaaaaatgggaaactcaccagatctttccgcgcgcgagcgcgaggctgatcccgcgaagccgccgcctttaaatagcctcctatccgttgctctcccatccccatcccctcctcgattcaaatcgtctcctctcttcccaaccaaaccctcctcccaaaccctagaaattccactcctctcccgcggatctcccatggcgtcggcggctggagatgggctccctccggggctcaagttcgagcccaaggacgacgagctcgtcgcccgcttcctcctcgcgcgcatccagggtaagcccctccctctccacggcgtcatcctcgacgctgatcccctctgcgcgccgccatggaggcttcttgcggatcatggcaggggcgatgaggcgttcttcttcgccgacgcgcgggccaagaatgggaaggggagccggcagaagcgcacggtcgagggcggagggtactggcaggggcagaggatgtgcgtcgatggtgagaggctggtcgtccccgatggcggcttggagatcgcgtggcgcaagtacgtcctcagctacttcgcggatggcgagaaggggagctcggggtgggtgatgcacgagtacgccatcacgacgccggctgacctcgcgtcgtcgacgatgcggctgtatcgcatccggttcagcggccacggcaagaagcgcaagagggaaccggaatctcagagcgcccaccacgacgacggtcgagcgcgctgcgccccacagatagccatgcccgagactgctctgctcgaggacagcgccccgccgccacagcccgttcttcctcctgctgcggtggtgaactctgtctctgatggcgccgttcctcctcctgcaccggtggtgaactgtgactctgacgtcaccgatgaggatgagttgcagagctttgtgcctgagttctccgcgcgcaacctgttcgtctctttgccacaaggaagccatgaagctgaagcggacgtagttggtggcgcattgccggcgcaatctatgtcgtcgtttgctgatgttggaggtccagagaacatggatgaccagagctgctccggcgtggtgtttgctaatctttccgacctgatcgtcttaccaccggtggaagccagtggcgcagcacccgcgccatcttgggcgtcatcgctggacaatcaaaacgacgaggcgcctgtgttctttgagtttccagagagcatggatgacattattggctgctttgacttcgccaccatggacgacccgagctgcactagcgccatatcagaggagccctttcttcctcctgcagcaatggtgaaccatgacgatggctatgcctctgacaacgccgatcaaggttgctccggcgccgttcctcttccttcagcagtggtggaccttcccaatgagactgacggcgccgatcaaagctgctccggcgtggtggacgattcatccatggtgtttgctaatattcacccgttggactctccagcagaaggtggccatgaagccgaagccggtgccgggggtggccgtgcagcaccagcgccgtcttgggtgtcatcgctggacaaccaaaacgacgaggcgccaatgttcttcgagcttccagagagcctggatgacatggttagctgctttgactttgccgccatggatggccagagctgcactagcgccgtgtcagagactgctctgatcgaggagctcgttcttcctcctgcagcaatggtgaaccatcacgatgactctgtctctgacatcgccgatcatggctgctccggcgccgctcctcctccttcagcagtggtggacctccccgatgactctgacggcgccgatcagagctgctccggcatggtggatgattcccttcccgggtactatgaggctgagctgaaggttccgcttgagtacgccgcgcgcaatccggtcgactctccctcaaaaggcggccatgaccatgaagccgaagtcgacgccagtggtggtgcagggtccatgatgtcatcgccggacaaggagaaggagcactcctcatcgggcgtcatggacgtggaggccactggttttggagttccagacagcatggatggcctgagctgcatcgacttcgccgagacgatggacgacctgagctgcatcgacttcaccattgatgatgagctgttcgatctatggagctagagatggattagcagtgacattgtcctttgtagaaataaagagattcttctgtatatgtagaagcagagatgtatttattagcaaagctgataatcattagctgttgataggttgaatcaaatgtgcttaagtagcactaattgtattatctgattatatctaatgaaagaagccaaattgttaattgattattcttttaattccaaaagtgtactatgaatgaactgtatttagttcagactgccaagtctgaacttcagaaaagttcagacatgagttaatcgattcttgatcatgtactgaaaatgtcaagtaattgtgaacacctaaatttgagtcacaaatcaatttaggaagctgatgtattaatctccagcagttaaagcataataggcaaacattatcgtcatcaagtaagttgcttcaagattgtcactccacatactaactctgccgtagcattgtattcagcctgtgtgattgatcgtgagacagcgtgagcaccaggagatatgaagttaggtacaaggcacagtacatttccattagttgatctggtgatgatcagaaaaatctgctctgtccgtgtttgaaaacgggctgaaaagagcttgactgcattctctgaattttgaactcagtgcaaagctgtgccttcagaagttcagagtactaacgcacatctgtaggagcttgtaaatactaacgcaccctgtcatcatcaagtattgtagcacaccagcaccagcagtagtctagtatagcttctgaaagtctgatgtctgaacatgacataaaagtggcaatctgtttggcaaatacctgtccggtgtggcagatcaatgagatacctcttttcatttatttgtgccagcatcagttcatcaccagatagcttatttgcttcaatgctcagaaaatacgacagcccacatatatccttgattgcaaactctgctgcaatttttctgaattcgtagaatatcagattgtccagatgagctagcaatacaaatccacatagtcaaggatataaatggtgacaatagattgatggaagatcaaagatacaagtatcagctttggatacactactgattcattaagaagaaatggatcattactgataaaatggctcatctgaaataagcaaggatttataggttaaaacaatagcctgctgctgacagacaatgttcagaacaagaagcagattgggaggcagtttctctgtgaaagtgaaacctattcctggagaggagcggttcttggtggtgagaattttagtacatgactattactcagctctttccctttctgttgacggatttgccaatgtttacattcacctatggatgtccattggacagctctgaaacgaatttcaaggtatctgaagtatcctgtggatattgggctgcatattagacagtcaagttcagggcttctacgacctgagctgcatcgacttcaccattgatgatgagctgttcgatctatggagctagagatggattagcagtgacattgtccttttgtagaaatagattcttctgtagatgtagaaatagagatgtataggagcttagtcctctaacggtcactgtatttattagcaggctaagatcattagttgttgataggttgaattgaatgtgcttaagtagcactaattattatctgattatctgcaataaaggcagtaaaattcttacttgattcttttttaattccaaaaatgaaccctgcacgagttggattgagttcagactctcaggtctgaagtttagaaaagttcaggcttgagttagttgatccttgttcatggactgtacatgtcaagtaattgcgaacacttgaatttcccaaaactcattttcattagcatccagtttaggcacagaagatgagcagagtacagttgtgtttg

SEQ ID NO: 69537 - DNA, 38072 bp, Oryza sativa
  unsure (1)..(38072): unsure at all n locations
ttactatgttgatatattcttgattaagacctgagctgtagtgtattttattttaaaagaactctagtgttatgtggatcctctgctttgagtgggtgaaccactgcacatgcaaccagcggtcttcatggacttttcccgttgtattacgcatgcaactgtgaacaaagacttgtacagttgtactttccattttagggtcaacgcttagtcctactgcctcattggaggcctttatcgcttgggtgtttgggccttttcaaggccgtgctatatgtagttcacaatacggccgttgtagaaatttagcccaacaaagttaaatagctcgtgtaggagtaagcactaagcagtaatcgcactgttttttaatataggatgccattggcattttaacatatgttaattaattattcatcttattttaaaaatatatgtaattattatttattttaatgtgaattgttttattgttaagagcataatctatatttctacaaatttatttttttatttgaaataatatgaacggccaaatgtatatgtccaatcttgaaaccggcaataataaaaggggtagcgcacgagacctaaaagtggatggatgcatagacaataatttagacaggtttatgccctctcgatgagagataataccgtacttctgtttggggattgtattcgttgggtgtgtatcgatctgacgatctagctgtggagttatgcccttggagggcttttgcccaccttatataggttggggacttgggggacatgattacaaagagagaacctggccggatacgacatcagtttccttaatctactttacaatattaccgaatcaaaactttaggttgttccataatacataagaaaacgcaatatctaagtcatggctcgttacatattccataaacataatctatcccctatatctggtcggataaagaagttgtgtgcgcatatggtactcataatctccatagtatatttagaagttaattgtgtcatatattagaaaaacacatgggaacattaagcagttacaatatatacagtttattcttctcaattggacacgaaccacaagtacacttgttggaggatgaccattttgggaatactttaaaaaccatatgtgatgaacaaaccgtgatagagggagtatattataattaaagaactacttatgttatgaatgaatattgacaaggaatttttcaaaagtaaaattgcttaattacgggtactgattactgacacaaatagacctttgacacggcaatgctagaactgatgaagtcatgaaggtatacgatctcacgccatatctgtctatcaacagtggttgttaggatcgttgcttatagggcacgatcggctatacttttgctccaacggtggtagcctgtggcctcctgtccagtgcggcgacggcggcggcggcagcgctatgttgcccgagccaccggcgccggaggcttgatcggcgtacgggcttgccatggccggtgaccatgacgccgacatgaccatcgtcacgaagaacatggccactgacaccttcctcatcgttggcatggcgattatgtatactgtaactcctgtactagctagatcgaagatactcgctcacagttgtgttatctgatctgctctgttttctccacaaaaattataattaactctgcagtgttttgagctgtgacacgaagaatggtcgatgttacgatcggttatttataggttgggagaagctcgtgagtcatgagacatggcctgatgccaaggccaaaccctgaaagttcttggctttttacgtgtgtgactgtctgtctgactgatcaactaattaatttgacgagtttgtgaatgaaattgcaaagcagctacgaggttttcttggtctacaagcatgcaactttgcaaagttatatcgagtgaggtctgtcggtcgatcggtcagtgcatgctttcttacgaacttgcaaaaccaagactgtaataactctcttcttcagatgtagctttctgccactgatctctctttttgccgtaagtagtctgactgtccggatagaccaggccagctagcatgaatggaagacgaactgaaagtgtccggaattcgtactgggcacatcgttccaacttcgacgtgaattgctgaaaggaatggcaagattgcgaggctagtgcttaattaagagcgattgccttgtgaacacgccatcagctgtattagagttcatgtagtgttcttcatattcaaaaagaagaaactccctataacagagcttgaagcactactagttctacttaaccggcaatttcgtgttcttaactagagcagtgatttttcatgcatcccaaaatgcagttcgatatgataagagattaagagctcgaaatgctagtgtttcgagcagttttaccagttcttagatgtaccaaaagataccactatttcacaaaactgtatacacctctacaaaactatatatgtatcgtgaaattaaactatatactaaaccataatattgtaaattcgcttaattagcacaatttctatactccttttaaaagagaacaatggtggtcaccaagtatatagtatttctttaatttatcatctactccggccatcatgttttctatcaattccccatgcatgtgctttaatgttataaaatgatctctctgcatgtatgattctatcatattcacctgtacaatatgacatttataggtacaaaattattcaaaaaacctcactaataatttgttttaatccgtaacaaagcacggttattcggcttttatcatataacaacataagcaatcgtatcgttcataataacatatagtaaaactacatatttatttaagatgttaattagttcaataaccaatcttgatcagggtacattacaatagttaatcaagtagtcatcacaggttagtggactaaatttcttgttattaaacacaacaattctgataggttgataaccacttaggttgttttctttttctaagttccaaacttcctctccttcatttttcgcacgcacagtacgctttccgaacagctaaacgatatgtttttttttaaaaaaatctacaggaatgttacttttaaaaaaacatgttaatctatttttaagttttttaactaatacataattaattatgcactaatctgtcctcttgttttgcgcgttgggaggtgtgggtttggtcataccttcgaacacaaccttaatacataatgatggccaaacattagtatggttagtggacagaatttcagattttctagacacccttatgaaatactaatatgtaatcctttaataaaattggtactaaatctagagttttacaagacatcaaaatataattgttgtcatggttatgataccacatacctaatagtagttgactaaatctcggcaggatccaccacatacaatgtcttatacggaaactgacttcggatatggagagagttccgataaggaaagacaaccagagttctacatggaaacgacaagaactactcggattgtatccatattggtttccctagttctacttggacaaggggacacctatgggtataaatacagggccccctaggaggagaggagagaacaaccatccacgatgagaagatcaacacccaccagaagccacaacatacaagcctacatacgccaagacaagccgccggatatcgacatcagagatacgcttggatcgaccctatccggtaccttcagaggccggccgtagggatctagcactgtctctgattccgtcgggcgcgagctcgaggaggaaggctaccctgttgtcgactacgagtcagaccttcagaccgccatgtcgacagcagttagataggctaccccacatattgtactggtgtgattatggtgaataaaaagcaacatcggctccagccaacaggatgtagggctattacctgacagctcaggggctcgaacctgtataaaaatcctcgtctccatctcttttatctcagtctcgcgtatatcctagcaccaacgatccccatactgtccaaataccgtagtcgagacatcaaacgtcgacagtggcgcgccaggtaggggggttttggtgctctatattttgacgagatgggttcaaaggatggattctccaacaacaagctactcgatgacttcggctgtaaggagatctaacccgactgaagtacatcttccgaccagatcggaaccatcaacgtcaacaattttgatctgttgagataatccaaccttcaaagatgacgccaccgctgcggagggcatctgtacggtatttccgaccattgacgatcttgaggatgatgccggaagggtacaagacgccgacacctctagagaccgaaaccgactactacactcatcgggtttaagtgcggttttggttagactcggagtaacaagccggatataccattgcccgacatcgccacgtactgatcgcttctgacatgtgcacatgcatatgcacagactcaatacgtgcccaggcatgcattggtttgccatcatatacatgcaccgaagacaattcaatggctactaaggctagttaaggtaattagtagattaattaatttaatcaatctactaattccgtagatatatccggcatatatctacacaggtacgcaatattttatatgcaatttatcgtacctatccagatcatgcagtattgtcagatcaataatttattatgtttacctagagcatgttttttatacaatgtccgttgtgcgagtacttccgacgataggccaactacggtctaacgctgggggctcgctctattttcttctgtataaatcatgcttgtttacggtttacataatgcctgatatttaatctgctcgttatatcctgataatactagaagatccatgcagttttttgagtacatactcgatattatctgctatatatcttgccttctagaaaatatttttcaggaataattgagcacttgagtaggttatggtcgagtacactccattatcgagaacattctcgacaaatgcggagttatcgcacccaacctaccaacaaagaccgacgacctatctcatagcaccggccatggctggactactcgagaaaaggttgttaacggataattcctcgcgaacgccgtcggcttgatcacccgacatgattgcgaacggacatccggatatgctataagttgggtacgtgagtcatgctggccacatgaaatacacttgcaataaaccaccagtacgcagcaatctctcacaccgcaacttccgttggtgttcgagagataattccgcttgctcactagttctcgcaccagtacgcagcaatctctcacaccgcaacttctattggtgttcgagagataattccgctcgctcactggttctcgcaccagtacgcagcaatctctcgcaccttaacttcagatggtcaaggtacgtctacggcagcgtagcggtcctcgtaccacgactacaaatgatcgagggacactattcaccggttctcaatcagttgatcgtagtgatctctcgtacatttgcttcaagtggtcgagttacgactactgcctggtcctcgaccagcgatgtagcgtctctcccaccacttccactttcagtggtcgagttacgactactgcctggtcctcgaccagcgatgtagcgtttctccagctacttccactttcagtggtcgagttacgactactgcctagttctcgaccagcaatgtagcgtctctccggctacttccactttaagtggtcgagttacgactaccgcctgattctcgaccagcgatgtagcgtctctccggctacttccactttaagtggtcgagttacgactactgcctggttctcgaccagcagtgtagcatttctccccctatttccacttcaagtggtcgagttacgactactccctggttcttgaccagcagtgtagcgtttctcccactattttcacttcaagtggtcgagttacgactactccctggtcctcgaccagcgatgtagcgtttctcccactatttccacttctagtggtcgagttacgactactgcctggtcctcgaccagcggtgtagcgatttctcccactacctctacttcaacaaagttggtagcaggtacacaatatcgccaagtgttttacctagagatcccttaccacgatgacacctagcgttgaaacctatcctactgtccctttacgccgtcctgacaaggcctccgaggaacctaagggatcttcggctggggacgcccagagccgataaggccttgtcggatcctgtagagacgaaataccatgtaagatctggtcgtgtaagagttcttgccatgcgtattaaccaagccgtgtaatcggaaattaactttccaacttcacggctggggctaggatcagtgcttattcaaccaaggcagattaagggtccaagagccttatcctctgagaacgattctccgacgacaaggctgggggctagggagagtgtatgactctacaaactaactgatcgaagtcggtaagacgctcatacacaaaacattggtcggtaaatttaattcattttcaatttaccatacatattataacatgtcaccctttgagcattcgctcgggggctctttctatttgatatacttttctgagtattgattttaggaaaattctattcgacatttacgaagactccatgtctctatggttctacaccaagatcgactaaaggcgagtacgacaaatgttgacaaagctccgtcgcagactctatgccttctcgatcactcgagaatggttgctggatctcgacaaggaatacggaatgaaaagatagtgtaccctccgagatagaatttcttgacttcaatacaaattctcgattacggcaagacggaagacttagtcgtacgctatgtacttccttggttgacatcggagattgactcagacaaaccctttaggtgcccgcatgaggctgacaaaggaagtctaacgttatctctaaactcaccgagaacggtcacatgagctcgataacagttactccaaggtctgcgtgcggttgagaatatgaattcgttcatttgcattgaagtcggggggctactgtcatggttatggataccacatacctaatagtagttgactaaatctcggcaggatccaccacataccatgtcttatacggaaactgacttcagatatggagggagttccaataaggaaagacaaccagagttctacatggaaacgacaaggactactcggattgtatccatattggtttccctagttctacttggacaaggggacacctatgggtataaatacagggcccctaggaggagaggagagaacaaccacccacgatgagaagatcaacacccaccagaagccacaacatacaagcctacatacgccaagacaagccgccagatatcgacatcagagatacgcctggatcaaccctatccggtaccttcagaggccggttgtagggatctagcactgtctctgattccgtcaggcgcgagctcgaggaggaaggctaccctgttgtcgactacgagttagaccttcagaccgccatgtcgacaacagttagataggctaccccatatattgtactggtgtgattatggtgaataaaaagcaacatcggctccggccaacaggatgtagggctattacctgacagctcaggggcccgaacctgtataaaaatcctcgtctccatctcttttatctcagtctcacgtatatcctagcaccaacgatccgcatactgtccaaataccgtagtcgagacatcaaacgtcgacaattgtgtgttaaattctttgcaaatttttattctgtatgatattgtgaattaaatatggactccctccatatcaaaatatacataactacctctaactaaaaaatatcttgaaatatggctacttcgcagatgagtgcttgcccagttggtatattgtaagctgttaagcaagctagtacttgtacattgagaataaaagttaccaccaaagacttccactttacattatcatttctgaggtgaaaaatggtccttgtcgatttgccaatggccgagtgaatactgtaaaaactgacgacttttaatagaggtggcactggcagtagaagtaaatttactacgtttcatttttactatgtgtttatgtctgatcttgtgaagctatgatgttgatcgattgtggcacaattgatccatttttgggggcgacatgagtaatatgcagtggtcagtgaacttgtcgcacatacgcatgctagttttatccattttttagtcagaattaggtctcgttagtttcgtggcacatttttcaaactgctaaacggtgtgtttcgtatgaaaactttctatatgaaagttgctctaaaatatcatattaatctattttcaagtttataataattaaaactcaattaataccgccttgttttgcataaaaaaactttatcttcatctctatcttcatcttcatcttcatcttcagttacattttaggatgggggaatactcacactagcaattatctggttgagttatcttacaaccttcgtggaaatctacgtggctgattggctacagattagcacttgttttgtgcaaggggaaatttatagccccatcggtcagcctaataagccaaagtaaaagtcaaaattagaattttcgaacttgattttaaagtttattttaagatattttcaacttaatttctttttagtattgacttttagatcgctacgaacaaatatataaaagttttatctataaattaatttttattttctaataaactattttggcttattagaggatatgggcaaccaataagactcttaaatcgtatgatgctgagtaagctagtgtaaataggctagtagtactagactagctacgcataatggatattagatggtttcatcaggaatggaagagtttggcgagaagatgaaatcaaaatccaattcttgtttaagatctgaactccggtctgctttgaataccctttagctacccctaaatattcaccatcaatactgctttcctattaatgagaggtattttgtttttttttctctactatctaaagctaaatattaagttatattggaaagtagggagtagattccccagctgtacaataggcatgtatgatattccactcatgttttaggcatgcaaacaagcaagcctccgcataaaacccacttagttatttatttcttttatggtagtatagtttttagaagaaaaaataaattagaagtacgattcactttattcgtcttattcgtcttgcttgcatcccgacgcctgttcttgtaccccacttatgaggtcagcaagttgatgaaacctttgtttggtgtaacaagctagctcagtcaaagttttttgttcaagtcgaagtcaaccggccagttcgtttgatacacattctcagagatagacgcctcagctcgcaaaatagagacgggaagaacagagtaatgatgcaatctgcttgactctcgggtgttccataggtgagatatttctgaccatcgatgcaatttatgtagacatttctgtggacatgcatggctgcttttccatcggtacctagtccatcaattccctttatatacatatacagtacaggtccatggaattggacgatacatacgtacatacagtacttgcaaggtttgtgagagcaaataatccatacatttctgattcaacacgaaataaaataatattatattaagtaaggacaaagaaaactagtggaggagccacgcacaaactatgggtttggctgaccccacaatttttgtactatcaccctttgtgtgtcttgatttttttttcatttaaatctattaagttttgcacaaataaccccactacaataccaaacaataaaaattgttttcacggggtaaaattactggcttcgccacttacgacaaccagaccatacaatttggtatctaccatgttagttgtggcaatctggcggcggtttattattttggtcattgctgcggcacgagggacctggttgtgaaagctgttgcagatacagattttggaggaactgtatgagaggatgatcgccggaggtggccatgccaacccatttgtcgcctcccatcggccgcgctgatcctgacacggccgacagcagaagcaccaccatcatcagtggcaaaacaaacctcttcgccacggccataatacgagctcttcctactctctcgatctgtgtctaacacaagctttaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagagactaaagttaagtcgctgatgtaaacaccaccttcaacttgcacactcttctctcgctcgcagctagctagtttgtcctctcctgtacgcgtctcttgcagctcactgtctcaggcaagtcacaagcgagttcagttaactcgttagctagctagctaccgctgcgagctctctgcacaagacgatgtcgagtgtggttgatttgcatgcatatatatagcctactgcttcgtgggaaccccgtgttggctccgctattacgtgcgtgactcgtttgctgagtaaaactgaaaaaactgggcacgcccggactccgattctacggtctctacaagggaaaaattcacgcggccttagccgtgcatgagccgtgtgtaacatatacaccaacacacatcgatcacggccactagcaaattactccctccgtattttaatgtgtgacgccgttaactttttaacaacatttgaccatttgttttatttaaaatttttgtgaaattataaaaatatttgtgttatgcttaaagaatatttgatgataaatcaagtcacaataaaataaatgataattacataaattttttaaataagacgaatggtcaaacattggttaaaaagtcaatgacgtcatacattaaaatacggaggtagtaaatctgtagtgaaatttgcatgagtacaagagaagctagctagctttgtctacgtaaaaattccatgcttgtgctcagctctattccctccatctcataaaaaatccaatcatatatttaaatctggaagattcaaacccagaattgagtttttttatggatggaaggagtacgtgcgtgactcgatagtagacggtgtaccgtgtgcttctcactgcacttataagagaggggacaactttttcgattggaggaatatgctttcaaattagagaaaatctacacaacagtatcccgtcacaacgggataaggtctcatcaaccttatctccttcgatcccttcctctccacaatctctctctctagctcactcaggagtcaggagaagtccaagagcatggagatgaagccagctaggaggaaggggtcgtcgtcgtcgtctccggcggccgaggtggacgacgatggcacggcgtcggtgaggtcggggcggcatcgagggtgatctcgtcgcgcctcctcgacgccgtcctccgcccgctgcggcgccgcttcttctactggcgctccccgttgctgccggcgccgaggcctctcctctcctccctcgcactcctcgccaaggtctccatcgccctcacgatccactagcgccatcgtccttgcccgctgctcccgccgcgtccttgccggtgagtgcaaatggctcctcctccgccaccgcagaagaagaagaagccggtggtctcgatgcctctgtcaccgcaacgccggcgacaacctgctctagaacctctacctcctctctttcgccatcaacttcaagatgaagttgctgaagcgcatgttcctggagatggtcgtcgccgacttccggccggacctcaccatcttatgcgtccgtgccacggccttctctattaggtattaatcgcgatacctcagtatcaagcctggtacccgcctggtacccaggtacccacaagtatcaggcctggtacccaggtacccacaagtatcaggccatacataagatggttacgttgactttttaacatatatttaatttttttttgaaaaatgtaattagaagtattatttatattgttgtgacttattttaatgctagggtacttaagcatgacctatatttttacatatttaaataaaatttttaaatgataggaatggtcataggtacattggtacatatccccatgccatatattaaaaaaacaaaaggccagtattaaacagttacagtatacgcactttattcatcgtaattggccacgaaaatcacgagtacataatctactactaaaatatattaaagaactacttacgttatgaatgaacaccgaaaaataaaattaattatgggtactgacacaaatagaccctgacacggtcaatgctagaactgattaaggtaacgatctgtctatcaacaattcaacagtgggtattacttattaggatcgttggtataatggcacggtgggcgccattgcttttgctccaacggcagtagcttgtaacctctccaatgcgtcggtggcggcaacgcggtgttggcggagccaccggcggagggttgctcggcatacggcctcgccgtggccggcgaccatgaggccgacatggccatcaccacgaagaacatggccactgcaaccttcctcatcgttggcgtacgtggcgctgcttttttagaaaaaaaaaagagaactctgcagtgttttgagctgtgacacgatgatgaaatgctcgatattacgatcagttagttataagctgggagaagctcgtaagtcgtaacatggcataatgccaagaccaaaccctgaaagttcatggttttttacgtgcatgtgtgattgtctgactgatcaactaatttgacgggtttgtgaatgaaattgcaaaagcaggtacacggttttcttggttacatgcaacgactttgcaaagttatacggagtgaggtcggtctcggtcggtgcattcgttacgagcttgcaaaccaagactgcaataactctcttcttgagatgtagctttctgccactgatctctcttttcgccgtaaccagtatgactgtccggatagaccagcatgcatggaagacgaactgaaagtgtccggaatacgttcttgatgcaatgttccaagtgaacttgttgaaaggaatggcaatatttcaagactagcttttttttttctttagataatggattaaaaatccggttattcacacggatcgatgtacacagccaaagatttgcaaagctaactagtgtttaagatcgattgccttatgaacacgccacgtacagtgatgaaggttgatgtaacattcttcgtattcagggaaaaatgaactcaacaaaaggagaaagtaccgagagtgtatatttgtgttttataaattcaattttttggttaacataatgtaataatctaattgctgaatttttttaccgctaccaaaatttaaatttttgaaacttaattttaagagtaattttacggttcttaaggaggtatcatgaggtaccaaaaatttagtggtacctaggtaccaagaggtgccaaatatataatagaaaaagtggaaccttagagtatcttctcaagtaatataaaattgctctaattttaaagttgattatattttttttctcatcttggtatattttctagaattgggttttaaatcacaaataatgcatacataaaaattatatccataaatcatttctgattttttttgtttattttgtatggcttgtgagctgtaactcaaccaaccagagccgtgcgatcggccacatgtagcttccttgaaaagaaaaaaaatgaagaagttgtagcttctgccccacttatgaggtcagcaagttgatgaaacttttgtgcgtagctagctcagtcaaagttttctgttcaagtcaaagtcattccatttgatacacattaagagatagagacatcgcaaaatagagacaaaaagagaagagatagagacttcattagaggagccataatgctcgatcttgctcctagcgaggatcctttgatgttccatatgtggtattttattttttaaaaaagagtatgtggtatttattcttaccgtctaaacattatatctcgagggctgctatacaacggaatcccgttttcgaacgggatgataccgattaggtatcaggtcccgatacctctgaggtatcatgtcctgaaacataaccggtatcaagtgatacctatcaagtattagacgattcatactacgtatctggtgatactcataaggtatcatgtggtacctatcaggtatcagatgatttctaccacgcatcgggtgatacttgtgaggtattagatgatacctaccagatatcaggtgattcctactaggtatcaagagctgagcatcgaggcgtcgtcgtcggtggccccaccctctacaccccatgtcgaaggtcgtcgccggtggccatgttctctgtcgtccacgcctcacgtcggaggtcgtcgccggcggccgcgttctccgtcgttcacgccctatgtcggaggtcgtcaccggcagcctcgtccttcactgccacgccccacactagacttgttgctggcggtcgcggcctccgccgccacgccccacaccacgtccttcgctatccatgctctgcaccacgccggagcttgtcccggaggctgcatcctccgtcgtccatagccatgccacgccgggaactcgtcaccggtgaccgcgtcctccaccatccacaccccatgccacaccggagcttgtgcagcaatatgcatgctttgagagagatgtggtagaatggataaggtagaaggagatagaatcggtggattagttggttgctgccctatcatgtctatcacgattgggacgggatcccgtcagatactcagatagcatttctgttatatctctactggtctactgcgtgggatatatattcagactagcttccagtttcacccatatatatcaaatccattatatatctcacataacactggatggattcatcgaattaattggacaacatttacattaacacttgggcaaggtagtacgaagaacagaagttacaaacaaaaaactgccattttattaattcatatacttgcagtttatcacaatctaacaagaaacagagcaatccaaaaagactaaattgcattttttttcaaagatcatatacagtacattgtcttttcttgaaagatcttatatatatacactacattgtctcctatagagaaatatcacaaccaaactttagaatttggtgttagcatgcaagtgatggcaatatatatacatggtgggatatttaatttggcgtctaccctgttttttagtggtggttggccgaggcagtacatgatgggttatttgggtcattggtttggcacgagtgacctggacctgctagctgctgcaggtacagatgtttgaggaactgtatgacagatgatcgccggaggtggccactccaacccgtttgtcgccgcccaactgccgcgccgatcctgacacgaccaacaccagaagcaccgccatcattagtggcaaaacaaacctcttcaccaaggccattatatgagctcttcctctctctgtgtgtgtgtctaacacaagttctacgattgcacactggtgtttctctcgctcagagcttgcacaagtatctacttccttgcagctcactgcttagttaagccaaaggcgagttcagagctaactcgttagctaatagctacctgcgagctctctgcacaagacgaggtgtcgagtgtggtcgatctgcatgcatattatatagcctcccctgcttcgtgggaactccgtgttggctccgctattacgtgcgtgactcgtttggtgtgggttaaactgaaaaaacccggcacgggccggactccgattctacggtctttcacaagggaaaactcacgcggccttcaccgtgcatgggccgtgtaacagatacaccacaccaacacatcgatcacggctactgctagctagctagcaaagcttgtgtatgtagtatgtgaaaaattccatgctcatgctcagctcaagttacgtgcgtgactcgacagaagacggtgtgcattgaattagccgtgtgcttctcactacgtactactacgcggcgggtttcccattattccacggtcgtcgctccgaaaggaaagagaaaacgactggtttgtcgcgcgccgacgtgaccaattaaccaaaccggtgccggtgccctgtgccgtgggtcgtaaatcgtaatgcgcatgtcaacctgtggccgtacgtggtgcgtgcatggcgtgtgcgcgcggcgtcagcgacccgcgcgccagcagccgcgcgccggccactgcacgcaccggcgtacgtacgtaagctagctttgctctcttcccacttgctttcgctttgaggtaggcatgtgcacagcagcacagcggatgtttggcgcaaagctagctagcctctccttggttggtcgggaactcgccgacacgctttcccgtctgcgcgcgagagagagagaggtcgatccaccgagtccgaatcaaccccaccatctgatcgatctcccgtgcgaatcgtgcgtgcgccgcggagacgcggactcaagtaggctaacacccgagagatcgaacagaacggccgggtcatgcgtgcccctgcgcgtttcgttcaccttcaccacgagtcttgtcacgaaacagcacgcaacgacgccggccgcgggcggtcaacatgcattctacagtactcctacgttgtttgcgttgcaggttgagaaattaacggagaaagcaagctgcgcaggttcatgctcttcggccttaatttggatctctcctccttgatcagtaaacaatgtgctatttcttcatcaggtcgtcttttatcgacgatcgataggttcagatagagaccagtgtacttgggcaaagtggggagggggacagaaagaaggaaaagacagagatcctgggtgttggcacgagggtgcttttcggtttcatttgacttgcagctctgctccgtttctggtcaggcattgcgctctactccatccgtctaaaaaaaatcaaatcatagatttacgtgtcaatgtttgactgtccgttttatatgaaatttttttataattagtattttcattattgttagatgataaaacatgattaatactttatgcgtgacttatatttttaatttttttcataattttttcaaataagacggatggtcaaacgttggacacggaaaccagcgtttgtcttttttttttttttgggacggagggagtacgactttacggcagcatctcatggtcttaaattttgtaatttcctttttttagtacaaatcaaaatgctcatagcgtcggtcagatgtgctagctgccagcacgaggaagccgaatagtatttacctaggactgaatttatcttttttttaatcaggcaattttcattacccagcttgaaaaccaagccaaacacaaacaggaacagagtcaaatgaatttatcttttttcgccgggccagtagcgaagaagtgcccctgcggattttattatatatttgaccctcggtggaaactagcaaaactgaagagaatttctgttcgatcccatcaatagaagtgaaaaatatcaaaatgatactacctccatattttaatgtatgacgccgttgactttttgtctaacgattgaccattcgtcttattcaaaaatttatgtaattatcatttattttaatgtgacttgatttatcatcaaatgttctttaagcatgacataaatatttttatatttacataaaatttttttaataaaatgaatggtcaaacgttgttcgaaaagtcaacggcgtcatacattaaaatacagagggagtatatatgaagtacagaagtaggcaaggtgtatgcaaacaaaacggtattaatcactgtctttttctattttatataagcttttctatacacagctgcagggttatccactgaaatttctacaccacaaagatcgtttcaacaagaaaatttcaatccctatcgaaacaacaacacgatataatctacttagccggaaaaaatcaccggggaaaaataatatctctagtttacaaccgaataaatctacaaattgaactgttgtatatattagcaaaaagaaaaaaaaagaattgctgtatatatgtctgtgtcacaaattagctagctagcttccaagccatcttcaccatcgatcctatcagcatccgccgttagggctgtaggtcttgcaggagtgacctggaccagcaagcttgtgcagatacagctgccggagaaacctgacgacgacggagtcgtcgccggcggtgtcttctccggcccattcctgtcccgccaatggccgcgccgccgccgtgccagacacgaccaagaacaccatcaccatcacgatcagtgacagaacaagcttcctgatcaacacggccatgatcttttacttccctttcgccgttcttctccctgatctccttctgtcttttctactcactttcactaagaaaaaagctaagaaactttactgaactttactatgttcttctcaaaattctgatatgttcatcactgaattggagcaagactatagagtggcaggcggcggttgcttgctcggtacgatggccacttgaatcggcgttagtatttggaattaatttaagggatttttttttgcggggaattaatttaagggattgacgccgtcagtgggaaatttagactgaaaatgaagaactaggaaccaagtctaagctcctgaattttcaacacatcagatgcaatattgcaatgtctaatgttaggctgctggtacgtactggggaaatctgaaattcgcgctaccgcgttttcccctggcacgcgtaacagaaacctagcaaagattcctcagtcaaggaaacattttaatttggccaatttgccgtgatctcgctgcctgaacaggaagaaggatgtaatgcagaaataagtccattacgtgttctgaatgcgttgctgtaagggagggggtggcggtggtgcggtgccggagccagaggagggagtggcagcggaccggcgttggccgaagctagggaggaagggtcgctggggcggcagtggtcgtcggcatcgatgtcggggtatgtatagtgtgatacttggcaggtatcgcacgatacctttatcacctgatacattgcaagtatcacctagtaggtatcgcgtgatacctgataggtatcacctgatacctcgtaagtgtcatcttctatgtggcaagaatcgcatgatacctgatatgtatcacacctgatacttcgcaggtaccacctatcacctgaaacgtggtagaatcacttgatacctgataggtatcacccgataccggacctgatacctaactggtgtcatcccgttcgaaaacgggattccgttatatagtagccctcatatttaaaccggcacatttatagggataaaagtgctcctttttcaattttttttagaaaggaactttgggatgagctagcggagccgaacacatgagcatgtggtcttttagttctcggccttttctcctcctcctcctctcctctctcttgtgttttctcaattcgtcctctccccaaattaattgagcggcgcccctctctcccctccaacaacgatggcagcctcttcgatccgcgcctctccatccaacggaaacagtgacctactccccttggcccgttgttgacgcgaaaaacatgaaggcctggaagatctacttaggttcagtgcaggtcatagatcttgatgaggtgcaggcatgcaagttagtttaattctacaactaacaagatgtcaatgtagcagtaattagccgataggttgaacaattggctgctggagaattggatcgattggaagtctgatacaaatagacttaaatagttggataaacaatgaagtgtttgctacattcggttaaaaccaacttgtatataatccttataagccgatacaacacttaaacaatatatatccagataacgcattggttgaaacccccgatgatataattattgatgcctacttacttaaataaatctaatttacaaccacaacccccataggtcgaaaccaaccgatgcagcataaggttgataattgcctgatagatttaaacaagctaatatgacagtgatcaaaatggttatgtattgaatttaaccaagccaggaaaaccatcaaagagaaatttaacacattggataaggtcggctaaccctccgacgaacctatcaacttaacatgactttgattatcaatattaatctagaagatcgaacctaactgagagttcaagattgtgtttaatatctgatcccaatgagttgataaatctgtctaatgtgatggatatatataacaaatcgatctagagtaacattatgtttaaagaaacatcaacttgatcagaatatcggacctgaccgaggaagtcctaactaagtcaatataactataaacaataatggaactaaaaatagatatgatatacctgataggcaacacttgcatcagctcgattggaatatcatactcaactgaggaagtcctagccacaccagcataagcgaagatgactaaactcacttcttgccagaggtcaaactcaatcgatgcagcccatgagccaaaactagaactcatcaagataaaatctcatgggatggtggcgatgtgccgaaatttaatatattgatatgtggagatagattatagggacaccgggtgtacatatttatacccataggtcgataagagtcctaattggacacgactcaaactttataatgataaaagaaaaaatacaagtcttgatcggataataaacacactttcctaaaactaaaaaggaaaccaactgactctatctaattaatagataaattgtcatatcgcatcattcttgaactcgacctcttctggataaactttttttaattgattaatttccttaaccgaatccatcaagaatctaactgttggtgaataatagttagcatcggtctattctaggactctgaaaccgatactacctctaggccgatgacaactttgaagtataccaaacacccgtccaacaacgatggcggtgcaccaacaccacttacgagttacgacttggagatcgtcggatctatcaatgcctcggtctccaatgagcaacggcagtgatggtttttgttaaaatttttattcagtttttgtatgtgttcttggatcgaagcatcgactcgatttgaaccgatgtgagcagtttttttttattactagagcctcaaaggtgccggtttgttcgtatcacctgaggggtgccggctagaaaatccggcacctatgagggtttttcaaccgataccattgacgttttcttgtggcaatgtatcttgcacgattgcaccgaccaattccgttttacgtatcattcgtccatcatcgaatggacgataccacatacagtacttgcaggattgtgagaacaaaagtttacaaacaaagactggcactttattaattcatacatttgtgactaattgcaattgaacaagaagtaaactatattgcattcatctctacccttctaggaagtacacggcgagaaataccataaaccagactatagagtttgccaatttggtgcctaacatgttagtgggggtgggaagggcaacctggtggcggtggaatatttgggtcattgctcgtgcacgagggccttgatggtagctgctgcaggtacagctgtttgaggaactgtatgagaggatgatcgccggaggtggccgctccaacccatttgtcgccgcccagcggccgcgccgatcccgacacgaccaacagcataagcaccgccatcatcagcggcaaaacaaacctcttcatcatggccatactatgagctcgatcggacttgcgcgcgcgctggtgtttctctcgctcagagcttctctcctctcctgtacgtgcagtgtgtctgctctcttgcagctcactgtcccgggcaagtcacgactcacaactcacaagcgcgagttcagtgtctgatctgtgcgagctctgtgcatgcacaagatgatgtcttttttttttaaactaactgcacaagacgatgtcgagttggtcgatttgcatgcatatatatagcccccctgcttcgtgggaactccgtgttggctccgctattacgtgcgtgactcgtcggtgagctaaactgaaaaaaactcggcacgggctgaactccgattctacggtcttcagaagggaaaattcacgcggccttcgcgtgcatgggccgtgtacagatacacccacacacatcgatcacggccactagcaaaactgtagtgaaatctgcatgggcacaagagaagcttacctttatttgcctatgtaaaaattccatgctcatgctcagctcgagttacgtgcgtgactcgacagaagacgctgtgccgtgcgcttctccctactacatacgccgatacgcgggttccaattccacggtcatcgcttcggaaggaaaaaattgcagggtgcggagctaaagaaaacgaccggtttgtcgcgcgccgaggtgaccaacgcgcgcgccggtgccctgtgccgcgggtcgtaaatcgtaatgcgcatgtcaacctgttacgtaggtgacactgggacccggggcctggtgtgcgtgcatggcgtgtgcgcgcggcgtcagcgacccggccgcgcgccgccggcaactgcacgcaccggcgtacgtataagctcggcttacatagctcttgcttttgctttgagctagaggtaggcatgcagagagatgtgtttggcgcaaagctagcaaagcgagattgaccgagttgcctctcgttggtcggcaactccccgacacgcgctcccgtctgccggtctgcgcgcgcgagagaggtcgatccaccgtgttcgaatcaacatgtgatcgatcttcccgtgcgaatcgtgcgcgcgcgccgcggagttcgtagcctaacatccgagagatcgaacggccggtcacatgcgtgtctacgcgtttcattctcgccacgagtcgcgtcatgaaacaggcacgccgcaacgccgccggcgcgggcggtcaacatgcatgctacagtacgcttctgtttgtagattgagaaattaacggagaaatcagtaagggttcatgctctttgggccacttcttcttttcggtaaacaatgtgctattttcttcaggaatcaggtattctttattttatcagcgatcgatcgataggttcagatagagcagtgtacttgggcaaagtgggacagaaagaaggaaaagaagacagatcctggatgttggcacgagggagcttttcggtttcatttgacttgcagctctgctccgtgaaatatgcagtttctggtcaggcattgcggtctacgactttacggcagcatctcatggtcttaaactttgcattttctttttttctttagtacaaatcaaaacgttcatagcgtcggtcagatgtgctatatagttgccaacacgaggaagccgcatagtatttaccgaggactgaattaatcttttttcgccgggccagtagcgaagaattgcctctgcggattttattatctatgactgaattttaccctcggttgtaagttcaagccaaggaactagcaaaactcaagagaatttctgttcgatcccatcattagaagtgaaaaatatcgaaaggatcgaacagaaattcttcattagaagtaggcaaggtgtatgcaaacaaaacggtattaatcaatgtctttttctatttgatataagcttttctatacacagctgcagggttatccactgaaatttctacaccacaagatcgtttcaacaagaaaatttcaatccctatcgaaacaacaacacgttataatctacttagccggaaaaaaaatcaccggggaaaaataatatctctagtttacaagcgaaataaatctacaaattgaactgttgtatatattagcaaaaagaaaaaaagaattgctgtatatatgtctgtgttacaaattagctactagctagcttccaagccatcttcaccaaatcaccatcgatccnnnnnnnnnnnnnnnnnnnngctgtaggtcttgcaggagtgacctggaccagcaagcttgtgcagatacagctgccggagaaacctgacgacgacggagtcgtcgccggcggtgtcttctccggtccattcctgtcccaccaatggccgcgccgccgcggtgccagacacgaccaagaacaccatcaccatcacgatcagtgacagaacaagcttcctgatcaacacggccatgatcttttacttccctttcgccgctcttctccctgatctccttctgtcttttctactcgctttcactaagaaaaaagctaagaaactttactgaactttacaatgttcttctcaaaattctgatatgttcatcactgaattggagcaagcctatatatagatattagagtggcaggcggcggttgcttgctcggtacggtggccacttgaatcggcgttagtaattggaattaatttaagggattgacgccgtcagtgggaaattcagactgaaaatgaagaactaggtaccaagtctaagctcctgaattttcaactcatcagatgcaatgtctcatgttaggctgctggtacgtactggggaaatctgaaattcgcgctaccgcgttttcccctggcacgcgtaacagaaacctagcagagattcctcagtcaaggaaacattttaatttggccaatttgcagtgatccgctgcctgaacaggaagaagaatgtaatgtactaatgcagaaataagtgcattacgtgttctgaatgcgttgctgtaagcgagacctagcttgttgggtcttccctgacttaggacctcatggcaacttggcaagtgtttggtatgataatgcagtgtatgtatgtactctatttgacaactcggtgttgtatggtcaaaacttgatttcttgtgaactacgacagtgtacttgcctgagatgttgctcagtcagacctcctattgttcaaatatattattcaagtcaaagtcctgcaaattttccaagaaaatgcccccaatattgtgtgtttatctgcattctgtgggaagaatgatcagaattacattttcctagctcaatatggtccacattctgaaatattggttattttgttttcctatgctatgttgagatagattacagaaatcccgttctaatcccaaaggcataattttggaattaaggcttggcatataaattttgtaggattcaacttcctaacgaatctttcctactccctctatttcaaattatatcattataattttgtcctaagtcaattattattataaatatttcaccattttttaaattcatatagtttaacaacatgcaaaccgtatattataaaagtattccccatggtaaaacaagaaacataaatcttatgatgataaactttttctttttgaaattaattgtcaaagatactaatatttgacttatagaaaaactagaacgaggaaaataagcaagaggtataatattttgaacactttaatttgctttcaccatgtttggactgaagccaattctaccatttttttggcaactttagtgccatatggatgtttgttttgctaccttttcttcacatagtacaaattaatggcatcagatttgagcgtgccaaaacttgtctatattaaagggtttatcttatattttcctctttttttctatagaattaaacaaacatgtcatttcaatttttttacacttttttctgccctacgcattctaaaagaataaatttattattattgagaatgtatcgagaaataccacatcatgtatgcaagttctaatgtaaaatttggtatcttcatggtactaaatatttagagctaccaaaatttttagtgtaaatttggagctaccaaaatttttagtgtaaatttatatatatactagtatactttcttaagagacataaaatttctcttccaaaagggtctggttatgcaatttattcctacaacatttttccaaacaaattcaattttgcttgagcacattgtgcacgcaagtgttcctaatttcctactgttccactgcacgagacaggacatctctcacttttctaacagtctcgcgatcatggtgtccatttctagtttgaaaacacgacaggatatctgaacttagttccagcatgaaacttgacctgctagtcactactcgcgactgcaaactaaaagcaggttcattcattcttccattgctgacatggtaactcgtaaggcgtaagagacacatatagcaagtttcttgattacgagtaccgcacggtataggtaacttgacttgtgactcggtagttaaggtaagagtatttactgagtcaatactcaagattatgctcatctgatacagaactcactgtgaagtcagtatgaaaatcttgcgattgacgtctagcggatctgtccctgttatactcgaccgggatcattccaaatttcagcgacgacggacactttgggttataaattcagtgatcttttcactttaattaatttccaaggaccgaggttaatcatgatggactaaattaagaatgttgtttggttttgctggcttagctttaaaattcttggagtaactcacttcagtgtgatttgtgaagtactatatactattctctttgtccctaaaagatctttatttttttaactatgtaactggacaagtattcctacgccacatacaattttgttttaaagatttgcgttcgcgaaaagcaggactagaaaagggcatcactactgcaatagcaactagcatgcagcaacatgtcaacacctaatgcacatctctcttcttttatttccgtgtttgattgattggttcatctacgaaataaccaaattaagctgctacagcgtgagattgaagtagtatacactgaaaccttcggtaccgggccgtgaccaggcgaatttaacgggccgcaggttcgtctgtatcccgttcagagcccactactcgaatctgcggagatggcgctctcgtaacagggccgtgaagatctcggcccataggaggcctgctgttctgcacaaactggaggcgataacgtcgtcaggccatcccgcacgtacttgggaatcctgttccgagcccacgttacaaattggcggaatgggcgcgctccaagaaggccatggagtttccggcctatatgaagtccttcctttccccgtttgcggaataagttcactttgggtccctctatttgtcgcccattccgattttcatcccttaccgcaaaaccaggtatgacccgtcccccaacttatgaaaactaggcaaacgtggtcccttggcgattttgaaggcggttttggctgacgtgacgcatacgtggcttgtttgactaggtctccgtcctacgtggcattgacgtggcgcttacgtggcaactatatctcggaaaaataataaaaagtgtggcccacatgtcagctgaaaaaaaaatggtgggggccccacatgtcagcctcattcctctcttcttccctctcccttctctctcttcttccctttcccccctctctctccttcccgggcagaggacggcacgggtgggcgacggagcaggcgagctccggcggcggcggcgggcgtggtcggcgccgccccccgaccggagcgccgccggtccgcgtgaaggcgagcaacgcggcggcgccctaaaagatgccatcgacgtcgccacccgtgtcgctgccgccgaccacccagacgccctccgcgcgcaccgggacagcatcaccgagcgcctctacaccgcgctcatcctcccgccgccgctccacaagccgcctacgccgcgctctcccctccctcctctctcgtcgtcctccctcctctctcgccgctgacgccgccgcgcgccgctccctcttctcccgccggcggccatcgaggagaagggcggcggacggctagacgagcggcgcaagagaaagatggccgccgccgccccacgccgtcatggggctagcagccgacgctgcaatcctccttcccccgctccaagaaacgctcctcctcctcctcccacaggctacgctccctcgcgctggccgtccttgctaccgacgcctcggcgaggtggggaggaggcggaggggagcgcggtaaacgatgacagacggcctcatccattgcgccgcccttgtcgccaacgccaccgatggctcgcttgctcgcatgcggagagggagaggaggcggagaggccgacggcgagcacgcggagagagggaggaggcggcgcgggagcacgccggggctccgagtctgccatgtccacctccgcggccggcgggagggccgaagagtagtggcagttcgccagccgccaccgctccacttccacctgcgacccctctgctccgcccaccgaccgccgtccttccgcccaccacccgccgcccctctgcccgccgtccttgcgtccaccgcccactgcccgccgcccgccgccgctctgcctgccaccccctatgcgccggcaacgccactgctcgcccttctacttgccatgtgtcacgcccagaaattcccgaatagaattccaagcagaatgtgcattaaaacccccgtccaggaccggccggggtacacaaacgataaagttgacgtacagatccacgtcttacaaacattataaaagtcttacataaatgcagcggaaaattaaaagataaatggagctaagccttgacttggactgcagcgggaacgccacttcacaggcatcctcgacggcacggatgaagcctactcctcggagaagccaccatctgacacgtactcaaactctggggtttgggggaaaatagagcaagactaagtacaaccaccgtactcagcaagtcataccggaatagagggtatgatgcaggatataaccaaaggatagctagagtggttcatttgcataaagcgagcatttaaaggcagtagttaaaagcagtaaaacagttataataattcatcaatattaaccatccactgttcaacgctaccccacgttgcaacaggcctaaccatccacctgaactaatcgattccattagactaagctagggtgagactaatcacggtgaatctggttgaccgcccgtaaccgcgggcacggctattcgaatagttttactctgattagaggtgtacaactgtacccacaagacaaagccccacgacacgttttcgtgcgccgacatgccaccacgacataccggatagaggccgtgacaggacccttcgcataaccccctctaaccaagcacaccacacctcaggtttcacccccactactcgcaaggcagcgggcagtcccctctcgtgcctaagtgaatccggaagccgcataggccatcgcagggcccatccaaactccatcacacccacccttgcctagatgcgtcagctagaggaaagctaccctacaagcccagccgttgcgcacgctggcttgttgtaagtacgataagttcttccagggcataccgcaaaccggtccttatgtgccatgggcgcgaccatcaaaaccatgcacccacagcccaccatttaatatattttaattaaccaacaccggagcggtggcattaaccaacatcattactagaatctgatatctatgcattaatgtaattcccccattgtgtgctagttgaactaagcatggctaagcaatccctagtccaatatctcgtcatgttatatcctaagctaacaaaggagcatggtacaaaaatagcatggctgtaacagtaggtaaatatcacatagtaacattataaaacaatgcagtatttaagggaaaacgatagaacatttgcaatataggatcaacatgttcaagtgacaagcatgacttgccttgctttgctgctggatgaacctcggcgactatttcaaagtacaccggagcgtcgggagagccggaatctaagcgacatacaaagcaaacaatacaaacaggccataagactactgaaacagagaataaaaccatttttaatggattctttgcatttttcttgatttactgagacttgaatgggcttaaacggagctcggatgaattttctatgaattttagaagattcattgtgtttttactataaacagaaaaacccttaaatgatttattgcgcaataattaaaaccctgggagagagagggggcggcaccgacatgcgggccccacatggcagtgactcgggtggcggtccgcggtggaccgggtccacgaaccggggaaggggctgcgtaccacgtggcgctgacgtggggccgacaccacggccacgtggcagccacgtgggcgcccgaaccgacggccctgatctaccctcggcggcgggagcgcgcggccggcgcgcacaggtggctcaagccggcccggcggccatggcgtacggcaacgctaccgcgagcggcggtggcaaacggcggcgaccgacggtgagcggcggcgcacggcgggtgacggcggcgcgatgcgacgactaggcggcggcgctaccggaggaaaagagagggggaagaaggagggggtgtcctcaccgaggaggtttgactggcgtggagggagacgacggtgaacggcggcgagactcgacggagagaagtcgacgagcggcggacggggttcgggatgacctaggaaacaaagtgggagaagttagaggggaagagaaagatcaccgagggcgggaacgccggccaaaggcggcggccatggccgaactcaccggcgcacggtgcgggatgggttccggcggcggaatccgacgggagaggggtggatggggtggcccgctcgacggcgaacgcgacggcgtcaacggcgcggctcggcacggcagctagcggcggtcggagcaacggcggaggcggcggagaggtgggcgacggcgctagtgctaaagagagcacgggagcgggtgattgcaaaacgaaaaagagagaggggagaatgggaatgctttatataggctcacaagggtcgatcgtggccgggatggctgcgatttcgccggcggagtggggagaggtggagaggagagagaggcgggattcaaaaattaaatcccggccgtctcgagcgtggacgcgggcgagagagagagggagtgggcgcggggaacgcgggggaaggcggcgacgtgggcgacgtggcccgggaggtgcgggagcgagcggggcggcggttgcgggatgcggcggcggcgaccggaggttagggacgggcccgacaggtggggcccacctgttggtgaccctaggggagaggggcgtgggcggccggcttggctgggccgtggccttcggccggcccggcgggcagggggaggggaagagaatgggccggcggcccattcgaaaagaaaaaggagggaaaaagaaaagaaaaggaaagaaaggattttccagggattaaataatgcttgtgctcatttttaaatggttaaaattatttctagagctctgaaaattccactaaaaatcttgttagcatatttcgacatgtagaactcacgaaaatcctacatgccaattccgattattatttgcattaatttattagggtttcactcctgctcttacaccggtatttttttgagaccatttataaattcaatttagacttgggagaagaacttcagggtgtgacaccatgtaggggagagagaggggcatagagagaagagggagcctgacatgtgagaccacatgggtcccaccctttttatatttttttagctgacatgtgggtcccactgttttttattattttcccgggatccaaatgccaagtaagcgctacgtaaatgccacgtgggtcgacgacctagttaaagggagccacgtaggcgctacgtcatctaaaaccaggcacaatactgccgagagatctcttttacacggttttgtaagttgggggacccgttgtatccggttttgtgatcaagggacgaaaatcggactgggcgacaaatagagagacccagagtgaacttattccccattttgcgcatactcaattatgggccctaaatgcgtaggcccattcagcacgtaggcggcaatcctgttctgggcccacgacatcacggcctgtctagttacgctggtttctaacgtgggctcggaacgggattggcccaaaatggtctacgctgaattcggattagtccatccgcagcaagaatgccacgcttggtatttttcagatggaataagtgtatttacatccctaaactcatccttgattgaatagcatccctcaaccataaaaacgggtataatacctcttcaatttttgaaaactggttcaaatcgatcaactccataggtggtttgggaagcggtttaccgtaggatccacatgtaagcgcctactctagttaacacttttttttcaaatgaacgacatatgtacatcgtcgttcaatctggtgcactctcgccgctcgaccgactggtgaccacgacggtggcaaagatggcttcgtcgacctaggaggccgagtacaaggcttcctcggccacaactggtatttatgctcattcattatcattactttcgctattgcatatttatctacatcaatcgactctctctccatcaaaacaaattggatacatgttaattgacgtacggtagacatgggagcttctctgacagcgcgatgctcaacaacatcattgggctcctcctgcatagcacgaagccactggcacgcctatccgtccacgcgacatcctatgcctcgcaatgcgcattgacggctcgtgcttaccatcgtcgtgccttgctacctcagtgggaacctccgcatgtcctgcatcctcccggcgctcttcccctctctcgccgcacatggccgccacgcctgttcgcctccacacccgcgaggccgtgctagacgtgagttcgccgagtagtgagtactagtccacctatgcgatgaagttgccccgggttaggccaggcatccaccgctaccgtcgtgatttgctcgcctctgcaatttcgcccaccgaccgggagcccgggatgagacaaagagcaagagggaggtaggagaggaaggagtgggccctactatgttctttttattttttttactataatgccacacatgcaacacgtcagtaccaaagtaagtcagcctactaagtaggcaccacatagaatgaaaccattatctaaaccgttgaaggatgcgattcaatcaggtgtaaggtaagagggagattcacaaataggcttaaataaatgtgttctccttattttggcttttcctatttaaatgtttgatgtgttctattttatttgaactacactcttatctcgagtgttactttgtaataattggttgtagcttttcttgagcaaaggttgagatattatattccattattaaaaaagagagagagagaaaaatagacttattcctttttattcctttttagattcttaagccgaactatcatccgttgatgtttgcattggacttttctctatataagccgcgtaacatgaggcccagtaaccgaaagttggctgatgttgtttcgttgaacagctcagcccactccaacctaaacggccgctccctccactgctgttgaaagcgccacgacgcgccgcgccgcgccccgccccgctggcgactgcttctgtcgcgctcgcgcgcagagtcgcctccccggagcaagcgttgatcggctcaaacctccgccgaggcgagagggcagcaaagcgaaaccccgaacattttcaaacgcggcgccaaagcgaggaccgtttcggatcccgacccgatgcggtgcacgcgccgtggtcaccggtacaatcgtactgtagtacagccggtccaccgatcccgatgctctcagcctcaccagtcaccaccaccaacccttccacggctagaaattttgcagtctactactgccaccaccagctgtccagttcaccaccacgacccggtcgcctcctcccgcccgtttaaatacgcagcagctcaagctgcctcccccgcacgcttcatccacagatccctctctgtctctcaactcccaagcagcagagagagcagcagctaaagctaagccgagttctgtcgccgacgccgtcccgatcaagaggaggatacactcgtacaaggagcggaggaggcatcaccagcttacaatgcggagctcgttcggcggcaaagctcgcggcgctgcagcaccggcaccggcgacgcacccgcgctacgtgccgcagagaggagtcgtgctgaagagcgtgctgggctggttcttcggctgcttccgccccgccaagacccggcctcttccggccggccggtgaaagcccgtgcgtggctgaggcccggtgtaccgaccgaactgccaatgtcggttagcgcctcgctttcccgtcccttaggttcttgctgggcgagcttcttcacacgagacacggcaaccgatcacgatggaccgcgcgtgtgtttcattaggattgtttgtacttagctttgtgaattgtatgttgccttcttggcaacccgtgatttcatttgtgttcctcagggccttatcgcattctgaaatctggattcagcttcagccttttcaggtgttctttttcttaacgagacggtgcgaagttctattgatagagcaggacttttcaggtgttctgtttcagatgtttagttatcatttgatgctgcgtctctgaataatcgtagactaaacagcagaaagcgcagaaccagtcaggtgcaaagaattgtttgcgagttgtgatttctttataacagaaaaagactacgtaggacaaaaataaataatggggaaaagtcagaagtccaagtcagcttttagactttgactttttcttgctttgtttagttcttgctctgttgcaatggttggttggtggccggatctgcagccatgttgggctcttggctgcatccagtggcttcaaccagattgattacctttttgtttctggaaaggaatcattagtatttggtaataattccattagcccaattgtacagcgttgcatcagctgcatcatcaataaacttgattacttctgctcaacgcatctcaacattgaccagagtccacatttcctacacttgtcctactatacatcaacatcatcttacttactgtaaacagaaggaaaggatttgttccgaagcagaatggtgacatcgtattccatttcctttattcagaagtgattttgatggatatgtatgaactatgaactaggggacctgtattacatttttttgaagggaaaatagcgcataattgtgacttttcattgaatatagcgtgagagaacactgcatcacattaacttattctgtacttcgagctattacccatttactcatatgaaagttcatccaaactagtactaagacttaagcacgtactccatccgttccaaaataaagaaatttaatatgggatgtgatatataatattactacgataaatctgaataagtctattttggaatggagtactagcttgtggctaaacacatttctgaaattcaaatatccgttcagtacttcagtagtatagtacattctccaacaatttggtacgatccatgccttttatagtcagtacattcagaacgaagaaaacctgccactgggatgaacatgggcaagaactaatgttgcctgcacaagacagaattcgccagctcaaattttgtgagagaagtcagaagtcaaggtcaggttttcagactgaccttttacagttcctcttctctcattagttggctcgatcagagtcattcattaaatccgatcactggacgcgaccagtttctctccgggacactgaccctgacccgaagtcaatctttcaatgtttcttcacttggtcactgccctcatcttcagtgtacctactggacatagaatcaccgctaaattttgcacaccgaaaaaaaatgctttggtaactaaatttccaaagaacatagagtaaggataatctttttttttcctctctccttctttttccaggattccagtgctgttcttgcccagttgccctccctttctcatagttccagtgttatttttattctctccatcctgccgtctgcactatcgtttccatgtaaaatctgccccccagttcgccacttgcggtttgccgatgtgaaacgaacagaaagccatcacctggtagaacaaagtgaccagcgtcctttcatgccagctacaaacaagctcgccaataaactgtagcactcttgagtcttgcctgaccgtgtttgcggcgagagttgagttgaggcatcattgtattcggttttcaccgacctccacacacggccacacacactgctcctgcagatgcttccttcgtcccacagtgcacgaagaggaagaaaagatgatgaatttgatggcgagtgcagcagaaaggcgacgtcttgaacggtttagccgcaaatcggaggggcccgttgagcttttcccacggccatgggcgacggccatggcgccacatggccgatggctactcgctaacttccacctgcggaaaccgcccccaaaaaagttcagacgtagtcgtgcgctcatcatctcgcttacgctctcacgctgtcgccatctcgcgccacttccgctccagttcccgccatcttccccagcctttccttcgctgctcctctgtggagtgccaccatgagttcataaatacgaggttggtatggtatggccgtttgctcactatcaccacgaatccggtgtaaagctcacctcacctcacctctcgttatgctcggcggcggcggagtaggaggggggaagaagccgcctccgccgggagtccaccctcgctacgtcccgaagaggggctcggtgctgaaggggatcgtgcgccgcatgctcggcctcttcgtcttcctcctcccgcagcagggcgggggcggagcggcgaatggcagcggcggcggcggccgcgtgcgcccggcggcgcctccggtggatgatggcggcgagcaggggaagtaggtcacccacggtatatatcgatcgttagaccgggttatcatgtcccatccttttatctgggccgttcgttaatggtttgaatagtagctgttatgtttttcctcctattattgcagggattcatgtcacagattaatacggtcttacatattcgtactactactatgctttccctcgtattattgcagggattatgtaacacgtgcttgatatttctacagtttggaaaagttcagtttttctttttcattctgttgtgtttgtttctgcagaagtgcagaggatttttacaggaatactcaattcttcatcttcaggtgctgtgaacaaacaaaca

SEQ ID NO: 69538 - DNA, 4509 bp, Oryza sativa
ggggagggatggggagggttagggttagggttagggttttgataaggctgtgggccgaccgggatggaaataagtctattttaggtccctcgggctggaaataagtctatattaggtccctcgggccgaaaaaaagagaagttcatttttagtgcttcattttttcagaagcatttacaattatagttattgaatgtgtttatttctaagcaaacctaaaaggaaggattttctttctttttccaattaaataattattaaatgatgtttgtattattaaaattagcaattaagctctgaaaattccaataaatttccaaagagcgtaactaatcatggagaatttaataaaattaaatttaacaatgtcattttatttctcacactttacttgtaaatttatttaattatacacatacctccttaaaaatactaaatatttcagcgaatttgtattttaattaattgcatattttttctgatacgtgcgcttcccggtgcaatacacgggtacttttgctaaaccaaacaacaattttggtcaatatacacactccgtaatcacccggtacaacgcacgggcacttttgctagtactatatacatacgtatagaagtagtagattagatacagagagactagagaaagagggagactgattgcgcgcgcgcctccctgcgcggctgatcgcgtatcagccgtcccgacgtttggtagggtagcaatccaaattggcccactgtctcctttcccccttcggatcaaggctgacggcgccccggtccaagttgcgcagtgcgacgtgggtcggtgggtgcgtgtggccccgcttgcagcgtgccggcccccggtcctgcctgtctcgcccgttccccctgcgccgcccctcgccggcccgcgcacgcgcccaagacgcacttggtggtccgcgtcgcgctcgtctctcgcgtgcgctgcgtctcccctcctacccctgattcgcacggaattcctcgaatcgcccgtgagatccgcttgattcgatctccgattcaggccccggggtctagggttttcgccgccgttcgagcggagcagagcggggcgtgggagatggcggggaagggagccaaggcgacggcggccaagtcggcggagaaggaaaaggggaagaaggcccccgtatcccgctcatcccgcgccgggtcccaggtaagttcgactgctcatcctctccccgcccccgctcgtcgcttctccgtcgttcgtggtcgctcaagattcggtccgcctgctgccccttcctgtgcattttggtgttcccacaggcgccttgggttcagctattgctctttctaccgctttggttggaattgcgcgttttagcttggtgaaattttcggttggagattacagttgtttgggtcttggaaattcgacccacgggagatttcaggctttcaacagatctggaaaaccatatgttatgtctggtgctattatttttgggctgtgagatttggttttctcgcttgggtgcgagaggacctgcacggactggtgggtttcggtaggttgtactgtgggtttagttgtctcaaatactgtccgaaattctgggtgctcggcttagtattctcgtgttggaatctctggaaatggtagtcttatcaaatgagcctccagtttcttgttcactgtaacttgttatttctcgaggtggcaacatttcagggatctcaacatggttggatgaccatttaggatacattttgctcccgcatagaccaaaagctgattttgtcttcatcttgaattcattgtagcaagttaatttatttgatagtacctcccttcgcttcctagcacaaatgcacaatgcatatagaggttttctcccatccctgggaagtattatatatatacctccccaccacttgaaaggcacaagacttaaaccggctgaactgattagagcaaatggatgttttcagaaatgtcaggttttagggtcctttgggaggtatattgtgtacatagtgttgttaatcaggtggtatataccttttagtagaggtattataacctcatgactaatgctaaatacctatacctcggacaaaaagtcaggagccaatgcaaatgtgaatttcctgtcctatccccagttgtgatcactactgggaggtataataccctctcgcatataactagaagattataataatctgttaatctgctcaatcatatgtaggagaagccagctccaaacaaggatgtttaccaactatttgctgagaaggttagggataacaagcagctggaatcaagatgggcaattatgcaagaaactcgtgttgagtatttccgtggaaaagattttactaccttcatgaggaatcatccagaagttagggaaattttagggccagataaagatttagaagtggaagacattgttaacactctgctgagcaagaaccttgtgataaggtgtgaccgagtttggaaaactgtcagaccaggaaagaagaaattgtcatcgtggcctgcacatttggagatacatcgtgtaagtaccactgctaatgaagaacattgtaggttgaactttctgttgatcttgttgatgtactgttgtatttttgatgatataatgttcctaatatttctattacccttatccacaatagtattacatttttatggcaatcacatctttgttctcttggcttcaagtgaaggttttcttgtgtcttggtgatttctgttcttgcttttaattcctatcatatttatcctgtatttagtttgaaattagataacgactgtatcaggtgaaacaatacatgtatcaactagcacatttgctccattttgcatcgctttgaagctttttttttttgtatcttgcttatttttgaccatgtaataaaccagttatgcctcgcaaattcattttgcttgaaaataatgagtggtgatttcatgatagccttttttcaggatactattatcctcagtagttctaatgtgagcttgatttattcttgcaggaacaagtgttcactgagaatgatggattttttgcttggatgtttctcaaaaggaggaccttgtggcaaacgattctttcatttgtttggcctctctttgctttggcagtttgcttatttccagtttacccataccaatgcaagattgtggtcttgtactcatgtgctggagctttattgttcattgtctctattcttttgtgtaagcacttctctctaacactgtcttttatgctagaaatattagcaccattaactaatcaaggtatttttttttcacgagtacaagacagacaaaacaaaaaataagcttatgctctccctagtgtctattaataatatgtacaatgcatggatgcccttgtaggcttgtactcgcatatgctgttactgcgttacctatgataaatgagacataatttagtactcatgtaactgcaatattttgctatatcatttttgtagttgcatcatcatgttctggagtaaattttattggagtttatgtgctgcttttaaggacgttttgtggcattatctagtagacctaaaattgcttgtgagcatgcaacgttctatttgtatttactgtttagtagtacaaacaactactgcaacaatgagtaggctaagcctgtctagcagtctatctcaaaatcatgcttttagctaaaaactattaatcgctgactatgtttgacagcttgggagtgtgacaaaaatgtgatttatatttttgttagactggtaggtttgaaagccttggaaaaatgattactaaatgacctctaaacctttgagatatgcaataattctttgaaaaaaagagagtaaaatgcactagtcataccgcaacatgtgaggtgtgtgcaatttagtcattcaaaccttgcaaattgctcagaaaagtcactcatattgtttcaggggtgtaaatcacatcaaacacatgccacgtgtgctgtttgcttccaacatggatgatatgctagcctaacattgtgcgctcatgagccacatgggcatggcaagctataaaaatgcaaataagtccgttgtttttcgtgcagctgctgcatgcactcatgagctacatgcagttgcatgaaaaatacaggactaatctgcaatttttaattttgtctaagcacctaaacttgtcctgtccaggtggctcatgagacatcatgttaggctagcatattgtccaaccttggtagcgaacagcccaacatgtcatgtgtacgatgaggtttgcacccctgaataaaaatgagtgactcactttagtaatttgcaagatgaatgactaaattacacacttcacaagttgtggtaccactagtgcatctaactccttaaaaaaactgttgcttgtgatgaagtagattgttgttactagaaaatactccctccatttctaaatatttgacatcgttgactttttagcacatgtttgaccgttcgtcttat

SEQ ID NO: 69539 - DNA, 11031 bp, Oryza sativa
acggctgcgccgcctgcggtgcaggaatcggagacgaagagcggtggggtgttggtcaaggatgtggtggaggtgtcacggtctctgggtgcagctgatactacagaggtattactgttcgcgatcgagtgctatgccatcggtccccatgttttgaaatcgagaggtctcatttggttcattattttttcccttatgattgcaggtggcccggggacctgcagtggctgtggctgcagcagggcagcgggcaacatggtggaattgctgtggggtatttgatgcgttctctggttcggagagatagattaaggtctgtatcgctgtatcatggtttatcttttttttttatgatgatgatgctttgtggaaagaatatatcattaccattactgttagatgtcattggggaggcttaaaataacagatattttactaaattgtttgtttcttttaattttctgtcctttgctcatgctctaggactatttcgatgtttgttaatataagcaccgggcctgatttcttttgtaggaatgaaggtggtactatagctgcgtttatgcctttttattcatgactaatgttattagcagcaagattattctatatgttttataattgcatcactttgcgcttctgtgtgctttgctgcttgttttttcaaatggctaccatatttttaacctagtcagagcaatgatgtcaggacaccctcttttccttgtttctaaaaaactgtccagttcagtctcctgatgtgcctgtagaagggagctgaagaatgttaatgactgatgacttaaggttgtgtaaggcttatcagaccatattagagaatacagttatacaattgtcaactaatctcccaaagcttcatgctattttaacctttcaatgcctttttttttttaatttgattgtcaatacattttttcttgtaaatgcttctgtaaatcattggactgtttaaggttgcaacatctagctgatcaaatagagttttcttagtgtttgcttttccttaccaagaggacagtgaactcaaaactaaaactaccttttgaaatcagatgcccagtgtcagtaaaagctaactgaacataattttgataaaactagctgtatgattacgatcaattttgatatgccacgtggacatatttttttagttttgaatatttggatatgcttgctatatgttagtcaatttgtttgcagagaatctgttagttgcttaagaaacgagatacccggtatagttatcgagtcatttcataagcagtgtttgttccaatgctgataaactaaggaaggatgcacaatggtaacactgtaactacgagaaattgaaaacacatgatttatttgatttgtctgttgtatatatgttatgcacatggaacatgatgccccaagtttacatcttagtggagaatagtcatgctatgcatatgaacatgattggagttttacatgttctaatttgttttccctgttgatttggttaaatcaagttttaatttccaaaatagctgaatgatctctcttagacttttacacgtaattatgttctgttggcaatccaacttggcatccaaagagactaaagtttaccctaccattttgctaccagcaatattgtgatgtctaccacatgaaaatacgaggatgcaccttttgtattctgaactatttctctgctctttttcccctcatctttaaaatggttacctctgttcctaataacaactattttgtacttgtggataacatggataactatcatagctggccaattccatttgagatacagtccagctgtaatgcttggtatgcttgaggttgtggataccaaacctctcaaatttgtgtaatgtcaaagtgaaattggatgacaatcgtataggaaatgactaaatcggaatttttcttgggctcagatgatttatctgagaaagtactaagagcaagtttaataatatagccaactattagctctaaaaaataacacatcatatatagctaacttaataaaccactcatacaatagttaactatagatacgtatactgcaccattattgtgcactccatatttctctcagttcttggagcacgagctgcaatctgtagcccgcctttcatctcctcttatttcttctccacataagcacaaatatgatgttgcaacatgtagagcccgcttacatcatcttattatctttgctctaatgggacaagatgtttatttactattttggtttcgtagtatttattactgagaataacatgtacttctaatcttctatgttgtcttaaaagttctcttgtttttcccacataccaggttggaacttggaagccaagaagacagtagacgcgaagttgttcaaagctgatggtaattgtaactagtctggtttatgctcatatgaatggagttgaagaatggataacatcgagctgatgtttctctctggcccatgtttctacaccgtgctgtgcaaagttacatccccttggttgtggttaatattctcgagtcgcgtagtactctgaaatctacacccttgtctattatcatctaggttatgttcatgtagcataagagttgagttgagtcgtcagcaaagaaattttgttctttctgtttcatacttatttttttttggggggggggggggtgtcatccggtttgcccccttctatggttcggtcaccttgaaaggagtaacgttgaaactatttaggtgttccattgtgtagtcttgctccgtgatagctcgcaggcacatcagactactcactatgaaaaagaaaataatgagacgtgtgggttacattcattgattctgctcacttccctgcccggtatgtgtcatcctgtcaaaatcctggcatggcatctatcgtgccattgttttcatggctccacatggtgtttgctatacgaattttatttagtaaaaccggacaatttgttcgttgaacaaaggggacggtccggaatgatagcgtctctgcagcggctacctcctaccggtgcaagaaagctacagccttgtcggcttgaacgtcacgtgcaaaaatgtagtagcagcatgaatatattagtagcatggtgatttcttattcttatacgtgtatttttgtctgaaacatggtactccagtaacatttaatgaaattaacgacgtttccttggaaattctgagcacaaaattgcatgacacgtctgcgctgagtcagtctggtggtcctaattaactcgggggccgtaatttttcattcctccatcctactagattttagcgggtcgtttttaagaggtgacatgacacagcgtgtgaaccagaatatttcgccctaatcatcagttttccagagccgtttgtggccgtgcaagcttactggtcgctggattgtttgatttgcaagagcaagtggcaaccatccaaccatccaaagctctaacagccacgagctgtgtactatagtactccgtacagcgacatggtcgattcgtgttcatggcgacgatcctggtatccagcctttcggtcacccggacgccactgaagattctttatatcatcggaaaacgatagtcctctacgtagtaaaaggactgcagtaactacggtaatttccttgctgacagaaaccctcgcaacgtgcttttcgccagcgagtggtgtaattttgcatttggcgaaattaatcactccgtggaattcagaagaaaaatacagagatcatgagatttactggagacagggattgttcattcttgcagtattaccatatgagtgaaaggagaagagggatattctcaggagcaaactcttaatgattactcaaaaatttaactggtggctgtggcgctttgtgtctctcactgaccgactcgtgctgccctttataatagccacggaattttagcacaaagaggcagacacgagaaaagggaagatacaagtgtcatcccgcatccaacaaccatggactccttgtatgatatctcctgctttgctgctggtcttgcaggtacggaacttcatttcgatctcgcacttacaattcttcttaagttcctatcgcaaaatggtctggatcgaaaagaggcttgctaatcttctgaaaatctggccgcctccttttgttttgtcgctgcaggcaacatctttgcgcttgctctcttcctgtcgccagtgtaagcacacgttcggtttggttttttcttgatcctttgattcgtagccgaagttcataactgaattttccttgtttcaggacgacgtttaagaggatcctgaaggccaaatcgaccgagcgattcgacgggctcccttacctgttctcgctgctgaattgcctcatctgcctgtggtatggacttccctgggtcgccgatggcaggctgctcgtcgctaccgtcaacggcattggagcggtgttccagctcgcctacatttgcctcttcatcttctacgcggacagcaggaagacgagggtaattcttcccatcctgcaaccaattttgtctcagaaaaatgtacttgtagactgcagtaatagattgctaatgtagtagcctagtactgtacattttcaattttgtctgatgccaatatgccatcaagaaaggaaaagatgatggataatgttttccaattcctccacagatgaagatcatagggctcttggtgctggtagtttgcgggtttgcgctagtttcacatgcgagcgtctttttctttgatcaaccgcttcggcagcagtttgtgggagctgtgagcatggcttcgctgatctccatgttcgcttctccgttagctgtcatggtacgtatgcctctcgatcaagctgagctcttgatcaatatcatctccggcatgtttaatagaactgagggatctcactaacctttgcttgctccatccatccttgtgtctacagggagttgtgattcggtcagagtctgtggagttcatgccgttctatctgtcactctctacgttcttgatgagcgccagttttgcattgtatgggttgctgctgcgagatttcttcatttatgtgagcatcatcttgtatcgctttaaatcacttcatttcttgaatcgacatgcatgtttatgagcttgatggatcttgtactgacagcttgattcttttttttttaaccattttgatttttcagttccctaatgggcttggacttatcctgggagcaatgcagctggcgctctacgcttactacagcagaaaatggagaggccaggattcatctgcaccgttgctgctcgcatgatcaaaaccggagtgaatgattgatcgatcagctggttttgccatggtttggattcttgaaagagtgggtttatggtgaattgtacagttttggctcagtcttcacatgttggtactggaagctgtacttcaaactgcattcttcaaacatgttggaaagttttgcacaccaggggggcaaatgatggattttttttaatttgattccctccttttccttgaatacttggtgtgcaaaattatttcagctatgcacattgagcctcacttcttgttatcaattatgacatgtcacatatgtataagttgcgatgatagttttgtttcgttgctgtttgtaaactgcaatattcttctcgccaaactgtgtgaacaacaaatcaatggccacgtcatatatgtacaagttgagatgataattttgttttgctgctgttggtaaactgcaatcaatggccaatgtttatgacacctagggcaagtccgagatatttggttcgtccgtgaggaaggtgtacgacatgtttgcaccatcctggctatgaatgtacacacactcttatccttataaatacacacacatatcctatccctacgagcacttccgaaatattggactgacatatcttgatattgacgaagtcatcacatgcgcatcgttgccgataggtacgccacctactactaaaataataattagccgtaaataggagcatccatatcaaatatatgatttgaatctagggttctaacataagaaacctaactagttgagctacattttgtattatgttttattgaacttgaatttcacacaaaaaaaataaaaattcatatctcctcgcacaaataaaaaacaattaagcaccatttttggacagctcaaaattttatctcaccctagaattccgatttctacaagtggaaaatagacctaatcaaatgtaaaacagtggtaaatgtaccgggccttatagatctaattaggcccaagcccatccagcgaaacacgtttcagttggcccgtaacgtggaatccatcccgttccgttctcctcctcgtcctcgtggcgttcggaccaaacggagcgcagattaaccaaccatccctgtgttcttcctcctccgcccaataagccgctaatctcgtctccgcccttagaagagatcagcccctcgcagcggatgcctgggctagcattttggttggttcgatggagtctaaatcccccagtttttaatctgtgagccgtctccctgcactctgatgtctgtttcgtctggcttttgattccattgtgattaattaggtcatgatgttagatgcaaatttgtatgtcattgcggatgataatgctgtattgaaatgcatggggattgggggttcatgcaggtagactcggacgctagctggccggcgcaaatatgtgagttcttctgatttttttttttttacgtaagaaggtagagtcagccatttcatcgatataaatgagtgtaaggtacatgaggaaggggggtggaggaaaaaaagagagaaaagagagtaaaagagagaatgtacaaaagttcaaaaagtaataattctgattcaaccgagcacctgcatgtcttcgaatttagggggaaaaactaagtgcaaactacagacatttccatctgtgcagcctacttgttatttctctgattgctgaatgcaaatgtgatttggagggcgggtgggttgatcggttcctgtgatacacagatactgctactcaagcttggtctcttttgtttatttttatgcaggtgactgtgtaaagctgacaataggatgttgacatgttgctgtttagatgacaccagatgaaactgtacaattctagacacaattgtgatgccttctttattgatctccttttgtatttgtgcgtgcatgtgtcaaactattggctaacactaatgctccatgtttaatattctcaaggcccttattactttaaagaaaggtactaaactcatcaagtatagccggagaggaaaacccaagatccgtgcgttcagactttctagcgtaagcgataagccccaagtatgtgccgattgcttgatgtcggtgataccaaatttgattatgtccctttgacctttacgtattgcaggatgaaacatctttaatttggttttctcacaaaaaggaaaagttcctcagactgtcttctgtcactaagatcattcctggacagagaactgtaagtcctccatatccttaaacaacaacagttgcaaaagagcataaacttccatcaagctggtaccttgctatcctactaatcaacttttcaccaggctgtgtttgggaggtttttacaccctgagaaggattatttatcattttccctcatatttaaaaacgggcaacgctcacttgatctggtatggtaaagataaaattatgtaattcactcaatctaagtcccaatcattagcttatgataaatacttattttttttcgattcatagcataggttgagtctatgatagcatgcactgcagaggacattcctagtatgaacttctttctattctgcaggtttgtaaggatcaagctgaagttgaagtctggttttcagcacttgaggggttaataagttcattccgcaaaaaatctttgattaacgaacacaaggatagagtatcattttctgaagtgagttatgctcgaccttcctacaggaatttctgtgcctctgtacgcaactatattcatggttcagttttgctatacagttaccattttagaaggaaaaaatgactcaagcatcgtagatatgcatataacgcacaaataccataataccgtaagttttttcgagaaaagaaatttagttcaatttataatgaaagttataggtttatacagcaaaagtaaaagtaggggttactagcttacaataatgtacatgaaacaaaagcacctaaactttaggagtgcagaccctctagacaagatggaacataaacttttccaggatgatgagtccaggctaagactgcctcagctccctaccttttgttttgctctgaacaattaactcatccaccaaaattctatgattgttactgaaaaaaatatatgtacatactaaaagcatacatcattaaaatgttactttgatcaatctagtttttagttatgtactctactccgctctgtaacatgtgggagctaggtatccactttgaatcttttatctatctagattttggttaccaactcttctcctctttctatcaactaactctgctcctcttcgagaattataagcccctatataattaggatgtatagtatattctgagacagcaagtctttacaaatattctaatatagtgcgccttccttcttttttccaggaagtaacttattatcaagatcgccattcctatgattcaacactagatattgcttcaaatatttcacgcagttttaactcagctggttactgtggaaccaattcatttagtttcagaaaatcagatgtgggatttgatcgtctaaatatgataagaacaagtgctgcagacagtagccgggttagtatttctagtgcccttagttcttacagtcaaggttctggaacagatgacatagaatcccttggtgatgtttatgtctggggtgaagtatggactgatgtaaccccatcagatgggcacacaagctcttcatgctcaaaagtagatgttttgatccccaaacctttagaatctgatgtcgtgttagatgttaatcagatagcatgtggtacgagacatgtagctcttactaccaggcaaggagaggtgtttacgtggggtgaggaatttggtgggcgcctaggtcacggaactgatgctgatattagtcgccccaagcttgtcgagtctttatcactaaccgtagttgatcttatttcatgtggagaattccatacttgtgctgtgactacttccggtgatctattcaattggggggatggttcttacaatgtcggactgcttgggtgtggcactgaagttagctactggcttccaaagaaagtctcagggccttagaaggtcttcaagttctatctgttgcatgtggctcatggcattctgctttgaccacatcaagtggaaaactttacacatttggtgatggaacatttggtgttcttggacatggtgaccgtgaaactttagcatacccaaaagaggtagaagccttgagtggattcaaaacgatcaaagttgcatgtggaatttggcattctgcagcaattgtggaggttactaatcagacaggtgcaaatgtgatgtctaagaagttatatacctggggtgatggagataagaaccgccttggccatggggacaaagagcctaggttagttcctaaatgtgttcaagcgcttttagagtacaattttcatcagctggcttgtggacataatatgactgttgccctagctacatctggtcgtgtgtttaccatgggtagttccagcaatggccagcttggaaatccaaaatctgatggcaagcagccttgcttagttcaagatagattggctagtgagttggttgaagagatttcatgtggagcttctcatgttacagttttgacttcaagaagtgaagtatatacatggggaatgggtgccaatggaagacttggtcatggcgatctcaaggacaggaagaagccatgtcttgttgaagcacttaaagatcggcatgtcaagagtatatcatgtggttcaaatttcacaacatgtatttgcatacataagtgggtatcaggtgcagatcaatctgtctgcacgggttgcaggcaagcatttggtttcactagaaagagacatgattgctacaactgtgggctggttcattgtcatgcttgcagttcaagaaaagtgttgaaggctgctctagcaccaactccaggcaagccacatcgtgtgtgtgattcatgctttctaaaattgaaagccgcagagaccggcagcaacaattctaacagaagaaatgctgttactcgtcgctctattgatgggagagagaagcttgagaggccagaaataaggccttccaggacaacagcaccagcggaatcagtcaagtatacagaggtaaaagctgcaagaaatgatatgagagcatcccaaatttcttccttgctacagttcaaagatcttagcttctctgctcttcaacccacggcgatgtcaccagctgtaactatgtcacctgcagtacctgcactctcaacaccatctccatacacaaagaaaacaaaatcacctgcacctgcaatcccgcaattccctaaaactgatatagataacttgcagaagtctaacgaattgctgaatcaagaaatgttgaagctgcaatctcaggcaagaatgaaactgctgtttattctgtaccttgttacagctagctattctgataaaccattgtgttttcaataggttgatagcttaaaacaaaagtgcgaggcccaacacgagcagcttcagatatcagataagaaaactaaaacagttgtctctatggccacggaagaatatactagatgcagtgctgtggtcgagtttgttaaatttcttgataacgaggtatagtaaaatccttttgataatattgtggttcagatcttggatgttattagggttcttctctattgaatttattttctttact

SEQ ID NO: 69540 - DNA, 27128 bp, Oryza sativa
ggattggatcaaccatgtgattaggtgttctcttcttaagcaggaaataggaaattagagggctcctgatgaagtagcataaatgcatatgtgcacaatctccgcaaaaatcgagctcaaaggtacgcatctccttcgatttggagaactgtaaaaaatctgatgcctccattttatgccatctgttatgtcttttggagcacaaaggattttggtctgtgttttttcatttatgtgagatttcagattactgcatcatcttatttatcaagaactataaattactttgttccagaagtccatttcataatctatattagctattattttttagatctatcttgaatggacttcaggcttgatcaaaatttctgtctgttctctaactgctattcactggccaaataagggcatctatcgagttaatgtggactgatggcatatattgtacattagttgtgcgactaataaattcagttgagttgctgatttattgtttcacaaatgaatttagtttcactctattttcttcttaacaaatcttttttctgttaattgcatatacatgttcaaatcccttgtcatggagatataaagctttagtgaacagtcaaggcagagattttgcatctttagtgtattgtagatcagttgataactatggatcattcatacatgattctggtcgctcaataatttgtgtattgtaaacatgtttataattcctgcaaatttctcctacatgattccttattcatgcaaattctgttcttctccctctaattggcctcaattcactgatgtgagaaaacaaaacatgatggtattcagtatcgaagctaaggtatttttctttccttttttgcagtcataaaactggattgcagacagctacctcggttctaaattcatccagggcatcgcttcatataagttactgcaaggaattctgcactacaactttctacacataggagcaagatggtaaggcacaaaatgcatagtaacaaataaaggataatgactatcgctcttgggctataaaaacttttatgttaaagcatctcatatgattaaggaaactgtatagctataaaagttatcacaactgaaaaaaggcattagtgtcccagatattctcggcttgtggaatacaaagttagaagaaatatttctcaaacattattgcagtgtctttttttttccttgaagaaatactaacgactactagattacttagaagcagcaatcaaagatgaaaactaacgcgccagttggcaaaaccaggttaaatcaggttatatgtaagctcaagtgatcttgcagttatgttgagaaaaattattagatctatgtgtgaactcactaatgtttttagggtgatgcttgatagtcgctgaattaccaattttaaagttcaattcagatcaaatattaattatttgaaaaaattggttatatagcatcgaaagtttccgtttttggttttatagcaccgaaagttaccggtcactttaatagtatccaaagttcaccttgttcccatttttagcactttcgtcaatttttccgtccgtcttgatcgttattgatccagccacacacatgatataacatttctacccctcattgatatgcattatacttgtacttgtgaggggtaaaaacgtcatatcgtgtgtgtggctggatcaagacggacggaaaatgatcgagaattgacggaagtgttaaaaatgggaacatggtgaactttgggtgctattaaagtgaaccggtaactttcggtgctataaaaccaaaaacgtgaactttcgatgctatataaccaattttgcctaattatttatagaatcgggtttgtctgaaacgatataaaacaatatgttttcttgaacttaataggctcacttttacatattctgcctatttgtgacgacatggtagagcagaaataccgagagatcacctgggtgaggtagacaatggcctttatggcgcccaggttctactgtggcccaacatgttcttttttacagagggtgtactccgtcaccgagaggagttgtcaatctgcaccatcaccaactgggaggcctccttctgtgtcgccatagaggagcattatcaatctcttccgccataggctcatgtgtcctcgatctgagccgccattgccagatatgtcctcgatctgcatgagacaaggatgttgctaatagctgattaacgcaatggggtacaaaattatgttgttcttggaggagactatactatgtatgtcttctccctgctgtaatgtttgagttccatccatctaatttagagttatctaactcaatgttccctcttctcaatgacaataataaaagggttaattagatcatgccattataattttcatggttttaaaatatgccattacaattcaactatttggaattataccattataactttagagttattagataaataccactacttacctcttcaacccatattctaaatgttatagacgaaattactcttttcttcttccttcgtctcctccccactctcttctgttcatcctcggaatctgacggccggagagctgcagctcgaagcagcagcggcaacagttcgagggccccgtggtcgccctgacctgtcccctatctccctgctgccgcagctgtcagggctgccgcactgcctagagatggtctgtgacgctgatgctacgcatggcgtccaatctgcatcaacgaagaggagcaacagcaatatctgtaggatgagtgattctccggtgctctctgctgtatgatactattagtagaaacgatcttagccattgatttattaggctataatgttaagtttttctttatatgatttgtgccttctattctttttctcttcgagaaatttgcatgactagatctcgcgcataatgagaaattatttttttttatctcttgcctttgatttgcggtgagaggatcacttgtcatatatatcaagcaactcatgcacttgaatagcgctattcagttttttatactcctatacgatttgtttggatgaagatgcatgaatacatgttcacatcaaaactaacacggtagctgctaattgggtagccaggccgcaagattgcttatctgtcctcgatcaggaccgaaagcctcgtgccgccgccttgattcatcatggagaacaagaaagcccaagtttaagttttagctgagtcaaaaatatttgtctgactttttctccgatgtttttattttattattttattagacaattatacccttacatggttctactaccatttactaagttggtagtagaatagatctgatcccttagatttaaaaaaaattgctccgattaattctattatcaatagagagcactggagaatcactcttgtgcattatttgtagaattttaattatcgtcgattacctatcatggggtttgcaacaagataattcccatctttatttaaatttggtgcaattgtttttctggaactttgatgtttaacacgtaatgccactgatcaactttatttcaaattcactaggaccttgtagatgactaatcattgcaccattctccatttagcattcgaatagttaataatgtggtactgtcatttgtaccgtggagattgaagcttgtggagcagctgaaattcagtttatgaaacaatgcttctgtccaagcttgtgacgaccaaggtgttatttgtagttatctgtacaatgaagattgaatcggaatttattaacaattcttgtgcttgcattgcttcatcataattcgccttcttttgcatgatcataatgttactcatgtctctgtatgccatgagttaacttttttgtttagctaagtggtattccgattagaggggcactattttatttcttaccgtgatattttattcaactattttttattgttcttgttatttaattaggaacactataaagatgtgatataattattgtgtattaatgtttttgatacaacaaacatacacccgatgattatctaacatcattgttcttggtgtgttttgaattcataaatatattttcttcttccattgcaacgcaggggcacccactagtaacttaaaacaaaaggaagtaactttatcatgacattaaaagtagattcgttatggaggtaaaaacatgagtctatctagaaattaaatttaatcagcaaaaattatggaattgactaaaaataataataaaataaacaactcacaacattatgaatatataagaagtaatttaatcaaatcgaaaagtaatttatatatatgataaaaataacttacatatataataaaagtaatttacaatgtagatatttcttttctcaaaatatagtaatgtaagatcttgttgtaaagatttaattgcaacaaacacaatggtgtaatcggattataaatcgaataagtaatttaaaagaaaattctataagaagaaaaaaaatacatgtatcgcttggtgtattagagcatctccaacatagcctctaaacatagccctcaaacaatttttaagagttaagaccaaaaactgttttgagagttaagaccaaaaactaagatccaacaggacccttactaaaacccccaaaataggaaggcacacaaataatctccttaggtccccagtgctggggctcatttgtggacccatggtggagaagcgcgggagaaaattcccgctcttccccctttttctctcccgcgtgttgtctctggcggcgatcgcaccccaggtgcccctcgtccatggcgccctctccgacgatgtcccccactgtccagatcaggtttcagatttttgtgaagtgttttattttgttcttgagcactatacttggaaattatcactgttaattatcaaatgaagtacaattcatttatcgattgtgattaatagaatatagcctactcagtttgcattatctgaacatggaaatatgaatgatttttacaaccttaaggacagtatcactgtttctttctttgcgatccatctaaattttgaatataaactatagcatagttaacaggaattatgatccatgtgtcctttactagtaggatatgtcattaccacgtttggcctttggagtcctttttgttaattatttctgcaataatttatattactttcatatttgttatttataatcgaaccattcatacttgtttcatacttgtaggatgtgttatttttaatttatataatggatcattggattcacatagtccattttttatgagcaattttcattttcattggtgaattataaatcttggttgcatgttgttgtatatggcactgtgcccacaccatatttccatgtttgaaaattttaattactagtaatatgcccgtgctaacgctatgataatattttatgtagttcaaatattgcacatccaaatcgccagaaaaatgcttccacattccgttgttcttaatacaaaatgtaatacacataaaccacaataaccacttgatggtttgataactatacatctctgggaatcgcatgggaggggtaacaaatctagttaagtagcaaggaattcgggaggggttacaaatctagttaagtagcaaggaattctctcaataataatctattatacgcatactatgaccactgattcagaaaaatattatccagatccccacaaaacctccacaattctgattgatccaatatgtaggagagtaataaggtatctacagccattgcatgcttcagatttatttaacagcccaatagcccattatgcacttcattgtgttgaacttgaaatgccttgcttgtgctacagagaggtgaaacgaaaggtgtttcaaaacaaagaaaaatgctaggccttgatcagcataaattagttcatttaaattttagcttgctcaatgttttacatggcaaagagtcagcataaacaccaacattaaacaacaccatatcttaaggggaatcatgcttgatcatcaagtggggaataatacaactattgacaatcctgccaattaggtacaacacaaaatcatgcaaatcagtgtatcatatttcaaaacgataagttgaccaaatcatgtaataccagtcaaagtacacaccatgcagtcaagctgacctcaccgccccagaggtcgtcgcctccccagcacttcaccaggacagccccttcatgtgccctacgaggctaagaccatgatgtaggcatccacctctgttgtcattggctaccttgtaaataacactcactgtagctcaatagatgccaaaccacactgttaaacataaacatgaggcacatgattttttttgatagaaaattggaaaagaaaacattccgaaatagcacaaattatttgtactgataaatcgaagattatttgaaaagtacatagaagtaaggaatgcactggaaaagaacaacatcatctcaaatatgggacctgatcacttaacatgatatcaaatcgagcagttcatgagcagaaagatttcgatgagcaagagcagtgaaatagcacgccaaagtccagaaattacatctgtacatgctactatcagcatgtataccactgtaaattcagacagtacatgctactctgaacatgtccatatgctgtcaaaatgctgaatatgactgaaattctgaaaccaacgacatgggatcaagtctcaacccatcgtcaatagagctccgacattaagataaaatccatacatatataaccctaaaaactaatgctaccctcagcccggtatactgaaaaatagttacctttaatatatgatgcatcaaccctcactccattctccagcaaaaagcatcagccacaaccatggttccacagatcattgtctgctgcacgttgtcccaggtttttttaccaggctgcattctatcttttgaaagaaatattatgtacagtggaaaattactatagacaagtaattttacctctgttcattggtgattttaccgtatgctatatacaagtaatctccaatatgggatctttcatgatatgcaaacctgaacaattaaaaatcaacagcttcccaatcagctcctagaaaccacagttcacaatagtacactgaaacaacacaaaacatgaattgtaaacgtaaacgtgggactcagggaagtggacataaactattttcctaggataagatgcatagattattttcagttttgtttgcctgtttcactttttttacatggcatagtctcagcatattttccaatcagcactatcgtatatagtcatgcatctgaattttttaaaaaatgacctctatggtattgatatatgctataacaggcatataacacctgaatagttaacgcaatcgtaggacagagctaattctgtacccctgtacccttatcaatttgaaaacaagtgatttttttaagggtgacaacaagttacagcgctggttatatacttgtgatactccatgcaaaaaaaatgaagagaatggcacctaatttatacacttgtcctcatccatacaaaaaatgaagagaatgccatataatttctcccaagaaagtaaaattaatccaaggaaccatattctggttaaatattactaactaccaagacagtgatattaatccaaggaatttgagtttttttgacaaaatttattctgcaaatatatgttgagaacacagtattcatgattcattctgtaaccaccattaaatctaattgtcatagtcattaaggtgagtcagtgtaggtgctgtttttacttcctagcagtatggttttgagtatgactaacattatggtttttaaagcatgattggaaattgcaacaattaaataatggaaactttttgggctgcatgagtttctagactgaactgaattttaagcaagggtaagcaattttcccttgcttcaacaaatttgttccattagaaattactaagagggaatcgattgcataattgtctacaaattgcattaaaaataagaagggtgatcagatgccctttcttttcttaacatttcctcttatttttctccttccctgagagcacatgggaattcttttcccatgattttacaaaagtacagttatgagattccgtaaaaaatgaaaacgtaaaatgatctagattaaatcaaaatacccatccaaacatgccaaaaagaaaatcaaactttaaagattcgtatgcccaaagaatctaatcactgataaccttgtgaaaagaagttgtttattatggaataaaccagctgcaatgcgagcgatatacgtagggtaaaaaatattaaactcacaggtgtaactgtaatggcatatcagtgaccaatcctagagaaaagacacgtgagcttcacccatgatcatcaacaagtaaagattgcaattgttcacagttggttcatgctgtaaacaagaatctatagaaattgtcgttgtccacgagctataacacacaagctatcatactacgagatgacagatatgagatatgcacaacattttaatatcgatgaatcgcctcgctggctcgctgctgcaatttataaacccttcccgcaaaaaaaaaagggtgattagaacaaatagccgcgaacaataaaaatagcaaacagacatgaatcagtctattaacgtaaacttaccggagcgaagactacacgcggtgatcaggatgccggtggatgacgctcagtgacggagatcgagggcaaagaagtcggaggtggcagcgatgaagtcgtcgacgacgggcagcgaatcttcgacgacgatttgtgagcgacgacggcgaatcgtgggcggcggcgcagaggagatcggtgaggcggcgcctatctggatgctggtgcgagcgcgggggttcgttcccatcgatccggcggcggcgcaggtggagctgctgcggggggtttgggattgggggtcggcgcgacgcggggagagcgagggtgcggcgatgatggcggatgcggtttccgtgggattgggatatgggagcggtgcggcgattccgtgggatgggagcgacgcgcggtgggaggtcagggaggtatggttcgatcattttcgtccgttagatttgatgaatgaagtatgaagaatgtaagacccagtaggtggattataaggtagactagtagcatgcccgtgctaacgccacggtaatcttttgtactacttgcaaatttctagctgtattcaccaaattaattagcatttttttctcacacatatatgagaggtatcggagacatctctgaattttattgccaccatttgtttatctgttcacattattttcttgtgatcagggtatcagacctttttttagacaaaaggctttcgcccagctttactaaaagcacgagtatgatacatgtattgttggggtttcaagcttaacttgcaacagcatcggacaaaggcaaagttgttggctcagcaaataggcagaacaagccagtctgagttacagaacaaaggaacaagctaacctaagctatctctctagggaacgttccatctcggcacaaaaatgatagcaaacagttgcagaaccgctggatagctaacctaagctatctctctagggaacattccatctcggcacaaaaatgatagcaaacagttgcagaaccgctggatacttatagctagttggaaaatccatcttcttgatcattagttgagacttgatcctcacatctcgtgaattttggcaagcaagaatccctttaaagcatccaagtaccctgccagtttcgaagggatgaaaggtctccattgttgcaaaagggaaacaactctataaggcaaatgcaatatctgaaagcaatttgtttttaacacccaatcatttcgggttagcgaaatggcccatgttcctacagagaacaaatacaagaaggtaatattctgattttgttttcaggatattgcagcatggacatgacctcaattctagaatttgggattctatctcttgcacatctctaaaatagcaactgcaggaactttgcttgagcacatttgaacattaagtgatcaggctatattgcataatatatttgaacattaagggtgatgtcttgcacttgttgctctgtacaacagattttggagaatggaattgtcgagctgtgaagtccatgaaggcagaggttccagatttggtctgtacagaaggattcatctcaacacagtgcaaattaggagtcaaaaaaaacatcatgacagaatacctgttcaagtggggaggcaatgtccattgtgttcaagcagaaggcacgactggcttcgtcgatggcatgccatcaaaaactgacacatgatgtgatactccatagaacttaagtggaaaataaatagctagaaggatgcaaaggtcatccctcgcaattgcttattgaagcgtatacttaatgggaaatgcaatctgaatcatatttttctatacagtgcactccaagtaagatgtgaaactgtaagtaaagaaatttgctgccaaagcgttgtactcgtacataagaataacaaatggccttgttttctcataactgcaaaacagattttaatttaaagaaaaatggagaaatcatagatcttcaattcctgttttgtaagctaaatttgagactatttgagttttccctcgggagaaaatgcaagcatacctacctacaaatcaacaatcatgaaaataaattaagattagcatattaatttattatatttggcttaaacacacaatcatattcagtcgtaaacctttatctgactttcatgcacaatactccaattgataagatgattaagccaagatgctactgtagtattgccacatgcttgtctacgtgggtcataagctcctaagacaagcatacgacatggattcccaaattaccactctaaattgacacttgccatcttcttcacccctttattccatggatggcaaccgtatactttcagggtgacaagatgcatccatactgatgaaccatatcacaaacatacatgcatcccccacgttatcagatctttaagaaagaaaaattttgatgtgaacatacaagcagtaggatcatagtcagttaaacatattattcatgcactaccatatcctttttcgcgaacgcatgcactaccatatcctgctatgtctatctccccaatggccagacatccaatctaagctagacatattcttcagagttaagaaccaacaaatttgcagtaaaactgcccagagtgctaaacaaatcatggatgtcacactgatgcaattaatccaacatctttaattgtgccaatttaaattattgagagagattaccctgtggttcaatatattaccaacgcattacacaagtagtaattggtatggctctgactgatcgggttagcctccaggaatcagcacaattccccgccgtcatgcatgaaaagataaacacaagctggatgtcaaaaggaaaccaaaccaatccacctcagaaccaaatctgaattcatgaactcacatattccagtcacactttgaggtagcggagatccttcttgtagaggtcgtcgtctggtcgtagatcaccaccagccgacttgagcaatcccctcctgtcggaagcagacaaggccagcaatgagcagcaaagcttgcggaaaccacagataaatccctaaaatgccaaaatccttcggctcaaccaactggtatgaattaaccggactaagagaggaatttattgcttactctagccatggttggagcggatcttcggcgctgtactcgtcgattgcctcgatcattttcctgaataggtagatcaatcaaacaatagacaaagaaaatcacgagacgaatcccctcccggcctccccgactcaagaaatccggagcaaaccaaaccaaaatcgagaaccaagagaagcggcggcggcggcggtgggagtcgcggaggagatcggcgcggtggagaggcgggggacggtggtcaatccgggcgacggtgaactggcggcgcggaatcgggtgacattgcggtgaggcggaggcggggtacggtgatggggatcggagactgccagatccagagggtctcaccgtggatgtgggcggcgcgacgagcggcgcactcggcgccggcgggggttgaagacgcgacggggaggggtgagggcgtgatgtgtgggggggtttggcaggggagcgcggaaacagaggccgtgatgagcgatcgcacccggaagagaggtagagctgatctcgatcgttcgatcggggtagaggaatatgagccgttggatttgatgaatgaagtgtgaaggatgtaagaggtagttggtgaattataggatagatgaagtatgaaggatgtaagacccagttggtgaattatagggtagatagatgaatttgaattgtggtgtttgaaattgttgatgagggcatcatccactattacccgctggcaaagacgcaataaggggccaagttgtctagttgtagtcgggcggcgaccgtgtgaacctctgaataatctcaccttgcttagcttgggaggaggaagccactttaaaagggagagccacccctcccctattggactaatcttttagggagattggcctttccccgagtgggtgtgcctaagaactgttggggcaaccttaatatattgggtctcggcaactgttggggcaaccttaatttattggagccaaccccataatttattgggcctcggccaaccccacctggggcggatgtatcatttggtatcaaagctgggccctcagccaaccccacctgggcctgggccagatgtatcatttggtatcagagcagagttaggccattgtatcatttggtatcagagctgggccctcggccaaccccacctgggccaacttcgtggttttagccgtgaaacaccgcacgaactcacgtttttggggaaaacactctataaaagtagtaatttgccagcggacaccgcgccgattaaaatagtgtatccgtgatgacgaagttttagtgggcccgatattttacgcggagtgaccaaaatgcccctgtgccttacccagtagcgtgctattgccaatttgccatctcctgtgccgccgccgtcgtcatctccttcatatcgagggtcaacagcttgtccatcactgtaccacctctgcagctacagtccatgccgttgtctttcgctgtaccaccaccgcagcatcatcagcaaacaccaccaccgattcagcttcagcaccacataataccaatgatgccacagtcccagctccaactacatccacagagcaaggaggccaacaccattcaagcgccgccactagagtagtacgacacgaggacatctagtggcggcggcgtgtcgtcattgaggttgccgaagtgggaaaacatcaagaaggagagaaacaagaaacatctcaaggacacctagacatgcccctactaccatcagcttgacgctgatgcagatatacctatcaaaagtacattgttctttacttgcagatcagaatataaggtgaactcgtttctctctaagtctatgcgtgaaatatatgagaatttgatgctacataatattttgcacttgattactttcagacatgagagatttggaccattggctggcataaacaacatggggtccagccgaaggtgacgggtgtagcagcgcacatgtggaagatcggatgctattctgttcgtgaagttcatggcgaattctgcattgatgagaaggctttcaacatgaatggcttatatattaggaaaggttatcaagtctactttccatcaaatcaaacggcatgtcattccgagctttctaccaacggcaattgcaagttgaagacatcctgtgcgggcagaccgggtgacgcgcaagtaacaacaatggtgatgagcgtcggctttgcacggcatggttggatagagttatactatcatatggcccatcttgggttgggaaggagtccatctattatttctccatggattgaagctttccaaaaccaggagtttcaagataagaaaggaaagattcagttcggactcggtttgggccagcctgaatataatggactaaaacgcttgtttctctctcgtccggagtccgttttggacgtgtgagcactcgttggaaagctaacttcatggcccacgtggtggatagggcccacgacacaaattccttctggtttcaccgcaagagccgaaacaaattgacggtgctgtagagaaatttccatattgtgatgtatttgattcttagttagtttctaacccatgtaatggctatatatgcctttgtgcacgacccatgagggggacaacatttattctaatgaaaattgcagcaaatttgctcttgttcttctcctaggttttgtgccgccgccgccaaactagagagagggattgggagttctgccatagattgttcttacttttccttgcagggaattgagggggcaatagattcacttttgcgtggttaagtggatcaacctatcaaagcgtgtggttttgcgaattcatggtgaaaggtgtgttgcacgggcaacgtgttgttcatccagttcgtgaggttttacggtgtttccggatcctacgtcgagaaggtcgggctttcccccgtatcagacgcgctctatcggctgcagcatggccaacgccgcctcgtcagctccagcgaccaccaccgtgcttaccgcggcgctgcacgtggagcacggtaaaaacaacggcaatgcgaatgggtgggcgagtgctaacaacaacggcagtagctccccggacacgagaaggttaatggatgaacgttcgccaactacttcattcgcgaatggcgccacggagaagggatcgcaacggaggagaagtcggaagggagcaatattattcctcccattccaattttcggttttcctctttttacgtggtcctttatcctttttgtttcactacctttttctttttcagatttctttttttaattccttttattgtttctttaacagaaatatttttatatgaattatttcatgaaaactttctatatatacatatagattatgtatgtaagtttttatatgtagattttatgtacataaagtttctatatgtagattatatatatatataaatttctatatgtaaactttatatagaaataaaaaaatgttgatcatcaccgaattattttttttttaaaaaagtccaatccaaacaaattgtaacaagaaaacataaagcatgcgtgtacttagtattttaaccgaagaaacaaactaccggcacgttagtcattactaatcacgattaagcatgtaattaggcatgtaattagttatgaggaagaagagatgaaacggcacttggaacattcgtgagatactactagatgctaatcacgtgcatgcatatatgcagcggagaagcgagaactgttggagtccgttcgcttgtcgcgaacgctcgcgaatcagactcaccccgccagcggcaatggcaacgtcgtggcggcgacaattaataacaacataatctctattacttaaaaaatccgtagtgatgatggtgaagccaatatacacgtgtgatacaacgctcaaacatcctcgataaaaaaaacggaggggcgcactcctccgcaccaccattgtgcgactggatcacgatccggaatcacccaagaaaaacggcgccccgcaatccggaatcagatcacttccgcaacgctctcatcctgcagactcgcacacgtttcctctcccgagcgatgtaagatccgccttcctctcaaccgctgctgcgatcttctccgtatcaactgcatgcagccaccgccgatctgtcgtcctgacgccgccttcgtcctccttcctccccctcaatgagcgcctcctcgatcccttccacctcaagcgcagccatcgccgtctctccctcccgagtcccgacgaagctcacctctgcctctaccactgtccccgacccaacccgctccctcccccatccagcgccacaacaccctccaaagtccaaacaagccatcaaaacgaatctctccgcctacgccccagcttacgccctccgccgatgctccttcctgtgtgcaccctgcgtcatcgccgccccttcctccgtgtgcactacaccgcccacccccatcgcccagcgaccacctcctggtgtggcaagcatggacgcgaccagccaagcttgaagtggcggtggcagcgacgtactgacgacactaccggatgtatgtcatttaaaggcatttggtggaaggcatttctttaaaactgcctcaaatcatctcttttaaaggcaattttcataaaatgccaaaaaaatattcctatacatggcaaatttaattaatgccttcaatacttttatcattagaaggcgttttaaagaaaaacgcctcaaaaactatgtgctttcaaggcattttcattagcgccttagaaaatctcctatttcaagcgtaatcacggaacgccgtaaattttatgttatttgggggcattttgcaaaatcgccagggcaacagatagaaggcactttcgagagaaatgcctcctaatctatgtcacatatgcaaaaagaaccctaaaagaatttaaggtatagaaattagtcctttcaccactcaatcaccaatcacgcggacgctaccatatccgatccctagctttctcagatcagatcgagcgaaaaaaaattggcaaagcgcgcgactcctggccgccgcccggccggtgacttgccgccggcgaccgcaccgcaccccgccctcccgtcgcccgtcccgtcgtgccgccgtcgacggtcgaccggcgcccatcgccgcatcagcgcatcgcgttgcgagcgtcctgcgccccagccgcccggtgacctcgtgggggtgacttgccgccggcgagagccctgcgccccgcccgtcgcgccgtgacaccgtcgacagtcgaccgtcacccgttgctccatcgcggctccacacacaagcgctgcgattccccatcgccgcttcaagccctaggcccctacatcgcgatctgtcgctgcctcagacaaggacgatcgtcggcctactgcagcaagtacaaggtatgttcctatcgctacccacccttctcacctcaatcgtgataggatttgagaaatttgcttgatctattggttaggagatgtttggtgttgtgtagatgttttagattagacctaaatagaatctgatctaatcatagtgacctcaatggcgatttatagtgtgtgttattgaaagggtcaattaggcctagggggggggggtgaataggctaagtttaaaactttatgcggaagctaaaactgagatagggtcggaaagtctgatccacagtcagactatctgaaaatatcagatagtctgatgttggatcagactgtctgatccactaaagagatacaccaagcaaatctagcacacaaacaagagtagtgcaaacagcgactagatctatagcggcacaattaagcaaagctaaagagaggatgaagagatatcaccaacgatgaagttcacggagttgttcccggagttcaaatccttgaggggattctactctccgttgaggagcccactaagagccgggtctttgctaacccttttctcaagaggttgcactaagcactcctccttccactaagggatatctctttccttgcggaggcgagatccggccttcacaaacttctcccggccaaccacacgtagatcggtggctcgggagtgacacctagccttctaggagtcctcaacctccaagagtaacaaacaccacacaactcttggtcaaaccctagtgctcaagatcgagtgaaacacacattaggccctcaaacaccaaattcacaaccaccaagatccacaacacaaagaacgaggactttcagttattattggttggatcctaggattcacactggaattttggtcctatgtgcagaactgaacttttgaaatatcagagtgcaagcatttgaatgtataaatccatttgctagatacatattactggaacttcatttgatatactttgcgcagtttgtagatacatgcctacatataaattctctgaaatgctctgacatttttatatagactttggctgtaatataaattctctgaaatttgtatgtcttgattcttaaattgctgtgataagttcttttctaggaagtacagtactgaattgtgggttgtacaatacttaaattataaaatcatccctagtatatttttgaattaatccatgagttgtttcgaagagctgtagctgtacaatctgatctatatagtaaaaaaaatgttctactcttgatttagaccatatgctctgatatagatgacctaatatactgcctatatatgcatataagttcagaaacttctgtagattgttctgaaaatctgagactgcagtagtgcttgttctgaactttggttttcaatatagtatagatttggttttcaatttttgacatttcccagaacaatggctgcagtataaattatctgaaatggatattttcaattctctgaaatggctgtagcactgaaatctgaatagtaggatttgttctgggttctctgaaatctgaatatatatagcccgctcaaaaaaatatatagcttgctcgatagggattaacatgcttatatttacttcagtctttcctgtaagcaaaattcataacccaaacaacctaagtctttcctgctgatttcatatgtgttgttgctatgcatgatatcaaggcaaagaagtctttcctgctgatttcatttgtgttgttgctatgcatgatatcaaggcaaagcctctttttaggctggttgcctgattgtaatggtttgataagagtatactggacgtttctttttctttacacttttgtattctttaacagagcacaaaacataattggaacatcatggataaagggtggatgaaagcatcgagatctagtattgaatataatatcggggttaataaatttatagacttcgccttgtccactatattccacggtactagacaattttcctaattcatagtttgttactccaaggttgcaaaaatttagatgctaaatattatttgtacccaattctaggtgttaactgctgttagacacatctcatctgaccaatgagacatatctgcaccaaggagacaaatacatgatctaacatacaaggagaacataggacatgaagatgtacattctaggacaagtagtcttggaaaagccagcgctggtttttaagtgctatcaagttcagtaatagccaagtgctaacaacttcacggttctagcttatgaaagtaagtctcctatcccaagttcgaatgtcttttctcaagaccatggcaacaactctgttgtttcataataagaaatagaactactgatttggatatattatttttttactaggatttaagtggatttgtaattgtaaaatgtagcaactcaattgtagttgtttatattttgcaatgtagaagttttagaaagttgtgaagtcacaagttgcagttaaggtgaatagtcatctatgttatttcttgatctatgattccttttatggcatattggcatattggcatattatgctcatttgtttctttcccttagaacttttatggacaattataatttctgcagatacctcatttgacttgtaaatgtaatacagatgtgcagatctgcacttgtatttgcagatagcctgtctatttcaaatgaattcgtatgttgcacttgtattacaggctatctgaacatcctatttgaattcgtattttgcaggggaagcatattattttcgctgtatggttttcttcacatggcttgcaagtgcaacatagcaccaataagaattcgaagctatactatcaagattttgtacaaagtgcaatatagacacttgtgattgtgtgatcatcatatgctggaggatgaaaacaaattgcactttacagtagcatcatgtcattcttgttgattatagttttgtcctgtgactgagaaatcatcgttgttattagttttttatcataaatttgatttctctatttgagttgcaatctcatattggtatgctcacaatttgtatgcgagcacattgtggaaaagaccactaattactaatgatgcaatgaacgccatggatcttcttgctggcattttaaaaaatgcccccaatctgctagctggcgtattgaaaaatgccttcatatctcctgggtggcattatgagaaatgccactgaatacctaagtaggcatttttggaaacgcctcctaaatatctttggaggcgttttctaaaactgcctcaaatcacttttcccgtcgacagtatatttggcactttttaaaatgccttgaaagatcatttgaggcgtttaatcaggcatttaaggcgttttgaaatgcctgctaagctatgtcatcctgtagtgcgaacgcctcgccggcagccgtcgcccccacgcatctttccaggttgtcgtcgtcgccgctgctccttatgcccgcgtccaccatgctgcctcgatctcctcctccatccccggtgcccaacccttccctccagtcgaccctccccatccccggcgccgtcgtccgctactaggggcggatctacagtataagcgtcggtgtcaggcgacaccgacgactttcggcaaaacatataacaaaactgcttatctatatactataacactatgttctaagtataattagcatactatgacaccgatagatacgttatgacaccaacaaactgattttctggatccgccactgtccgccacccatctcctcctcctcgctgcacccaagtcaaacatctcgatgagcgggatcatgtggatggggctctccatctcggtgacggcggtgagatcctgcggtggcttctcctgaaggagcttgcggagaaggtgcatctcgagctcgatgccttcggccacgatcaccatgaccacaactacgaccaccaccatggctacgacaacttacagctcgagttctccccttgggttaggctttttttttttggggtttaaatgtttaatttaggctatcctgggcgaaatgtcgatttatgtttgattcattttcgcgtgattgagaaatttgggggatttgattggtacgtggctcagtgccatgggatgctcgcttctggtcagcatggcgtcgcccgtctgtctcgtcctgctcccagtaatcttctgttctgtgagtgtcccccaattgaatgtttgcttttttttttcttctgattatatgtgtgcgctcacgttctgtttctctcatttgcattttacagtccaggggaaaccatcaaagaccatggtggattgccttgccaccttcgtggtaagtatgtaattttcagtggttaaaagtttttattagtacaaaacccaaactagcaaaaacagatcattgactacaatttactcgagtctgaatgtatttgtctgctatggtaccagaaccagcatagtataccaatgggtaatgcagtttgaaattacagtacagcaaggtaatttaggtggttgttgaattccttaattgtagactaacaaatggccacatctatactaactgaatatcacgtcacatctgtgttaatatatattttatattgtgattgggtaaaaaaaagagctttacgtaaggaattagatggtgaggctgactttgaatggatcaagtactgtggtttttatttgtacattttttgtgattttcttttgctatggcgtccatttgggtgcagatttgagtcttattgttcggattagattgttcaaaatggatattccaaatggataggttgattgggattattggaaatgtaggaagagatgcagtttcagatcaagctaatcctgaaaattccacgaggtatgatttacgtctttacaaattttagacaaattgacactctcttcgttatatttttcctgtgcaggtcatgagacattgcacaatttggttgatgaagccctcttgctaaaggtattgcataatcaaatcaagatgcaccttgattttttttttgcataagaactttaattgttcctaaaaaagccatgaagttacaagcttacgactttggtttttttatcaatgaaaatcattctatgaatatgtcaacgtgtatttcattgccattaattatttcatttttcctttaagctgagatattgttcaattttggagctctagacaatgaaaccatggcttcatatccttgaaaaaactctatcggttgaatccagtaaaaatgtgttttctctggcattttaaatattgcaatgttctgatgacttttagttactaatatatgatgcataattctatgcccggttctgttatttctttttatttggacgtaacttgcttgaatgatttgatgtggctaaggagaaaatttctaaggccctgtttggtttctcaggaggccaggagttggagccatgcaaacttgccttatgctaatgtcttcgggagctttaagattaggccctgctgcattgatcaaattaagcaggtcagttgaggctctaaatttgcttgcaatccagaaggtttccaccaattatagtgataaagcatcaaactcttatgatcaatgtttctttgttccgagcttactgccatagtatgttaaataaatatgctgcgatgatttaattatccaatcctgcgagccgacggacgcgccaccgccgcctgcaaatcctacccctccgcccgtgcccctacccccacccgcactcccgcatccgtccctccacctccgtccgcactgcccatgcctccatcctccaagccccctaacctataataagaaggttaagttagtttctcattgtttcatattagactgtccaagccccctcccctataaaaaatgtcaagtcagtttctcattgttttatatttggctgtattagttatgttttggtttagtttgattcatagcaaaatgcagtatgcatgctggactttgcaaatcctaattgtagacagcaaaataatgtatggactgttatttggtcttctatgttacaaaaaaaacccaaatattgtgcacctcatacgatatattatgcttgctaggtaactaatagcactggaaactgaaggttagtatgcatgatttggttaatagtgacctgtaattataaatggaacatgtatgctcaagctagatgagtgcgctgcataatctttgctgcagtaaattatttatgcccggtcttaaatcaaatgaataatatgttaaggctgaaaactaaaaccgatatgtgaaatataatttctggagtcatatgcgtagaaaatattccacatatataataccttattcatattaccttgctatttttaacatagagcaaaactttcagtaactgaatttgcgtgatggcattaaaaatgtgttgcacaattcagggtgatgagacaatacacttttttttgtgctgttactgtattgtatttatgctcccttcactaagaaatgtaagacatggattgtcatggtattctccataattgaacttgtctagatattgtgtagttctttatgcatcaggtggtattgcaaaaagagaaaaacataattaattcttcaggatctatgatgctgaattggttagtccatgttttgcactgttattatcactgatatggaattgttctctcagaactcttagggatcatccgaagattgaatttgaaagagcagtggactgatgtgctacctcactttattacttttgcatgctctaagatcaacaatctctcatgatagatagcatatcgcgtaatgctggagatgtggatggagataagtacattcattacagatgaactcgtggcagaaatttcttgatggaaattttacatttatcagaacggtttgtatgcaaattatgtggcaaaaattaacagatgtttgatacatgtctttaatgtactgtatttgatcatttcaattcagtctctatcctttgatttaaaaatgtagtattcatctgtaatctatggagataattttcattttgtaatatataatagtttgttctctgtatatagatcatgattttttatgatgtccagaagattgttacatgtgaataggaaaaaaagggaaatgtcctgttgtttggagtgaattggtgatggttcatgacaatgccaatatatttttacgggagatatgtgatggggagatatgcagctcatccatgacaaataccatatctgggtatgtttgatgttctagattttttgtttgtgctttaattagtatgacatcattaaattttcatagcagtcttctatctatattgtctttttatgatttcataaacaccatgaaattgttttgtacgtcagaaagcttgcactctgattgtagtggtaacaggtttcttgaattggaattaatctacataacaattttgatttgtagtctctttgatttgccagatttttttcaatgttcaacaaattttcacccaatgattatttaacatctttttacttgatataatttgaaattggtactccctccgtttcaaaatgtttgaaaccgacatgtttgaccgttcgtcttatctaaaaaatttgtgaaatatgtaaaatacatgaaagtatatttaacaatgaattaaatgatataaaaagaataaataattacttaaattttttgaataaaacgaatggtcaaacacgtactaaaaagttgaacggtgtcaaacattttgaaacggagggagtatatattatttcccgttgcaatgcacgggcacccaactagttagttaaaaacgcattgcatcaactcgtgctgcgtacttgtgcgtgcacatgagcatgcaagtaagcatcgttgtctatttgtctgtacaatccgttctaatcgaacaatgtcacatatcaaatcttgtaattttgggatcaaaacaaaggcagacatagctgttggccatgaaccacaaatacaacaacaacagaatggccgctgccgccgacgacatcggcggtggcaagatgtaggtgcagtacgagacgccccatttccaacggccgtagctgcagaaccagaacgttgtcgtcggccagccaaatgtgggcggcgggcgacggtgctccgatagcactggcaggccctccgcagcctgcagcaacaagtgggacatctttctcggtctgcttccagtgatgacgacaaagacgacgacatatatacacctagaaatatgaggaagcatgggcatttcggtcactgcacgtaaaatatcggtcacttagcgtctcgtcagcacgtatacattattttaatcgacgcggtgtctactggtaaattaccatgtttatggagtgtttcccccaaaaatgagttcgtgcgatgttctacggctaaaaccacaaagtcgtgatgtcctatagcaaaatttgtcttcaaaataaggactattgctggagatgaagtaggtctgagatagtgtgcggtctcacgtccatttccttttgttttccaaaaaaaaatccttccgtgagtgtaagggcgcgtcgtcaggcttactgggcatgtttggattgatgcccaaaatacgcctataagagacaaattcatgggcaaagccaaatttatggcataagtagtgttttaatagaggttaaaaatgtccatttgaattgaagccaaaatatacctataagagataaatttatgggcaaaaccaaatttgtagcataagtagtgttttaatagaggtgtttggtttgctaccctaccacaattttggtagggtaacgtttggcaagaaaacaagttggcgatcagtcgcgcgcccccctccccgcgtgactggacacatgtcgcgcgtggagagggggcggcgacgctccgcgcgggtgaggaagagcgagttttccgttttttttttgttttttttcgtttttccgtttctgttcggttgtttttcctttttttccggttcggttggtttatctttttttttctggtttctcttctgtttttttcccggtttttttaaattttatgaatacaaaatttgtattcgtatgtataccaagtttgtatttgtacgtatacaaagtttatatacgcgtatgcaaagtttgtatacgtgcatataaattttgtatacgttgtgtattttttattttttaatacatatgtatataaagtttgtatttatagtatacaaagtttgtatatgtcctatgtaaacttcgtatacgttatatatatatatatatatatatatatatatatatataaactttgtatatgtgtataaatttatatacattaaaaatatatttatatatatacgtatgtacatactatatatacacacgtatatatacacacgtggtgtatatataataactaatataaatattcgtatttttccggtcgtcacatctaattttcgtctgtctttttctatgcacaatccgattcggttagcaatagccatggaaaaaattgcaaaaaaaaaaatggcggccaccgacaccaccaccaccgccgccgccgccgccggatccgcccatggatgaagccgacgccatcacagccgttgggagggcgctgtcgccgtcgaggccgacggggagagagagagggggagggacggccgtcaccgccgtctccgccgcaccccgccgtcgctgcgccaagccggcgagacgggtaggagaggggaagagggagcgcggccaccgcgaacgccgtcgtcgccgccgttgggacggcgccgtctccgccgaaccccgccgttgccgcgccgagccggcgagaagggagggagatgggaagggaagcggcgccggtggcgggagaggcggctgactggggggaggggaagaga

SEQ ID NO: 69541 - DNA, 31088 bp, Oryza sativa
aatgacttacattgtgaaacggaggaagtagcacattgagtttcaccaaatcagccaaaaaagatccagatcaaagcaagcatttaatatgagacagaacatcacagaatcgaaaaacatgattcagggcaaccagaaaaatagagaaaccatggatggtgaacaaaaggctatcaaaatcaacaagaaagaccagaaaaatgcagaccatctcagatatagagaagagagaatgttaatcaattgagttaagttatatttcaagtttgagatatatcgagggcataagcggtaacataatttaaatgtacattctactatcctggatggttggatgcccacattagcaccactgtaccaccgctaaaccacaaaaagctcaagctcagtatcctaacttcttacactgcggcagttacataaatgactacatttatatactgcaaaaatttcagttttgcaacccgcctgttactcgactacagtatggcaagcgctcaacgcaacctaagcataaaagatacaaacataaaacataaacacgaaaaatctcaacaggagtgcacggtgcttacaatccaattccgggtcttggcgaggcgacgagcaagagcatggatgcagtaggcgacatccgcccgaggcctaccgatggacgtcgccgctgcaatctctgcaacacaaccaccaacccatcaaacaccaaacccaacagagaatggggaaaaccccaacagcaagtaccctccatcccaccgaacaatctcaattctcaaatctgattccacacacactgaactaaattaagcagaaaatcgcaagcgaggatataggagattggcagattggtagtgaggacgaatcaacgtacttcgcaggtggcgctccttgggcgggcactcgacgtggttcgtggccttcacaatcgccacatccagatcctacagaggggaaaagaaaaacatcgcaaactaaaataaatcccaatggatgcgtacaacacagatccaaacgcctccccctcctggactcctcgtcccccagtcggttgcggcaaatcggatgaactgaaccagtttgcgccactggattgggggagggtgcaaaagctcgacgcggaccttgaagtcggagttgagattggcgaggctgacggtggtggtgtccttgagcgcgccgtacgccttgcgccagctctgcagcgccgacattctctgctcctcctcctcctccgctcgctcgctcgccgccgcctgctgccgcctcctcgacttttttttttctctctctctcccccctttgcttctgattatttttttctctcagccctgcggcctgattcgatttccggctacgcgtccgcgagattgctcggtgcacggaacggcaaataaataggaaggcttcgtttttccgatattgccaaatgtgaaggcgcgttggcacttttcatcacaccttctaaagcctgacgagcagaagctataaaaaggatttcttttaaatcgaggagagatgaaactttttaaatactcggatttaaattagaaaatgaatcacttctcgaatttaaaattccaatggccgcctgagacagcgtgtccagatgattggtttgttggattgttgattaattggtggaatctcatattttagactgtaacagagtactaagtagtagtatttttcaagcctaattcgaaggcaataagctagagtcaattcaggccggctgctgctcctatcaaaagcggtagtgtagcagctggtttggttaccaggcagttccatgaaagtgtttaggttggctggtccaacattgtcaaaaaggcccaattaagctacggtttaaaaaatttgggaaaattggaaccatgccattataattttataaaatttgagatatgtcattctaactcacatgtcattgactcatgtaggtcctacatgtcattgagataccaatgacatatcttaaactttgcaaagttataatgacatgtttccaaattacccttaaaactttggttaaacctttcttctgcgcatggcttgactcgtgagcatgcgctaggcatgatagaagaaagaatctcagcacagacaagtcattcatattttatgctgtacagaacgaaaaatgcgtggtggtttggctgtaaagacgattgacaactccagtgtgtcctaacaccggtggtcctaccgcagcagcatgcagcttggtttcttccttggaaaggtttggtaccagagaaaggtagggagaggtgagttgccaccgtgccagttcacaggcacgtctcacctgtgacaaaactgcggattcgtgtggcttggaagatttaactgcatgcacggcgtcggattgacagggactacgagagaggagagtgattcgctgctgattctgaagaggaggggaatgcgggggacggttgcgttctccctttccaagtcggtcggggtagctgggttgtctcgccgggtcccaggctcgccaccgctcaccggacttggatgtgaggacgaagcagacggctggcgttggagtcgaccggcagttggtccgcttgcatatggcacagaaacacactgacacgcattcggcccgttccctcgatgcgtcgttcggaatgggccaaaatcccggccctgtatttggtgatggcctgggatttcagtggacttagcaagtcagaagcctgtgagagcccaataagccctacgctgtggacaaacttctgccgtgcgttttgttatacactcttttctttgccatcgacggtttcaccagtggcgcgacgcgatccgcgtcaggcgcatctgacggatctgcttccttctggaccgaaaattgtgcgcatgtatgctatcccgatgcagcgtcttgctattataactccaatcaaactacgaattctggtagaggccctgacgatctacgtgcgcctcagcgagggccccaaagatcaattctccgccctcgccatccatgtgatggaaaaagtgcaccaaggtccctcaacttgccatcgaattataaaattatcccccaaccacaaaaccggatatccggtgtccctcaactaaccaaaaccggtcataataggtccctcggtggttttaacccggttttatcctatgtggctgctaactcagcgtgggacccacgtgggccccacatgttaggctgccacatcagcgcatactctatttccccctcttctctctgttctctccttccttcctccccctcgctctctgctctcgcacgagcggcaacgcgtgcggccggcgacggtggctcccgagtggcggcgcgcgggctcgccggcctccccgtccccctagtgtggtcggcgatggcggcgtgcggttgcggccatcatgcggaaatcgactcgacgacgccgccatcaagtcgctgccgtcgggcgtcggcgatggcggcgcgcggctgcggccggcgggggaggcggaggaggtatgcgcggacgacctcgccctcgtcgttgatgtcgccaccgatgaagaggtccgcaccgctcaccagttcgcatgcctcgtcgtcgtcgacactcgccactccggtccggccgcggcccagcgaacaagcgacgagaagccggcggcgcggcgcccccgccgcggacgagcgacaagaagccggtggtgtggcgcccccacccgaagccgccgacgacgatgaggccgagcggcgcagagtcgtcgacgccgccgctccccatccaggtcgcgctcagggtcgccgcgctgaaagcggcacatccagcgcctgatgagctgccgcgcctcatgacgttgcagttcctcgccggtcagctctcccctgtcatggtcaaattgcaagggatcgattctcctcaactcgggtacatccaacctgtcgtttgattgcgaatccatgtagacgaagctatccagctgcttggtgggtgtggcgccgccatacgacggcgacgaggctaccgactcaccagtgaactacgacctctcctcatgcgaacacatcctgtctctgaagatgtgcgtcctcgacgccatccatggtttctacatctgggcactcgccgtgctcccatcggcgacgattggacgacacggcggtcattgctgcggccctctcgaatccgcttccaacatcatcctcgtcaccgtatggtacgccgccaccgctcctcctctgcctgacgacgaggctgacttaccgggagacatttttgacaccgggctgaccagcacgtcgcggccgacgacgacgtacacctgcgcgagctccggcagcgtgcgcgcgcgaagagggaggaggtggggacgtcgacagcgagcacacggagagagggaggatgcggcgcgggagcaagccggggctccgagtccgccagagtccacctccacggcgcccggccctgcctccacctccgcggccaccgccgcggcgcccaaccccgccccgcctccacctccgtgcccaccaccgcggcgcccggccccggctccgcctccgcgcccaacgccgcggcgcccacccgcgcggggccgtttcgccggcggcggcgacgcagcgccgtcggtgccattcttgaccggccgctgccctcgtcttctcgcgcgtcacagccgctgccgcctactcctctgtcgcctcgtccccagccgccggccggcttgccccagagaagagaagagaagagaagagtgagagagagagaggaggaagggagaggaaggggaagagagaggctgacgtggcatcctgacatgtggggcctacgtgggtcccacgctgactcagccgccacgtaggataaaatcggatacaaaaccactgaaggacctatagtgaacggtttttataagttgagggatgtcatatatctggttttgcggttgagggacgattttgtaactcgatgacaagttgagggaccttcggtgtactttttcctccatgtgatcgacgaggcgttgcgggggttcgcggcatccaaacacctcagccgcagcccctttcccaatcacctaaggccgacggcctgcatccccttctcctgccttttggagggcgcggtggataacctcgtcatccctaccgcggtcttcaacaaccatagggacgtgtgctatctcaggacagtagcagtgcaaggcacgctaccgtgccttcatcccaatccagcaaggattttggccctaaattcatctctaagtcacacaccctacagtgctagtgaccttaatctcgtgaccttccttcttttacgtgggaccacaatgcaggggaccaagagtgcccagcccaagaaattaattctcgcaactacccttctctcgaactctccacattgctcccgttctccttatcccggttgcgagctcgccgagaagcactctgcctcagccgccgctccggctcccctcttccctccaccagcggctagcgccggctctcctccctccgccgccggcgccggctttacttctccggcagccgcggttgccggctcgcgcgagttcttgaaccccatcgcccacgaggtggtgctcaagatcaccagcttcggtggctgcagcggcctcgtggcggcggcgacgacgggggggcggcgtactcgcgtcggcggcagagggaggaggcggcgccggccgccggtggtgtcggtgacatgggaccgggagtatcgtgactagaggcttgggcagccgcgctcacccacgtggcctgaccccctcgggggggtcaggcccgagggtgacgtggccacccctccctctgtctccccgaggggtcgggccgctcccgtttcggccccgagggctggggcgccccgaccccctgtggtgttggcgccacgtgtgcgggttaggtgagcacagcggcgctcacctaaccgcatttattgcgggttggacgagcgcgccacgccgcatttaatacagcgcagcgcgctcgcttatccggtccgtgaccggtcgcagtatgtgaccagtcacagatcggtcggatcgcgggttaggtggcagcaggcggcctgtcacacgcctcgccccgtcccgtcggaatgatgagagcctccaggcactcgtccctagccggagccggtgtgctaactcctggagttagcacgccagtcccggctagatacattccaggcttcatcgcaaccattgcaaagaagtcattgtatgaagaaggacagacgtgcgacatgctaaactgacacgtggtggacaagaatgaccggtctgtgactggtctgacgccggtcacgtcatcagcagacaaaccgtgctcccacgttgcatctgcttccagcgaagtggaggtaggtatgacccatcccatcggagggtcattcggacagcggccattgcaaatctccgcccattaatggaggaatgacagggtgatcccctgtgtcaggcgagtgacggcgctgggcctcactcaaggacaagctgtgatttagcttccaagcaaaggcgcgagccaagttctgatcaagatagggtggatccccacccaaaagaagggtaggtagaagtggtgcatgtggtatccccttgagatataaaaggaggaccttgcccaccgaagaaagagaggggagatctagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttcttagcggcccgaacctgtctacatcgcccgtgtcttttgcattggctctctcgcgaacattccacagatcgagggtgaagaacctcacttagcgcccccggccgaaccggcaaagggggacctgcgcggtctcccggtgaggagccccacgctccgtcatctggcacgccaggtagggggtgcgtgtgactttttaagccctcgtcctctttcgtgtgccccaagcttctcccgctcagcccaatggccgaacgggcagtggcgcacaacctctctccgagcgctagcggtgacgtcggggagcagaacccgcgccgtcgagctcgtactccaccgcccccctctcgccgaagtcttgggtgggaggaggcgctcgagggggtcgaaagatccgcgacttcgccacccacgggcgatggagaaggacggcgagacggggagcgtcgcctcctcgtctacggcgatggcagcacgccccagggcgcgctccaggctgcgggcgcgctcctgcgtcacccgcccgtcgtccccgatccagagactctagcccgacgttggctggatgacgtggccgacttggtcatgacggcgcagcatcgcctaggcgccggcgggcggtcctccgccaccaaggcctctggcgctgctaccgccggctccgtgtcgtcgaggcggagggcgcggcgagcggcggccgtcaaccgccgttcgtccgccattccctcgtcaacgcctccgacccaagaagatgtgcgtggggggccggatgcccgcctcaatatcgagcgccggcgcaatggtcgtcgtgttgcccacgcaacggagggcgcttcctcgtccggagcgccacttcggcccgggcacgggggccaccccccgtgtccccggttggcggtgtcggctatcgagcctttgtggcgagccttcggaacgtccgttggcccccaaggttccggcccaccatcaccgaaaaatacgacggaagcgtcaaccccgccgagtttctccaggtctacacgaccgggatcgaggccgctgggggtgacgacagggtcatggcgaatttcctccccatggccctgaagggtcaggcgcggggttggctaatgaacttgccacccgcatcggtccactcttgggaggatttgtgccagcagttcactatgaacttccagggcatatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcagggggggcgtgcggcacaaccgcatgctcgagaagatcgcctccaaggagccccagaccaccgcggagctttttcagctcacggaccgtgtggctcgcaaggaggaggcctagacctggaactcctccggttccggtgtggcagcttcggccgcccccgagttcgccgctcggtcagggcggcgggacaggaggaggaagaagaggtcggcccatttcgacgacgagggtcacgtcctcgccgtcgagggcgcttcgcgggccacccgaaaggggaggcttgcgagcgacaaaaagaaggaggctcgcgctcccagcagggaacgcccgaccggcaaatggtgttccgtgcacaacacctccctccacgacctcgcggactgccgcgcggtcaaaagtttggctgagcggacgaggaagtgggaggaggagaggaggcaggagcgccgtgagggcaaggccccggcgcctcccaccggcaaccggcgagatgaggccaggcagaaggccaccgccgaggatgtcgacgataacctggggttccaggagcctgaggccaccatcgccaccgtcgatgggggagcgtgcgctcacgcttctcgccggagcctcaaggccatgaagcgagagcttctggccgcggcccctacccatgaggcgacgcgacgagcgcggtggtcggaggttgccctcaccttcgaccagaccgaccacccgccgtgcgttgcccggggaggacagatcgcgatggtggtttcccccaccgtttgcaatgtgaagttggggcgtgtcctcattgacagaggtgcagccctcaacatcctttcccccgctgcctttgacgccatcaaggccccagggatggtgctccggccgtcccagccgatcatcggtgtgacgccggggcacacttggccgctaggtcatatcgacctcccggtcaccttcggtggttccgctaacttccgcacggagcgggtgaacttcgatgtggcggacctcagtctgccctacaacgcgatcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggtgtccaagcccgcgggtggcgacgagagactcagcacctccgtcccagccgccccgaggcagcggatgatcacatgcgacgaggtctcggtcaaggaggttgccctgggcgacggcccgtccaagaccacacgaatcagtggtcttctggacgacaaataggaagacgtgctcgtctccttcctgcgggcaaacgccgacgtcttcgcctggagaccggcggacatgcccggggtccctagggaggtgattgagcaccgtctcgccgtgcggccaggcgcaaggccgatccggcagaaagtgcagcggcaggccccggaacgtcaagccttcatccgcgaggaggtggcgcgacttctggaggccggattcatccatgaggtcatccatccggaatggctggcgaacccggtcgtcgtccccaaggcgaacggcaagcttcggatgtgcatcgactacaccgacctcaacaaggcatgtcctaaggacccttaccccctgccacgcatagatcagattgtcgactccaccgcggggtgcgaccttttgtgttttctagatgcatactctggttatcatcagattcgcatggctagggagaatgaggaaaaaactgcattcattaccctcataggaacttattgttatacgacaatacctttcgggttaaagaatgcaggtcctacttttcaacgtactactcgaatttctttgggtaaccacgcgcaaccaagagaccttactctcggatctagcggaaactttcgaaagtctccgctccgcccgcataaagctgaaccccgacaagtgcgtgttcggtgtgcctgtgggcaagcttctcgggttcttggtctctgcccgaggcatcgaggccaaccccgagaagatacgagctatagagcggatgcgcccccccagcaagcttagggatgtgcagtgcatcacaggctgcatggccgccctaggtcggttcatatcgaggttgggagagaaggcgctacccctatttaagctcctcaaacgctccgggccgtttacctggacggaggaggccgagcgggccttcactcagttgaaagcgtacctcagttctcccccagtcctggtcgccccggggccagatgagccgttgctactctacctggcggcaaccccgcaggtggtcagcgcggcgttggtcgtggagcgcgacgagaacaaccctcactccgcgcatccccaccctgtgtcgactcgacccgggagagagcagggaggagaggctcccgagccgaacggcggcccgaggcccccgacagccggagctggccctctgcccgcttgtccgacggtgcctgtcgccctccgaccccgaggtcgttggcacagaagccgagtgcgccccgcgtggcctctcggacgaagagcgccctgggaatgcggcccctggcgaagaggatcggccccgccgaaaggtgcagcggcccgtctacttcgtcagcgaggccctccgggacgccaagacccgataccctcaggcccagaagatgctttacgctattctgatggcttcgaggaagttgcgccattatttccaggcgcatcgggtcacagtggttacatcttaccccctcggccaaatcttgcataaccgagagggtactggacgagtggtgaaatgggcaatcgaactctctgagttcgatttgcactttgaaccacgccacgcgatcaagagccaggccctcgccgactttgtggcagagtggaccccagctcccgagcccgtctctgtccccgaggccagctcgggccccgcgcagctgcctcacaccgcctactgggtgatgcagttcgacggctccctgtctcttcagggcgccgggcgggggtcacgttgacctcgccgagcggagacgtcctcagatacctggttcgcctcgactttcgggcaaccaataatatggcggagtacgagggactccttgcggccctcagggtggcagctggactggggatccgccgcctcctggtgttaggcgactcccagctggtcgttaaccaggtctgtaaggagtaccggtgctccgacccgcagatggatgcttacgtgcgccaggtgcggcgtatggagcgccatttcgacgggatagagcttcggcacgtgcccagacgggataacgcggtcgccgacgaactctcaaggctcgcttcttcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcactcccagctcccttagattgatcgcttggatcgctgagatccaggcgtacctcacagataagactctacccgaggaccgcaaagggagtgaacgcgtccagcgcatctccaagcgctacgtgctggtagaagggaccctgtatcggcgcgcggctaacggagtcctcctgaagtgcattcctcgggaacaaggcgtcgagcttctcgccgatattcatgaaggtgagtgcggagcccactccgcctcacgcaccttggttggcaaggcctttcgccagggtttctattggccgacgggccaccatatattgcgagactgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacaacctcgtcctacgccgcgtccaaacgcgtgttggactgagcaagctctcaccaatgtgggagggtccgtatcaagtgatcggcgtcccccggccgggctccgttcggctggccacgggcgatggcacagagttgcctaacccgtggaacatcgaacaccttcgtcgcttctacccctagtgggggtcgggtgtcaggtctcgggctcgggccaaccccgcacccccccgggcgtgcagggttggccgggggctaccacatgcatatacttaccttttttctcttccatatttcaataaaaacattttcgatttcctaaggactgtgtctgtgccattgtttcctttttgaagaatcttggcttgaattagcacgcttgtgctcgatcctgccctcggtggctcgggccgtctaaaatcgccaaaaggggcccagaaccgagccgtgccccggggtgtggtgaactccgggggggaatcggcaaaggcccacaatcgggtcatccataaccctcggtcaccacgctcccggcctggccagtctcgacacatggatctccccaggcactagccccgacccccgccgtttgaggctgggacctgggcacgagcccttgttcaagccaagacacagaaggaccgcggcacagaccatcctcgtctcatacacacaacaaatagaattgacacagaaatttcctctttatttgattgcagattaaattggtctatacaagaagggggcccgaaggcctcggaagaagaaagaaagagctatttaagattggcaggggcctgggggctcacttcgacgcgcccgggtcgccagcctcgtcgtcgctgtcatccacaccaccgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaactcgtccagcgctgcccacggggagaagtcggggtccctggcctggtagcttgccagtacgagctccactgccccccaggcgaggtctctcgaggatgacttgatcgtctcctcgagctcctcggggagccgctggagggtcccagccatctctgagaggcgctgggcgaggcccccctggttggcggcgtacttcgcggtccgctcgccccagaggcccgcctgccgctcggcgcggtctagacgggagacggcgtcccgaagcatgccgggccctacctcgcctgccaagcggagggcctcgacctccccggcggacgagtccagcgcgccctgcagatcggcgatggtatgttcggcggctgcaaggcgggcggctaggtcgccgtcgcccgcggccgccccgccgctgcgcgctctcgcgtccagctcctttgcccgcacctcgggctcagcggcccgccgagccagtgcggccctctcggcgcgggcgccttccagattgcggcgcgcctgctcctcctgcgctgcctcgcggaggaacaggctgtccgccagccgctgcgccgcggcctcggcctcctcgagagctcgctcccgctcggtgagcgtatcctcgcggaggcggagtgcggactcctcttcggcgcaggcggcctcgtgcgccgccagtgttgcctcccggatggcgacagcggcctcgcggtccgccaggtccctctcctttgcgctggcgcgctcttccagcgccgtggcgcgagcctcaagggcctcttcgcgccgccgggacgccgcctcgttctccgccgcccgccgttcccaggcagcggcggcgtcaaggactccccgagcggtgttgagcttcttctctagctccgccgcccggctcccgtattggaggcggaggtcgtcccgtacctcgtcgagcacggcggtggcgatgagagcagtctcccgctcctcctccacctccttggcgatctccgccagctccctccgacgggcctcgagctctgaggcgtgccggcggtgtgccttgcggcccgcctccaccatggcctccaccgagcgtcgcccctcttcgacgcgcgcccacgccgcgtcgagctccgcccgctccgcctgcaggacctccatctgggcgcttaacccgtccaacaccgtggtgttcgcggcggccaaggcctgcgggaggggctccgcgctcggtggggcggcagaaggcagaggggagagccgcctcggtgtgggcgccgcgcggctcggcccgccgatcgacgtgccggactcgggggcgtcccccgaagctggctcgtcccgaacatcgtccgaggggtcggacccgagcggtgtgcccgcggcctcgtcgtgggtggcttcggaagtcgtcgtcgcctcgggcggagtcgggtcgggggcttggtaggccgcctggcgtgcgcgcgccgcctccgcctcccggacggactcctcggcccggcggagtctggcctcctcccgggcggcttcctcagcctggcgaacccggacggcctcccgggcagcttcctcggcttcccggaggcggtccgcggcttctcgccggtcagcttcccgcctccgggcctccgcggccgccgtctcctcggcctcggaccggccggacttggaatggcgggaggggcacgacgggatctcgctgaggcagaagaaaaaccagaggacaaaaagaaacgagtgagtgaaaactcgccttgggagatgggagaatgaatacggccgtggtaggcgcgggaacaaacctgcggggaggtcggttaaacgaccacctcgggggcgagatgaggttcccccggcatgactcggtcccccccatcttgcggagccgtttcttctttcgctccccctcgggctgcgacgtcggcacgacaccctctgggcgcctgctgctggcacgcactgccccgccccctcggggaggagatggggaaggggtaccctcctgcttcctcttcccccgggcgtcggcagggcggctgccccccgggcccccgtcgcggggcccagaagcatgaccccctcccggggtagattgtttccccctgcggctcccgcccgcgccatcgtggcctcggggggctcgctcccccgacgccccgaccgcctacatgatggtcaggatgttggcgcgatctggatcgctgcagagggggaggactccttgggggatgagggatgcctccacggagctgagattcagcacccgttggaccaccatcttgaagtcctcaggggcccagtcccatctgcccccctggtgggtcctcatgtagtcctcggacccggtgtactcccaggcgccccgggcgcgccgctggagcggcgcgatccggcgacgaaggtagtcgccgtacaccatggcccccgtgagcccctgggatcgcagacccgccaggcggtcaagaacggcgtcgtagccgtctcccagatctaccggcgcccgccagctggaggcctgcgccgggggctggctcggaagtcggaggcgcgcttcgtcggcgaggggggtgtagaaccagtcgctcttccagtcgtcccacttcttgcggaggacgcagggaatgtagcggctcagcaccggcccccgcggctggaagtagcagccaccgactaccgacggcggcgacaccggctatacggtgaagaaccaccggaacagccgaagagatgggcacaccccgataaacatctcgcacaggtgcgcgaagatggccaacgtcattaccgcgttgggggtgaggtgcgccatctggagatcataaaactccagaacatccatgaagaaagaagagaatggcgggaccagccctgccattgcgaaagagaggaagaagacggaccgccccgggtagtgtggcgccgggcgtccctcgcccagctcgaccacctcccggccggtggcagattccggcataaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcgagggtagggcacaggaaacgaagagttggagcgcaagtggcgaaggcaaggggaatagtggcgagaggaaggaaacgaatctcttcctcggcgtctttataccctttccaacgctatgcccggctcctcgcttcccgcgcccactatctcgccccctcgtttctcgcgcccacacctccactaattccgctcgcccgtttgcggcgcacgaggcagatgtgcggccgtggcagccgagatgggacatatcgtgcgcgcgttaactacgctcgccgaccaaagcgccatcatcatgtctccaggcgaaacgaatcagctcgtcccgattcgcgcgctgctcgagtaatgtagcggtcgcgaagaggccgctcattattttcagttggttttcccttaccgatgcgcacgatttgcgatggctggctttctgcccgcctgtagagaccggccccacctgtcaccaggcctaaggagtggcgtcacgcccgagcgcttccctcgaggggggcgatcgccctggcataacgccgggggctactgtcggtgacatgggaccgggagtatcgtgactagaggcttgggcagccgcgctcacccacgtggcctgaccccctcgggggggtcgggcccgagggtgacgtggccacccctccctctgtctccccgaggggtcgggccgctcccgtttcggccccgagggctggggcgccccgaccccctgtggtgttggcgccacttgtgcgggttaggtgagcacagcggcgctcacctaaccgcatttattgcgggttggacgagcgcgccacgccgcatttaatacagcgcagcgcgctcgcttatccggtccgtgaccggtcgcaatatgtgaccggtcacagatcggtcggatcgcgggttaggtggcagcaggcggcctgtcacacgcatcgccccgtcccgtcggaacgatgagagcctccaggcactcgtccctagccggagccggtgtgctaactcctggagttagcacgccagtcccggccagatacattccaggcttcatcgcaaccattgcaaagaagtcattgtatgaagaaggacagacgtgcggcatgctaaactgacacgtggtggacaagaatgaccggtctgtgactggtctgacgccggtcacgtcatcagcagacaaaccgtgctcccacgttgcatctgcttccagcgaagtggaggtaggtatgacccatcccatcggagggtcattcggacagcggccattgcaaatctccgcccattaatggaggaatgacagggtgatcccctgtgtcaggcgagtgacggcgctgggcctcactcaaggacaagctgtgatttagcttccaagcaaaggcgcgagccaagttctgatcaagatagggtggatccccacccaaaagaagggtaggtagaagtggtgcatgtggtatccccttgagatataaaaggaggaccttgcccaccgaagaaagagaggggagatccagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttctcagcggcccgaacctgtctacatcgcccgtgtcttgtgcattggctctctcgcgaacattcccagatcgagggtgaagaacctcacttagcgcccccggccgaaccggcaaagggggacctgcgcggtctcccggtgaggagccccacgctccgtcaggtggggttcagtttctgctcaggggtggcagcagcttcagtccgccgccatgcggaggcagggaggggtcggcgcggccaggggcgtggcggtggcagcggcggatctcggtgcgcgtggcggcagagctcggcgttgacctggccaaggcggcgaccgggaggagggcgcgctcctcctcaacgttcttggcggcggctcaagaacgggcagcgtggtcgacgccgccgcctcgcctcggcgttctgtgttcttgatttttcttgtgtgattttgtgtgacttgattttcttttgtgattttgttggtagctcggcgtcggatctcggcacgggagtggaggaatcttttcttggttttgtgtaatgtaatgagatttgatttcttgtgggaatgggggatcctttgtgagtgagatttgggttcttgagatgggtggtagctgctccgacgccattccaatcgatgccgaggccgccatggattttgtcctcatggcggcaaggccgatgccggcgcgggcaaaaggactcggtggcggtaggatgaatcgcaggcgcgggaagggattttttcgtgggcgaatctggaatttctccgagtgctgcgtgcgcgaggtcacgggcggccaagcatcgacgcccacagcgctcgctcctcgtgtttttctggcggcgcgtggattcgaccgagcaaggttgcgcgttgctctgcttggggacgagcaaccaagtttggtcctggttccacgcgacatgtcggacaaaatcctccgtgtcgccccatagcaccggtccagggtagagcactgtgaaaggcctcatctatgataacatcaacgagttgctcatcatgattccactcgctgatcaacgagttacttagtaacgattgtcgatgtagattgcacggatggcattctcaacaactactagttccatagaggtcgtgtcagtcgtggcctacgtgaccaccacaaacaataggggaattgggcttgacgtcggagctagagcattttgtcaaacacatggtgggcgtcaccttggactgcttgtcccaaccgaattttgcaagtcttcggcattcttctggactttggtcatccacgcttctaccaccgtcttgagagatagcaaatcagcgctcgtctgatctgcctccacccgccttcacttgaactcctcaatccgcctcaaaagcgtgtcaaatttatcctcacttgccatggtagcttgtttggtaggcttggtgagctctgacaccagattgctagcaacccaaatcaaccaatctcagcaccaactcaactaacaatctagccgtacaagtagcagcaaagtctagtacataggagatatttggatggggaacaaataggaagatacaagtggtggaaggtgccagaagcttctagaacaagtagtggtaaaagggaggtagggagaaatcgacaagggagcccccgaccacccaagtcgtcaccaccgccaagagcttccgctcgccaattgatttgttcgatgatttcctggaagtgctgctgcttcttatgtatagttgtctcttgggttcgcttggacttcttgaaaagtagatgatccactccaagttgcagcccagctggttcctattccctccgtcccaaaatataaatatttttgaactctgacacggtcttcaaaatgttactttgaccaataatatctataaaattaaggtgttttaaataaaaagagttgcatattatgatagtttgttcaatgataaatctagtaacatcaattttacatgattgattttttatatatttttgctattaatagtcaaagtttaaaatgttttgacgtgtcactatgctaaaatgcttatattttaggacacggagggagtaacacaaagttatattaacttatgttggtgttcaagccccttcctagggatgaagttctccgggatcaagttagttatcatgcaaacaatcacgagaccgttgaaaatttaaggaatacatgaacacatgatcaaataggtaaactacgcaaatatgcactctgttatcaagtgcttaattattccccatttttgtgaaatgatcaaatctgaccatgtatatcacatccatgttgcctgaagatgcggtatatgtaccctctaattcgcctgcgccaaagaaggcccaaaaaagagacgaaggacgtcatcggtaggaaaagccaccggcgaggaaaaaaaacgagagagacgacgacacacgcaccatcagacgaacacggacacagcaacactgtgaacacacacgcacaccgaaacaaacagaataagcggcagcccgaccgcgtccgtcggtgccagaggtatcgatcggccaatcagtcgcggtagcacacgagcagcgcgacgcagcggaagatgatgcggagcctcgcctcgttcccccgcgcgaccctgcagccgccaccgagctggctggcgcccctgcgcttcttcgccccgtggctcctggcgacgacgagctccatggtctccgcgcggcgcgcgctccttcgtcgctggctctctctgccgcgagagcgagtgagctagctagcaactactagcaaatgcgtccgcgcgcgagagccagctaattaaccgggcgctggcatgccaaaaaaacactttgacgacggtgtgggtgcgcgatggagtcggggctgcttgttgatgtgtttatataccgcgcggcgcgcgctagctctgatcgtacgtacacttggacggacgctggaaggttcaatgtaggtcgcgctaggcgctagctaggtgcagttccagtgcagctatcgagctgtacgtacgtgcaatgcgtacgtacgacgccttgaccgtgggtagctcatggtgagttccgtgcaaacgcatgcaccaacctgcaaactttcctggcccgatccagcaaccagatggatcatcgatacgtcggctcgtccatccggcatttaaagtcaaaccgcctggtgcttgattattaacgtccgttcgttttgttcagggaggttagaaacagtccaggatacacgatcggatcctgcagctaatgttgccatccgccatcggccatccgatgccgggtatgccgatacagccgtcaacccgcttgttgttcgtcatcgctgaccaatgcgtcgtatcgcgagccattaattaccttttctttgtaggtttgcgaatacgtcctgtctgcttccatgccttgaccgagcggcaagaatctttttctttcatctgcagtgcagtgcaatcaaccatcgatctgaacgttagtatcagttcgtcagggttgctatgatacacgtctactccctccgtcccaaaaaaaaacaaactctggttttcgtgcccaacgtttgaccgtccgtcttatttttaaaaaatataaaaaaattaaaaagacaagtcacgcataaaatattaatcgcataaaatattaatcatattttatcatctaacaacaacgaaaatacgaattataaaaaaatttcatatgagacggacagtcaaagttggacacggaaacccagagtttgtcttttcttggacggagagagtacacttccatatggttctgaaaatttaaggagcgcaactaatccagtatatatataacaagccaccggccctatccaagttactctttgactggccacacaataatacaatggtcttgtttggatgctccgagctattaaatagccctccagaatcttgctatttagaagtattaaacatagattaccgataaatccgattccataacccctaggctattttgcgagacgaatctaatgatgtatattaatccacgattagcggctgattactgtagcatcactgtagcaaatcatggattaatataccttgttagattcgtctcgtaaaatagcgtaggggttatggaatgggttttatcaataatctacgtttaatactcttaaatagcaagattctgaaaggctattaaatagccctccagatccaaacagggccaatatatcgatgctactcccatgagctaagcacgatccatccattttggacatgcatatgcaggatacatcgcatcaggacgaagttaaaacggctacgggatttggccggcacctcaagtttaacgtacgtcctataccatcgcatcgatcactcgtctacgggacagaatcgctacattggcgcacaagccagttgactgaaaacctcggtgggcacaaacgctaacgttggcataacaaattgtgtgaccacggctctgtgtgtcttttaaaagccggtcaaagaagagcgcttgccgttgttgcaatccagagaaaagtgagaaaactgttactactactaaactggcttatgaactcctagtagtcaactgacagcacactcaagcctctctgcagtctgattattcaaccagcgattcgtgttcaggtgacgtgccatttagtcctgcaaatagagagagacgctactgccagagtgtgctgactggcgagaatttggtagggtttcacatgcatatctacggctgtgtggttagttcgtattccctttcagaaaacaaaggcgaaatgcttgcaagttgcaacctctatagatagattttaaagaaatgcaatccatatcatgtacgtgtctgtaatctgtacaaacaagagcttgttgttaattgttgcaatttgcaaacatgtatgccgggccggccaaagagtaggtcggccaaatttcattaagaaagagagtgtttttatacaggttttgcactttgagtctttgacaagaggctgtcaaagctgaagggagagtgttaaaaaccctcccaaaagataaatttgcaaacatgtaatccagataaattgttaatggctgatgagctcctcattgccaacccgtaacacatttacaatcttctcttgctattcaaccagtggtcattgttcgtattacgtccgatgatttagcccaacaaatagaagaacccaaaatccgctattactctctacagtattggtgctgctactaattaaccggtaagaattaggtagggatacacatgcatcatctacagtatgtggtcgcaaaactgccgacgcctgcgttagtttgtgttattcctttaggtgaggtgcttgcaagttacaaacctctatagactgatttgaaacaaaatgcaatctacgatcatgtacttgtctgcaatctttgcagacatatcaataacacagcagatcattgatgaccagaagttagcctccagatcattaatttgggggaatctgacgatctcagcacatcaggatcttgcaaaaccgaggacagaaactcagatatgtatggccagggccagacagaaccaagttagtgtcaaacaagttggaatgttagccatacgtatagctaaacaaatcccagagcaagattcatgaggcattataggccacaaaatttttagaggcgttgtcccccagatcgatcttgcatcacacttcgtgcaagttgagaaaccgtggcatgtgctctgtggagtacttgcagctacccactctaaaaatattaccagtacatcaaaatgtatgatatattattggtagtttacagctagacaatagaaggcttcttttaaagaaaaggagctagagatttgggcgcttctcctctatataagcacgccaaatgcaacaggcatcaccatgctaagcagaagcacttaagcactaaacacttgtgaaggagggctgtcttttttcttcagaggtgtgatctgatttctccaacagtatgggcaatccaaggagccaagggagaagaggaggcctcggcagaatgttgaaggagcacaaggcgaggctgtacatcatccggcgatgcgttgtcatgcttctctgcaaccgcgactgatcagtgatcatactgatcatcacgcatttttgttgtagtccgggtcctccgggatatggacggacaacttctttttgttctggatttcacttccagaatctagggttaacaattctttgatcgatgtatataatcatgtatggagggctagcatgttattttccaatattttcaccttttaacaccggtgatttcgcactctactttgttagattgacataacagttctctttttgatcgttcagaaactcgatctgttattctggatccttcagaaaaacaaaagtagttcccggatagtgttttatctgaagttctgctacttgtttttctttcactttctgctccaaagaggaaacaagtctccataataattcacacactagtcaccagcaaattagaatactgtcatcaagttgacaatgaatattttgtgcataagttgggaaacaagtttacacactagatactctttgttgtcttgccaacaaagcagtgcaatttgcagcagtggacaacagcaactgaacctgaagcttcaaggcagtagtagtctctagcttgaagaggcttgtagcaccatgttctgtactttcatagttgttccccttcgcatctatccttgtggtcttccttggtactttctgcgtttggatgttacgtttggtgctgttcttttctctaacaagaattgaatgaagattaaaatttttatggtacatttttcaaaccgctaaatggtgtgtttcgtgcaaaagctttttatatgaaagttgctctaaaatatcatattaatctattttttaagtttgtactaattaaaactcaatcaatcatacgttaataccacctcgttttgcgtaaaaaacttaatcttcatcttcattttcatcttatcttgattgcctgatccgatggctatcaagaccattttagaccttaaccaaaaatctagccatgttgaaggatttttttgtgcgaaagcatgaatgatgtattgttgaatactatatacatgaatacatccaactatcctacaaatgatttcgattttaggcactgaacctttaaaaggtacgggcggttttggggtatgctctaaacccaaaccttcttccgctctcgcacaaaactgacaaaagaaccctcaaaccttctgtcaacgccctgaagtagccttgatttgtttccagtattatgaggggacctgcagtcctgcaggaatgatgcattttggtgttatagttctatgctcacgctttatagctacattaggaggatttctgacgaatggtttttatatgattcaattttatctttcagtttttttatttttaattttctatgtggtgggagaagtatgatgactccacttttacagtagtagaggtagtttttttttataacacaaagttaagattttttttttgacattcaacagagataagaaatgctattgaagcattgagagtttgagactaaggcttaagtatgtctgcaaaaatgccacgccgcctcaccgcccttttgcaggcggtcccaaggggactgcttgcaaaaaaaaatcggtgtcccctgtggccggccgttatgggagggcaacggccgtctgccatatcggcaaaatcgtcttctaggagggcgagggcgatggcgtgactagttttgtaaattttttaaatagaaaattatttttgtaattattttaataataaataaaattaaaaataaaaaaattccacttaactgatcgcttaacgggcaagatgggcctccgctccactggcccaaccacgtagcaagctccccttgaacagagtggaattttttttatttttaatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggcatggaattttgcaggcggcccccttgccgccctccgcgagggcgattttgtactgtgcggggggccgcctgcaaatgggcggcgagggggcatggaattttgcaggcgacccccttgccgccctccgcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatatttaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatgtttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcattttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaattctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggatctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagtcagtaagcctggtcgcgtgtgcacaaggacgaaagtcctagcggtgctctcgcagcgacggcctcttctgtgtacggctcccagatgacgtcgctcggctggagacggtcaaactcgaacacgaagtctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaatatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctatcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatcttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgaacatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatagatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacaccttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctatgatgaattgagcgaaccagcagggcttcgccgctccccttctgctgccctcccctctctctcttttgttttttttggatttttagtgaatataataaaatttcacagaggagggactgggctttatagggggagaggcaaaaatcgccctcccccagggcggcaagggggccgcctgcaaaattccatgccc

SEQ ID NO: 69542 - DNA, 7859 bp, Oryza sativa
attactgtagaacaatcatgctgtggtaactggttactgccatctgtatctgcaactgctagagagaaaactgcacatggtcaaagagactcgttcatatggtgaggtaaaatgaatcattacccatccgacgaatgtctacaatatccttccacggcactatctatcaaagattacatgctatccctgtttctttgtttctgctactgaaatattagtggtcaatcccatgattgcatatttgcagtcaatgccaatatgtcatggctgcactgataccagttggcgaacttggcgaagccatcatctatttctcaggtttccaggatttgggcacagaggttctcagcttaagtggatgctgcagtggagaaggcaagatcagaaacaactttccacacaggctgcattatattggcagtgaccaagaatactacagcgatgatgaaacgaatgaaattccagtttacatcaacatctacacgagccagagcttcttgatatcactatattactacccaattgtactcatcactatgagctattttaaccttactgaattgatatatacatctacttcaatatagaggttccacaatgtcagatgagtcatttgcaaaggttacctgtcaaagatgtctccacctagtaagaagcttctgtcaagcaattgcactgtaatcttctagaattgattacctttaactttcttgtacctctttgggaaaagttcatcgccctcaagaactacttctttatgcatttgttcccatattgctccaaaatggctatgaaatttatcttgaatccatgcttttatctcaggataaagaaaatctggattaaaattccacacatctcttaatgctgcccggctatctattaactttgaaccaatcttcatcctgtcaagaagatcaccaactcttctttggctaacaggccctaggagaacagatggtgacagtgccaggaacttctgaataaccttaagacatggcaagacatctcctttaagcaaagcacatgcaaatacctgcaaccgattggtgccatcctgtataggtaaactatgcaatggaagctgccaattatgccgagaaaagatggggctaacataacagtagacttggtccttttgaggttcgtaataaggttttggatcttccaatggtgcagagaatgtacaaagagaactagcatatttcaaaatccatcctggctttacactggttacaccatgcatatatgatctctttgtatgaagtagttccgagtaaactacaaattctggtgcaattcgtgcaacagaagatgatcggtgtagatatattgtatcattgaaagcacaagattgataatgaacagcccgaacctttttatcatcttttgatggtccaggaaaggcacgaatcctctttgcaaccctatcagcccacccagcacatattccttgtcctagaagctcctcttcatttaattgcattggttttttatcagactcatgcctccaggcctcttctacatcttcagaaaccccaaatttccaagaaaattcttcacaaaatttgctatggtgaaatattaatcgaagaagttgcttcctcaattttgacatctcttccattgttttgagatgaagtgagttgactctgcaaaattccactgggttttctgacaactcaaacaactgcaaggcacgagagatggataaagcatcactgctaggattggaaaattttgtgtgggcctctctaaccatcgccttgagcttcttctgtctcttcctttcctgcctatccttatcttctgaatcagggttatcttgttttgattcaccactaaattcattctgcgtgagaaaaggattcgtaaagctcaatgctgatgcagcagctgctgcatatcccaatatgaagttaggtctggaaaagcaccgctgactgttcaaaattttaactattgtcagaagaagtcgagaatgtcgggggctcatggggtattgtgccatagccttccccatcaatgtaggttcacccttgctatcaagcgcttccaatacttttaagcaacgctcagcttcaaccaaactttccttgtcaggaggtgtagggaaaggaaagttttcaacctgtaattatcatgaattgcatgaaacaacagagaaaagaaagataataagtcaaaagaacctataatctcataaggatgagtaacttgcaagcacattaccttattaatattcataaacttgagcataagcacaacaccatcgactggaatattcttgatctcaggctcagagaactcagggaataattcatctttaccatatgctgcagccgagtagagatggtaacagtgcccaggccccgttcttccagctctcccagaacgctgggatgcagatgccttgcttatccactggatttcataacttgccatcccagtagcatggttgtagttcttaactttttgtttcccagtatcaactacatactttatgccaggaattgttaaagaggtttctgcaacatttgttgcaacaacaactaatctttcaccgtcaggaatatcctgaaacactcgaagctgctgtgaagctggtaacatagcataaagtggtaacacacgaagtttaccatgcgaaacagacctaggttctgtgcatttactggtacaaggaacatgacttgactcttctaaaattgtagcattgcttggtacatcagtgctttccggttctcctgacactcttgatatagccttaaatgatgccttcaatccagatgaaccctcagcacctttcaaaaatgctaatactggtccatcctcttctgtggtttcataaacagaatcatcatcctcactgtcggtatccatctcaggttccatttcaatgtctgaagaatctacacctgggccagcattactctcatcctcatcatattgggaaaacatgtcatcttggtgctcagactcatctctatcaatatcatatgcttcactgatttccctctcgaccacttcttggctcgagccattctcatcaccctcaactttttcagtcttcttgtcagtttgctgctttgatgctctttgcagtttcttacataagtaatcgacttctcgttgtccagtaacaaagacaaggattccaccttgtggaagtttcttgtggatggacataacctttttataagcttgccccaaataatcgtcatgtgtactctttgagaagtgaactgttactgggaattgtcgtacaggtacctttatagctggtgggatcacatcaaacaatcttctgtttgaaatgaagtccttcaattgcaaggtagcactcattagcaccactttcaactgactaatcttatcttctggattaatgctcagaccacaacgtattttttcctgttgctctatgtacaatgactgtcatgtgcataaatgttaacaatggttatatatatatattttctttcattctaatgaaaacgatgaaaagtatttagtttcaaccttgcgaatctttataattctagatagcatcccgataagtatatctgtgttcaagctcctttcgtgcgcctcatccaagatgattacagaatagcgtttcagcagaaagtcactctgcggatgattagtaaaccatgtgattagcaggattctgatatacgtctaaaaataacttcaaactaaaaggaaaataaatacatagacatttcaggatgatcaatcacatgctgtaccattttataaagcaattatggaagccatgattgagtggttatagaaaaatatggatggcgattaatcaagtgtcaaacagaatagctggtaggaaaactaaaccttattagggcagttatgctgtccagggaacaagggagacttgcagtatcgacagttatgaccttgaatgttttcccttaggtgcattttctaatcatgcttaactgttaacctttttctttcacaagttaatcatggtaactaataagtagagtgaagaaaacatgtctcttcaataaatagacaatataggagtagccaagacaagtaatcagattgttacctggacctctcgaagcaaaatgccgtctgtcataaactttattgagcatttacttcctaccattttatcatgcctaacttgaaaaccgacctcctttcctagcttaagacctagctcataggacaccctcctagctgtggcaagtacggcaacacgtcgtggttgagtgataccaattattccttttctgtcagaccggttacttgtgccaaagccagcttcatacaagaactgcagacaacaagaagcatataatgagcaatgaatacaagcagatggtatctgaaggtgcacacacttacctgtggaacttgagtagttttaccacagcctgtttctccacatagaattaccacagaattttcataaatagcttccattatttcctgctccatcattattattggaagatccctccttgttttctcaacctcatgtggccttgacacaggtacaacaattggaggattgaaacactcttgtacagtacgttcttcttgtcctggctctttatcctaacaaaaacaggattacaataactctgaaatgaaccaaacagcttctgactgcaataccactaaagcaacaggtgaatccaacattttttacaaaaaaaaacatgtagaaattgatgaacaggtgaaaaaaaacacagtacagctgtagactgatcacctgtaatatctcttcaccagaacaactaggaacacatgattgaattgcctgatttgctgaaatattcggaacaccatcactaccttcagtttttggttcttgatcgctcagtccaacatctataaccagtttgcattccacaggtttcattgcaacattatctatgtgattgttacattttctttgaggatcctcgttttttgctgaatcgacaatcttgtccaggtaatcttcctctgcagcctcgctgttttcagaagctttctgatcgccgtctttctttaatagtgagagttcttcagggacgttcaaaccagccttggagaagtgcacagcacgcctacgtttttctttcaaggtctcagcctgcagtagaataaatgtctattgaagctttgttttgtacattgagaaaacagcgaatccaagaattatggctatatctactatacttgaccgatagtcccagaagcatggagcagagaatacgcatcatctgaaatcttgtgcttcctgtcatgcaggacaaccatcagaatacactatactatcagtccagacagagtaagtaaagactaacataccgcaaaatctcaatactttgagcttgcagtaacttcttttgcttttcctcctggagataagaaaaaaatgattggcattaacataaacactatgaccaatgatcaacaaaaggaatgtcaagaagggaggcgcacctccaaattctgcagctttttcagcttactcttgctcatcttcgggtcttccttgattttcttaccatcctggcaattcaggtagcataagtcacacatcacacccccaaacagtaggtggaaataaaaatggcagcaccttgtctttcccttgtcctttgttcttcctcttgcacggcagaatcagcgtgttgctgtcctccatgctcgaactacaagcagagcaaagcagaaaaatctcacaaccgatgcagacgagggacatccgagccagtgagcccgggaaggaactcaccctgtaagctggtgctcaccgacgtcggcagcgtccgcgagggggcaagccggcggtgctggcccgcgtggtgaaattggacacctccctccctcaagggacaactcgctggagcaagctgatgctccggcagagagaagccggtgcgccgccgacgccgcagccgccgccgagcctgcagccctcggaggtgcaagcgatgggagaggcggcggcggcggcgatggacctaatcgaagagtagaggggatccagtttgggccgggcttgtttgtgacgcctaatgggccgaaggagaaaggcccataaaagcccaacgacatttcgtcatttcccctgcttgttcatccggctaccgggtcgcggccgtcgacgagacacgagaaaggcgacgaccactgcctcctccactcctccagatcgccgccgccgccgccatggggggcggctccacggcgcccctcctcgcggccttcgcctgcgtcttcctcgccgtcttccctcccgtcgcctccggtgagttggtcctctactgaccatcgccgagtctatatcgctttgtttgctctggactctggggtgtaacaaattctaccgaatcgagatggtctcatgcttcgttgggtatcttctgttatgtgatgcgtttctagggtgaaattgtgtagggggtaggtctcagcgtagccttgaggtgaattaggtagtggactgctaaacctagttagttctgaagcttgggcgaacacctccgttgttgtgctgataggcctctagttgtgctcatggagctttgacatgcgactataattttttttctagtatctcattctaggaagttttgtgattgctaaagtattgtgatgtcttaggtgtaggtttgtttaggttcatttgaattataaaatcgtgatactgcttactgtcttaatatatttatatatgggacacaggtttgcaaagcaacgtaagatatcccaacttatgactgctgtaacattgatgtaccataacttaaggatcctcttacctttctttttaggagatgctgcaacgttggagtcagttccggatcttgtgaaggcaatgtacataaacgttgaaagcttcccttgtgtgaggctgttgaatcactctggtcaagtcggttgttctagtgagtattcggtttactcttattctgtatgcttaaattaagatggctgtcattttctatcatcattgtcaaaggctagccaactctgccttgttaagagtacatggttattggggtctccattatgtaatcagatcctgggcatgacaaggttattgcaccgattgtaagatttggaaacagaaatgatcagttggttcagccgtcggcggttcttcttcccttaaatcagatgacagatttctttctgaggtataattgcttagatagtctaaatctcacaaatgatgttacatatgatcgtctttcaaagttatgtttccttgaggtgctaagagatgagaatatttgctacattgtttgctcttgtgcagggtatccaatgatccagaactttatcgtaagatagctggcgtactagttgaggcaaatggcgttgataacatgctaggtttgtggatttgttttttttatgtattttattgccttttaattccaaaaataatgtactgttctgactttgtagagttttcaccggatagaaaatttccacaacaggcttttgcaccatactcaaatctcagccatcattggaatcccacggtaagttatgcggttgattaaaatggtaccaccctgttgagagacaaacgtgatcagctgatcacatgcattgaatatcactctgttaccctgacatttacttttgtagggatcaggtattatgtggaacaaatatgactttcctgtgtttcttctctcagaggagagcacacagactctgcaaaacgtattctgcctgctcttatatatttattatagttctcatttcttctttacaaactccagctacacaatgcaatgactctaaaaagagattatcaataacagcttgcggacaagaatgagaagagtgccatggatatctagcaa

SEQ ID NO: 69543 - DNA, 24012 bp, Oryza sativa
cgcgaactcgaggaacagctggtactccccgcccgccgcggcgcgtgacccgaggcaggggacgatgtgcggggagcagagccccgacatgacgcgcccctcgcgccgcagctgctccgccccgccctcgccggccgccgacttgaccgccagcagctcccccgacgcgtcgtccgacgcgagccacaccacggcgcccgacgcgccgcggccgagcgtgcggagccgcctgagctgcttctgcatcaccgcagccgcatccatcgatctcacttgctgtgttcgagctttcgaaggtcttggaggttatcaggtatttgtattggtggctgctgcctctgcctccacccgcgtctcgtgcaacacgtgcgggaagagagcgagcgagcgcgtcgcgtggtaatcgcgcgcgcagtaggaaggccgctcgctcgcgcccgtcaacgcctaggcgacggcttgacgagatcgcagccgctgctgcgcctgcgcccggaggattggtcaaatcctggcgccacggcgggcgcggtagatgggcaggatcaccctccgtttcggacgcgcggactgaccgaccgaccgatcgatgcgtcacggatcgtccaattggcttactcctatgcgcatattcgttcagcggttcaggtgagcacggaatctgcttcgaagattaactgcacgctaatcttgtgtccgtggtggataagcttaggctatgcgtgccgtaagtgactcctctttttcccttcacttttccctttgggatggacttcctttccccattcgtcgacttcgtttcatcgggagaaatatattcactgcaccggaaagccacgagcccacgagccatgttgtgaatataaaatcaacgtgaaaaaaaagtcgaatcatacggatgcagtgaggtaatcagctgatcaatggacgtctaatagtatagcccaccactaactccaatttatctataaccaatctaatagctcattcatacaatagttacatactacactattaatacctggtcccacctgtcatacacacactacgtcttggagttcgtgctacagcaggctacaaatctgtagcccgttgcttttctctctcctcatttatcttcttaaaatatgtttacagctggcttatagtctgctattttacctgctctacgagcaagtttaatagtatagcccactactagccgagaaggctattgggcgatcagtcgcgcgcgctcctctccgcgcgacgcgtgactggacacgtgtcgcgtgtggagagagggcggcggacgcaccgcgcgggagactgacttttccctttttttttctttttccatgttttccgtttctgttcggttggctgtttttttcccttgttttggtttctgttcagattggttttccttttttttttcggtttctcttctgtttttttttttcggttttttagatgtatgaatacaaagtttgtattcgtaagtatgcaaagtttgtatacacgtatgcaaagtttgtataagtgtatgcaaactttgtatacgtgatgcaatttcttgtttttttatttttttaatacgtatgtatataaagtttatatatatcgtatacaaagttcgtatacatcgtatacaaagtttgtatatgtcctatataaactttgtatacatcatatataaactttgtatatgtatatatatttttatgcaataaaaaatattcatatatatatatatacacgtatatacgtgtgtgtatatatagtatatacataagtataatatatacagagaagagaagagactagaggggggcgactaaccgtgcgcgcgcggatgatcgcgtatcagcgccctccactactagctctaaatcatctatagccaatgtaatagccaattcatacaatagttccttactatactattaatactggtcccacctgtcatacacacattacattttgtagttcgttctgcagctggctacagaattgtagcccgctgctcttctctctcttcttttatctctttaaaatatatttataactggcttatagcctgctattgtatctgctctaacaacagcagccagcagccggaggcaggagcccggcagttgaccaagcgttactgcacttggccccctgctctactgcggtctcacttggctgttggaatttccaaagggacccgttccctacgagaggtctctcaggtcaaccactacacaaaaagctatccaaaatcaaggccgtttcacccgcccttccttcttctcgctgacaaaaaaatgtacgaaagttctagtatgtcattttcgccccgtgcatatctccttgcgtctgctgaaacaggcaataaaaatatgttgacaattctattgctaccatcgtaccaaccatatcgctgtcgctctccaaggttcacacttgcgcctaaaaaagattcattggatactttggattggtacttcgtcaactcatgcacctctctcattcctccagcacgtaaacatttgcctgtctgttgaagagtcatatcgcgcttcattctctcataaaaaaacgtttttgagctgcatgtcgacgatatgagtccgttaaaatatctgcagcactggaataaaagacgcaaaaccattccaagattcaaaatcggatagggttcccgtgattaatcatttcataggcaacctgttgaatttaaaaaccagacacggttttcttatggcgaactgctcttccagttgcagctttgactgtgcacttggtacctaggcggttaagccacctaattaacaccctcgatttttttctccgggccggtgaaatgtcaaccagtctgaaacatgtgggtgtactataccattcatatctctcttgtgttgaatatttgtggccaattgaccgtgcatccctctcttttccaccccaaaaaaaaatcattgttgctcatcctcccaaaaagttgggtaatatcccagatcgatctacagcttagaacgcacaaggaatttgtggacacatgctagtgtggaaatcctaaaaaggaacgtgcgttcccatttcaattttgtgcagttgtgccatccggaaatgactataggtggactggactataaatctggaacatgcttaactgtgagcgtgctctaaacatacaatacgaaatgggacggaaggaaccgacgctgtaatcctcttgacgatgctctgaaaaaatcggcctggatatggtgtattggtatcggatttgttttccacagcacatcagcacgctgtgcttgacctgggagaagggaaaaaaaaacgcatttccatcttctaaaaaaagaagaaaaaagagtgcatttgcgtactgcttgcggcgccttggattgcctacctggggtcacagttttccgttgttatgcctgccatgaacatttttaagccatccacatgacattattggcatagacatctagaaatctagaatggatatatgagtgttatcttttgggagagaatggatgtatgattgcatatgtatgcccctttgaatgataggaatggaaaaacaaaggaaaaaacatatgattttgatagaaatacaaatgtaaaacagagaattacaaaacatagaaaaaaacataggaataactgtttaattgaactaaaaaatgtaggaatcagatgagagagatagtatcggaggaaattttccaagaagttgaaactcttactaagttttcttcaaaatctctatgggattatcagttccatagaaatttttgaaggataaaatattatttaatcttttattttaaaggttttcataggaaaattttcgataagattgaaatcctctaaaatttctatatttttcttataaattaaagtggtgctcaatcatttggttgctttccctaatgacgtactgatacttcatctaggggtgtacgacagatgtagtggaagatggatgacgaaacccaaaaccacgaacgcagtggtaaccagccgttgggcattctgtttccatttaccactaccaaagtatcatcaagtgccagtttaatactcctaacatcgacgccggagcgtcatacatgcatgagatcatgtcatattgtcattcttaagcgtgtcggtgtgtgcatgcaccgtgccgtaatgtaactccagagttgacattctactcacacggtcacaccgtggacgccctccggaacaagagcttgcaaacaaccggtggtcaatcaacgggcgacacgctgttactctgctagtaccggagccatcacggtgatgccgccgccatcaccagaaaattggcgggtcacaactcacgaccacgaaggcaggcgaaaagcgccagcatatccgcatttgtgccgccgaggtaagatcgcatcatgccatgcggatgtaaagcaagatggatgatggtgatactcactcaaaaccgcggacatgtgcgatgacgcagtggtaagtggtaaccagcggcagtttctgcgaatgcctgaattctgttactgtctgttcgttgccacttgccagttcattatcttccatcagaatattatatatactgacatactgtacattgtagagtgatatgtgacaatgtgcggggcacgcgccgatttggataatgaggagcttcggagatttgtcgattctccacgctgtggacacgccctaagaaaagattctggaaacaaacagagaacagccaatgggcaatttaccatcaacagagtagaactctgcatctggagccatcatcagcccatcagacttgcgtgcgcggtgacgccggtgccagtcacgtcacgtagacgacaaggcggcggcaggtgaggtgagcgccacgagggctgagggcagttgctccgcagtccatgctgcatccggcggccgtcccacgcctccaaattcgctttcgtttttaggccgcggccgcgccgacgagcgagcgagcgagtggcagcatgcgatgctgcctactcatgggacccccacggcggcggcggcgcgcgtggccgccgtccgtgccgggatttctcgaagattcgccgggaccggtcggtggaacgtggtggaatccctcatcccgcggtcgcggcccttcgttttccgctcgtcgcgagtcgagaagcgcatgggtgcgcagggttaggagggggcccgcttggtttgttttccccttcggacgctgcagcctatgggccgcgctaaacggcgctaatttgtcagccgctttctgtgaggaataagtttactttgggtccctcaagctgtcgaccagtctgattttcgtctttagtccagaaaaccggatgcgacacgtccccgaacttacaaaaccatgcaaatgagatccctaggcagtattgaccccggttttcgctgacatgacgcctacatggatcctttgactaggtctttgtcccacatggcatcgacgtgatgcttaagtagcaattctattccgaaaaataatgaaaaccatatgatccgcgtgtcagttaaacaacaaaataataaaaaatggtgggcccatgcgaccccacatgtcatccttactcccatcttctctctatcctctctcgctcccacctgggcggagcaaggcgaagcaggcgatgggtgggcgtggagtggggttggtggcatccggagtaggtcggccaagggagacggtggatgtactacacccgagctcaaggaggagcagggcgaggccggcgtccatccccatgcagtttgccaggtcagagccagagatggagacgaagatgaaggggggaagattgagagggaggtggcagcgagggggttcctggcgacgaggatggtgtgggaggtgcgcgtggtggaggcggaggcggagaaggtggcgaggaaggtggaggccgaggcgaaggcgctgaggcggaacgtgaggaggaggatcatgtcgtcagcgaggttctcatgcggctgctgctctggctcaacgcggtctacggcgcaatggagtcctcgcgctgcaggacaccatcgatgcccttgagcacatgttggtggcacccgtggttgccaacgacgccggcaagccgtcgacatggagtagcggcgactggagcatgccggcataggcaaggggttcagcttcataacctccgccggtgacgtcgaaccccctggtggcatcgaaccacttcaccatccccttcaccctctttggcggtcggcgggggagaggagaggaacatgcgtagcgatcagcgggagagagagaggagaggagcgtgcgtggtgtggtggtcagcagcagagaggacaggagcgtacgcggtgcatcgatcgacgagagagaggagaggaatgtgggcagcaacgggagagagagcgtcgcgtgacgtccagtgggagagaggagaagagcgtgggcaatgcagcagcgggggagagagcgccgtgaagctcaccgatctccccgcctctccctctttgagaagtagataaggtagatgtggggtcaagtactttaaatttattttgtttgactgacatgtgggttcctcatattttgtttatttctttaacttttcaattttgctcttttttttttcgatcaaactgccacgtaagtgttatgtcaatgccacgtgggacaaagaccaagtcaaatgagccacataggcgccacgtcatccaaaaccggtgacaatactgccgagggatcttatttgcaccggttttataagttggaggatgggttgtatctggtttttgggggttcaaggacgaatgtcagactaggcgacaacttgagggagctagaatgaacttattcctttctgtgaaggcgacggatccaacacggcctggtagtatctgtatatgggccgcagcgtgcaaagattgggtagcctggaatcctatgggcctcctccctctgggcttcaattaacaggacattttagtgtcgcggtgcgatcggatcgagatcatctcggtgtcatccaccagaatttcgggttcccaacaccgattgaattgcagttttgtttcgggacataataatcgttaaatggagcatccgcgaggtgagtggaatacgccttcccaattttcaggggtcaatcgaacactctgcagagctgaaaagatggctcagccgaaaaaggaaaattaaaggtccggcagtgtagacacaaagactcacacctgctgccgttcgagctttgagaaaaagaactgaattggggccaaaaaaagcatctgctgggctttgcgagatagctaaacaaagttaattaccatgtggacctactaaccaaatttcattagcaagcagctgttctgtcgcttccgtttcaacaaggaattattggcagaagaaacgatcgatacgatgcctttcaccctgggttatgcgtatccttatctgaatatttgtttacgtttcggcatctaccagacgtgtcctcgacgcagcatccagcaatcctaacacctcgcagacattcgccgcggttcgttgggcaaagcagcggtctccggctgttaaggaataaagcgctcgttagaactgtgctgaagtgaactgaactgaaaggatacacatgtctctgcatgaaagaaaaggctgtacttttccagctagccgtcatcttaacctccagacgaacagaatctctgaaaactctagatggtctgaaaccaaacccccggaccccagccgggtacgtatgttttcttctttctttcatgccttaagcatcacgtttgtcacaaaaacttaacgtaattcggctgtccatatgcatcccatggaagcaaggaacaaaaccagctatgtcccgtcagtaaaatagttcatattatttcgcgttctctatcgatcgcgtgtatatatataaggcccggatgctaacgccgaatcggtgcgcctcctgaatcaagtagaaatagtactactacgcaagtaacgtagatcagcacgtagatagcttgcgaagacgttctgaaagagtgcagagagtttttgctagctctcggtggtgatatccatggctaacgcggggctgaagccggtggccggccttctcctggttctcaacttctgcatgtacgtcatcgtggcggcggtcggcggctgggccatcaaccacgccatccacaccggctacttcatcggtaaaactagctcacattttgatttaccgtgtcgatctcgatggtgtcttgttatcgggcacaacgaaccaaaacttgctctaaattgagattggtgcctaattatgtttgtcaatagaaagtgcatatattttgaagctagatttgtgactgtttgagcgtatgtactgcatgtacgtgtaggttccgggatggcgctgccggcgaacttctccccgatctacttcccgatggggaacgcggcgaccgggttcttcgtcatcttcgcggtgatcgccggagtcgtcggcgccgcggcggcgctcgctgggttccaccacgtccgcgcgtggagccacgagagcttgccggcggcggcctcctccgggttcatcgcatggacgctcaccctgctcgccatggggtaaattaacgcaactaaatctgaccctgtcccatgcatgcatacgggtatactaaatcaatttccttgattcatttgttacgttttcagattggccgtcaaggagattgacctgcacggcaggaacgccagattggtaagatcgaacaacatcaaacacagtttttttttttagttcgtcgtgacaaccgaagacacgctattaactgtgtgcatgctgctctggtcttgatttttgcagaaaaccatggagtccttcaccatcatactctcggcaacacagctgttttatctgctcgccattcacggcgggaggtagaagaaggtcaggtttttctgattaaagttgtgaaggtgaagacacctttgtgagcattattgggcatagatcatggactttacgagcctaatttgatttcaccggtttgtgagattaagttcgacatggatcaaccagatcgaggcgctgtttgtgcttgtctacgaatacgtgtgtgtgtgtgtgtgtgtgttttatgcagtgtgtgactagcacttcttagtaattcgtgtgccgaatactcgaactcctgtgtgatttgttgattatttggatgcgttgatttatactgtattgatttcgccgtgtctggttaatcgatttgattatgtggacgtgatggtttacctgtttgaaattcagtccgaatggctatctccgcacgacaatcgtttatcccgtgaataataggggactgctatatgacgggataccgtttggacggtatacccctgtaattcatcccgtggaaagacgtgcgtgctgcttcgtacgatggtgagcacaccacgttcatgtactcctcccaaggtatattttacttgcctagtgatctgtattatttttgtattatttttttggattattattgtattatttttttattgggccatgctctgttacgtatttatgggcactattggttgggttttttatatatgcatgtaccaatgatgatacttataggtaccgagaatggtatctgtgagatatcaatatattgatgataggtatccaaatgatacctgtcatgtatcgtgatgatacctaggaggtatcaatgagtgataacacttataggtgccgagtatgatacttgtgaggtatctgtatgttgacgataggaaccaaatgataccttccatatatcgtgatgatacctatgaggtatcagagagtgatgatacttataggtaccaagaacattacacatgaggtatcatagatatccaaatgatacctaccatgtatcatgatgatacctacgaggtatcaatgagtgatgatacttataggtgtcgaggatgatacatgtgaggtatctgtatattgacgataggaacccaaatgatacatggtatgtatcgtgatgatacctaagatgtatcagtgagtaatgatacttgtaaataccagggatgatacctttcagatagcaatgtatcgaagatttgtttttatgtacccaaatggtacctgacaggtatcgtgatgatacctatgaggtatcaatgattgatgatgattgtaggtatcagtgattaaaaatacttggaagtaaaatttcaaagttacactaaacgaaacaattgagatattaagcaaatttaactaaaaaggattaaaagaaaaaatgacgaaaaaatgcataggtggggccaacattgagtaggcagtgccatctgacagtcgtggacctcgtggtaaagcgaataaaagtcatgcatgcgcgtgtgcgtcgtacttgttgagagggatggtgcgaggaggatgatcccgttccgatcgctaccaacggaataccggtacctagcatttccgataatgtattcctaaacttttaaaattaaacacaaatgagatcctaaaacagtttggatgatggttttaactaacgtgacatccacatggttggtttaacttgatcctcgtctcgcgttatgtatcgtggtcatggccattagccgatggcaatgttgtcttcttgccttgctttcttctgcttggttagttggtcttaaacaatttagcatcattgctttgtgagatcaaagcttaagtcaaaccaatcatgtagacgttacatcagtagaaatcattatccaaaatgtcttgggaccttgtataaactgattttaaaagttaagagatcagttatatctggcattacggtttaaggtttaaggatgtgatttaaactcaactcaacctaaaataaatgtattcctttatccagcccaagacttaaaagtagtatccacatatatatatgggccctattaggggtaagtctaaatgggcttggctcaactacataagcgagttcaaccaaaagaatttttaggacgaccttatgccctgtgaacaaacaagtatactactctctatctatttttaaattataaacagctacaaatcctgtaatttggattaatattcgttcttctctggattgaactgcttccatcatgtttattattcatgttactaagatatcaaaaacatgtgatggatctaaatcatacacattattttagataaagatctaatctaattgtacggttagtacttaccaaattcatatagatgcggtcaagttacatgttcgttttattataatgtttgactccatataataaaaatgtatttcaggttctacgaattcttttttaccttatcactgttattgatagttcaagctttcaatgtctatatataacatgcaatttaactacaaccctccgttttcctcatttttaaatatatggtgaggttgatttttttatacgtccatgctaaaatattatttgcttaaattatatttattgacaaaagaaatcataaataaaaaaatatttatttatatagtttttctaataagacaaataaccgaacgttgtgttcaaaagttaagcaacacatatattcttaagcatcacaaaaatagaggtagtattatttctacaacttcatatatgtccataataattttataatagtattagacattttttttaaaaaatattgtaataacatgtgtgtacacgatatgatatcaaataatggttcaggcccctcgcatgataatagcactaatccagtttatatttgattgatatgaaaaacctcagattaaatagagaacaatcaatcccgagattaccggcgagacccttgtcaagatggtttcgacgagatctcctggcgagtaggcttcacgtcctccaaattgtaggctatgttggcggtgttgacgctatgatttgataccttggacccctcagggggtgtgtatttatactgtttattaccttaatctccaagaagaaatcggaaacaccaaatccagcacgatatagtacaatcccgattctctccgagtagtactctattattcgcttccccgtgagaattatttccataatctctgtcgattttcttatcatatatagagacgtgtcatacatatgaaggtatgccttattcataatcatgacaacatcttttatatagccaatccgcatgtatatattcttaaacgagatacattcagagaatactaaagtgttagtcaaacaataaaaagaaaaacgaatatgctactagcaccctttcagtcggcaatactccatttgtagagagaagaccaatgcacattaattaattatttaatttgtgaaactggtagtatcgtgccacgttctgagcaattaaggatcccataacgccagacattaagtcggccaacccttctcatgcaatgaaggttttgaagcatggagtagttatcatacttgtcatatcatatagatgttatatataaaaattatatatctaacagatgatgtttttaaattaaattctcatctattcatgaatcatcttttttctctctcttttttatccacatatccccttgtttcattctcgattattgtgtagagatggtttatggcatgagaaatgatttatccatctttttacttcttttctcgttagctttcttgtcgtatcaggtttttactcgtgtgacaatgtatttaatgctatgaacactatatacgagttggaaatgacctaaacctatctcacatctcaactctcagcctttaccaactttttcttagaaaaagtgttcctagtacgtaattttaaacacaacccaaccaataaacagacacttaagtccgtgtggagacattggggatgtttactttgaggcctaaatcaaccttattaaattttaaatttgctacaggacatctaaaatttgtgtaatttgccgatagacatcgtgaaaacgtgttatggctgaaagacagtaaaaaaaaaggtaatttgctggaggacacttccggctcaatcggagagaaatttttttcaaaaagacaagaatgaccctagggtcaaaagctttttgagccgagactaaagtgaaaataaaataatggtgtatgctagtgatgtactttgggctatggcaaatttagagttacataatttccaaatttttactctaacaccatgtttgaagcatgtggctagaggggcattctcgtcttttttaggaatccatctcttcaattgagccgaaagtgtcctctagcaaattaccagttttttagaatgtctttcagccatgacacgttttttcgatgtatatcagcaaattacacaaattttgggtgtcctatagcaaaatttaccattttagaaattctaaattttgacattattaatattttttgacacgacattattaatatttgattgaattgagatgtgtagattgtatttggtttgttacctttactaagtttttctttttttaaaatagattctatagttgccaaattttgatagtgtagatggtcaaaaatttggtaggttcattttggcaacagagtgaaaaaccctattttttgctactagtaatactggagaagtaatttaggcccgatttataggaaagcccataggtaatttagggcgtgttgagagaaaaggaaataaaaatattgagaagatatataaaacaagatgagacattaatatattattaattaatttttaattattaaactttaaaatggattaatatgatttttaaagtaacttttctaagatttttttgaaaaaaaaacaccgcatagcaatttgagaaggggacacgtaaaaaatgacacaaatcttctccttttcataaaaggcgaacgttgccttagagaacaattcgatagtattacaaaaatttctatgaaagcacttgaaataacttgatgggtatcttgatctttcaacatgaaaactggaggagagtcatgcaacgctgttaccatctcacttttggagaaatcatcttttgtgggttggaccaataatagtcccggtccaacaaaaaaacagggactaaaaaccatttgtagtcccggtttaaaagtgcaacgagattatatgatctttagtcctggttatatttatgtcagacgttgtcaggacgcctgggatctttagtcctggttgatatcaccaatcgggactaaatatctctctcacatcctacctcgggatgctttcccacgtccttatctctctcgagaccgagagacccacgtctttatctctcgatctctatatgttcgctagttctccctcgatcctctttctcttcactcactcactctctctctctctctagcaaaggctggccaagagaagtggtagctgggcggggtcggtggtggctgggcgggagaagcggcggcggctgagcgggagaagaagcatcggccgggcaggggaggtggcggcctcgccctccccttcgccagatccggcaggagggaggcggcggcggccgggcgggggcggcggcagtgaagtgacagcgactcgaccagaggagaatttgttttttttaggatttgtggtgaatttgtttttgagaatttgtgatgctttttttgaatttgcgatgattttttaaaaatttatgatgtatttgatctatgatttggggatgtagtgaaatcaatatgcaagcagttaaaaacaatgaaaaaaagaaaaaaaaactttagttcaggttgctaacaccaaccgagactaaaaatttgtggtcccgattatataactgggactacaggggttacgaaccgtgattgaagatactttctccagtagtgctagtgcctattgccatacgtgatcaacgtgattaattcacgattattcctcaaactaaacatgcaatgatcagaagcaccaatagtttccatcttttgtggatctccctcgatcttccatagcgcaaaattaaaaagagagtccggccgtgaaacgggacactgtttttatgatgttcattccaatgttccaaccttgataaataagacgctggagggagaacgtgtggcacttctagagcagtgcaggtgacgatcagaaggacaccgctaccccgctgactgccgacaatctatctagactcaagctagcgatgccaattgttcttctacacagacaatatgagaggtggttcaaggtgcgtctgcaacctctacttccactttgatttaggaggctacatcaacatccatggcttcgaggaaacggttagtcgtccataatttcatattagcatattcatggttttaagttaaacagttaaaagagtagattagataatctacactacttcctccgtttcacaatataagttattctactattttccacattaagttattctagtattttccacattcatattgatgttaatgaatctagatgcggaggaagtactaatttttttttttgaaattactatagaataaacattcatatagagatttttgaaggaaagttagtaatagcttcaacctcttggaaagtttttttttctatctctctcatctgatttgtgtgtttttcctgttggtgtattcaaataacaacttctacattttccttctattttaatttgcacccatgtatttttcacttacattgaaatcaaaattatgttttattatatttttatatttgtttaatcctacgtttcgaacaaaccttagttcttgccgagctaaaagcaaatcaactatagacgagtaaatgcatcttgtgcaccatcatcaaaatgtttcttaatgatgaaaatgcaacagtggatacatcatcgcttaaaagcagcgacaaatgaaaaggaacagcatcatcacaaattccatgagaacaagtttctcttctcatttctctgctgcctggtacttctcgaagtgtgtgtcaatctatgaaggctatagtatgactacttgtcttgatcatggccgtgatgcttatgctaggctgctttattagttcttgctttagagcaggtaaaatagcatgctattagccagctgtaaacatattttaatgagataaaagatgagagagaaaagcagcgggctacagatctccaagatataatgtgtgtatgataagtgggaccatatattaatagtatagtaagcaactattgtatgaattagctattagattagctatagatgaattggagctagtagtgagctatactattaaacttaaacctgctcttatgataaagtgaccttgacagaaaatatagctaattatttgtcgcgaacaaatggcctaattaacaatggtaatggaatgtttgattttgctaccttccgttgctaggaattcctttatgtcattttcgttattattgtttactgtaggtccgatctgatccattctctgtgatgatacgtgcaacatggaacgtagacggatgagcagaagctgcacgctactacaccatttccctatccttttcaaacttcaaggacatcttgaatcttcttattcttcttccctccctccctcccctctctctctctctctctctctctctctctctctctctctctctctcttctcttctttttgcacaacccattgttaatttgaaattgaatactgtaatactcaatttgttttggaaattaatttgtactaccgtaccgaacgcatactgacgtgcattgcatataccatatggtactaggaacaagtttagtactacctgaatactagagcatatatactaaaatactcgtgtagatcaccagatcttgaatcggtgctgaacagaatcgatatttttaaaagagaactatcaacggaatcttgtactcagatatttttaaaagataacatactgtaaaataatgccagattcaaatactcagatctttttgatcggcaagttggtttttgtccagtttcgctgagactatcaagttgaacatgctcaaacagttgatgacaaaagcatcgagtcatcatgctatgactacttcttggcgcttcaagggttcaaaagtggttttcagaacacattcgacagacaaagcaaattcacttcaaatttgaacgaagcaaaggagaaacaatggtggtggcatcaatacttaacggtgctcctctgatctcttcgtttgattggacacccagtcctgccaagatgacaccttcatgctactacgggctgacagctgagtctctggatccagtttaccccatggatgacacacatcactgagaagtgagaagtctcatatgcctgggccacgttgaaacagacgttcgtattatctgagccatccatctgtcggcatgtgtgcaaattggtgttttccgtagcgctctgaattgtgtggctctctttgaaacagccagcatctaaacacaataatacgagtagcacaaggcaccggatcttctgcacggaagaactgttttgcctcgtcccaagttgaaatgtcatcgtccctgtcattcgagtattaatcgactgtcaatgtaggcgttagcttacgttgcagttggttgcagcgaccattatgttgaaataaacgtgtttatgataaagtaataagggttcagaacacatttaagcaattttctttcacttttttggccctgaacaattcaatagccaatagtagagctctgctgtggttgtgcagccgcagccagcgctgagctgagcagcacctaaatttatataaacagcagataaatccacacctactccattcaaacaaagtactaaagtacaggtagtatagtacaatgttgtgagtacaagaggcgaagtccggtgaggtgccaccgtgccacatgcaggcgtggtaacctggtgtccactctgcatccccgcaaaatggaaaattcaaacacaactcgacgaaatgctatccagaccgtagatgtccctttgtttcaatgcttgctgctttctttctttcttaggggctgtttagttcgcgaaaagtaaatttttaagtatcacattgaatgtttgaccggatattggaagaagtttttggattcgaatgaaaaactaatttcataactcgtctggaaaccgcgagataaatcttttgagcctaattaaaccatcaatagcacacggggttactgtaacacttatagctaatcatggactaattatgctcaaaagattcatctcgcgatttgcaattagtttttatttatatctatatttaatgctccatgcatatgtccaaagttttgatgtgacgtttttgggaaaaaatttcgggaactaaaccaggtcttaggccttgttagttggcaaaagtttttgccctagcgtgtcacatcggatatacgaacacacatttaaagtattaaacgtagtctaataacaaaacaaaatacaaattccgctagaaaactacgagatgaattttaagccaaattaatccatcattagcaaatatttattgtagcaccatattatcaaatcatggcgtaattaggcttaaaagattcatctcgtaatttacacgtaaactgtgtaattagtttttttatctatatttgatactacatgcatatgtccaaacattcgatgtttttcttgtgggaactaaacaaccccttagttcaagggcgatgttacgaactccatcagtcccaaaataaaaaaactcaggatctgtttggctagtgactgtagtttagcacaacaaactttagacgtggcacaatttcttaggttagtatttggttgagtgccacaagttaagttaaaccatactttattagcatattggtccacatgtcatactctcattttctaggcagagtttaccatagttgtgactaacaaactgttggtcacactttgtgtgcttgtcatagttatgacaaatggagttgtggtaaagttagtctccatctaaacatccccttaatctagaagaggatgtgatttgttctagcacaacgaatttggacgatatggttgttacatccccacctaggttttgttttattatggaggaagtatagtattgtgagagtttactctggtgtatatttctttccaatcacgtactactaacccttggtatgttgatttcgtttgtttcatagggattcctggcgtgaattgtttattaaccaagaatcgaactatggctgtgttattttcccttctttttcaactcatatctctttttttccgcatgcacactttttaaattactgagcgtgcgttttttataaaagctttctatagaaaagtttatattaatttatttttcaatgtttaatacttaattaattatgcgttaatgtgtaataccatttcccgtgaggttaggtggagttttcaactccacctcccgaactcagcctgtataacggttgaatccaactatcatgaatggttccccaaataaacatcaaatttgatcccctgcattcctttcaatggtacaatttatgcttgcggtgctatgatgcgcgttgcttattttttaagtttctgtaaaaccaaaactataactgttgttctttgttttactgatcaaattatgattatatataaaatatgttattgaacttttgattatttactcgattactttatacttctaaactccaacaatattatcatttacaatatatgttaaaataaaaccaatttgccaatgctaaaatgcgtaagggcaccaatgtatatggtaaagtgatccatatagatggaacccacataaatagtttttacccatagcaatctccataatgtatatagatacaatatatcatatgtatatatatacaatatattattaggagaagagagaggagtagagatagataatataatttattttatatgggtagaccatatgtatacgggtatcttttattattttttctatatggattagttgcacaatgataataggtggctgaatgaaatattctattgcttatgaactacttttacaccacctaaaagatgttagatgttggtggactcagtgtgattatgagaatccaccacaatgccaaacaacctatatgttgtattactctccgaaacatagatgaaggtgctaaccaattcttctcatttgacatctttacttacgtacaagagcgaaggtgggaatatctcaatcatagggctcaaccatggaatataatttttttgggaaaattttaactgaaaattagtactttgctaatgcaatttttttgcggtgtgtggggctcgatcctaagctgcccccacctggctccacccatgcacttgtagaacgctagtccatctgcactactcgttcaattccaattctaaaggattgtaacaaggggttatatggagaacatcacgtaggcactaaaaaaacatttatttgagaaaaaaaactaaaatattttagagtttaaatccctagcacttatattctgttggagctataagcattctaattttgtgatttagttggttctcaacctatagttttgtgatagttttatcactaaatttatagttttatgatactcagtcttaaatatatagttttataataaatttgatgctaaatctgtaatggattatacaacaccttaaatcttcatttttttataatctattatattattaagacaactttgaaagaagacaccacgctcgctgtggaggctagaaattcctacattaatcggagaaaaagagaaaaaaagctacaccttagattataatagatccagattaaagggcatagatttatcataaaattatattattaagacagctttaaaagaaagcactacgttcaccgtggaggctagaaattcctacattaatcggagaaagagagaaaaaagctacaccattagattgtaatagatccagattaaagggcatagatttatcaagaaaaaaaaaactatgacacaaactatatccagtacgaatagaaaatatactataaaacaaactctatcgggtacatacgtacatagagtcagagtcccagtgtttggcctaggatgtctccgattcagagtgagcaagaaaaggggaaaaagcagagtccaaagcaagttcatctacactccaagttcatgcagacatatagctgccactataagaccacatgcgccgatccatcttatgcagtatattttatcaatttgtcaactaaaatatgcacaataattttaggcccacattaatctcatgtgaaaaaataacaatagtagtcaataaagagggatcagtttatttgtataattttattatatgtgaagactagaaattctcacattaatcatagaaaaagaaatggagagttcaactaggaatgagatttagaaataaaaataagaaatatcgaaaacagtatgtgtaggaaacaaaacgatattaattaaaattcaaaataaaaaataaaataagttccaatgttagaaaaaaatgagagttcaagtaaaaaagatacaatttagaaataataataaatcataataaaaaaagaaacattaaaacaacaatctatctaaaacacaacaatagctaataacaataaacagaggaaagagggcgtcgggcgaggcgtaatgaagtagggtggtagtggttgatgagacatataaaaactataaaataaaattcgaatgatgattaagagaaggggcggcgggcagaccgtgaagcgtgaaggcatagggttgcgacagttgacatgatttctagaaagtaaaaaaaaaacaataatgatcagattcgattttaaaaatctcaataagagtgtgcagccggggggggggggggagggggaaggagtacagtggcagcatttgacggaatttataaaaattataaagacgaattctataggacaataaactataaaaactaagatctgattttcaaaaggtctcaatgaggatgaaaatggagtcatggtaggccaaataaaacgtggcacagaagtaagggggtggagacttatctgatttttaaaatcctaaaacaacaagatgactgttttaattttttaaaagaaaaccatgtgtaaaaaaattatataattctgtaggaaagctagccgcaaaattatgcgggccatccagatagtcttattaaaatatatgtagttttgcaataaaacaataaagaagtaaaaacttagtacacatgaagtaaaagaaatatactcctcctagttaaaaatatttcacgttggcagaacttcatttttctgatgtcaaataaatttgactagaggaagtatattataagtttttttacaacgtgtttgttaaaaatatgacgctacacttttcacttgatttcaatcacttttttcctcctataattgttttctctcctatttatatgtatgcttccatctcttccatcccctcttccacgtgaaactacttttaatcataattctcttatacattgcgtattagaaaattacatataaatattgaaacttaccatacaagttttaaaatttatataataattacaatgtaattgtaggtaagttatagagtgttttttaaaaaaatgtgaagctattaaatataactacactataatttgtatttatatttttataagaaactgtctataattgcacattacataaactaaactaaaaaaacgaaattcaaagattgtgaagatgtattatagtcttatacaatcaaaatataaagataaaaaacaaaagaacttaaaaagtaaaacaaatcgttttttaacgaaaaaaatcgatataacgggctgcctatgtgctgttagtatatatcgatattttttttatcctgaaaaaaacaaccaggttgatgcgtcatcggtgtaaaaacctaaaaaaaagagccgatccccctccctccacatcgaatcaaatccatctcttttctccccttccttccttccgcctcgcctccccttcccctcctcgccgcctcgctcccctccgccgcgccgtcccgtcgaatcccgccatgccgaagggtgccaagaagcgcgccaagctcaagaagaagcagcagggggaccaccccgccggctccgatgacggcggcaacaacaacaacaacaaaaacaacgccgccgaaaacggcagcaatgactccagccgccgccgcgacgccgccagcgacggcaaccaccacctaccgtcgcgaccaaacgttcctcatggtatggatggcatctacccttccctccccgtcccccgctttaagcccgtgtagatctgtctccccccacggcacgccgctttccgcaccagcggggagaggaatcgccttttccccccactccctcttgcggcgagggtggcattcccgtgctcttcgctggctctccggccacgttcccacctcctctttcgagctgttcgccttttctttctcttttgattgcttcctttcttccgctatattacgatggatgcgtgtgtgtttctgatgctgtggtgtgtgggtgcagtggatgtgagtgaggactccatggagagctccgaggagatggtgacgccgagggccgccgcgtccgaggcggacgaggaggagaggaaggccgccacgtcggaggtgcccgtggaggtggtcgaggccggggaggaggtcatggtggacgccttgccgcccgaagccgccgcaggtgcgcaggagcaacagggtaaggcggaggcgcttgtggtggtgcaggaaccggaggtgaagcgcgaggagttggtggccaaggtgcatccgatgcatgacccggaaccgcagggcgaggaggtgctcatcgtggaggcggctgcggtatccgcggtgcaagaaccggaggtgaagcgcgatgaggtggtggtcatggagacggctgcgccgcctgcggtgcaggaatcggagacgaagaacggtggggtgttggtcaaggatgtggtggaggtgtcacggtctctgggtgcagctgatactacagaggtattactgtttgcgatcgagtgctatgccatcggtccccatgttttgaaat

SEQ ID NO: 69544 - DNA, 1570 bp, Oryza sativa
tagagagagagagagagagagagagagagagagagagagagaggcgggatttgaaattcaaatcccggccatctcggggtgcgggcgagcgggagagggggttgaggggcgcgggaaaagcgggcgcacgcgcgggcgtggcctatgtgacgcgggaaaggcgggcgcgggcagttgcgaggcggcggctgcggacggcgggcggccggaggtgggagacgggcccaacaggtgggccccacctgtcggcgacccgaagggaggagggaggaggcggccggctgctgggccttggccttcggccggcccagcggggagggggaggggaagagaatgggccggcggcccattcgaaaagaaaaaggagggaaaagaaaaagaaaaagaaggaaatgaatttctagggaattaactattgcttgtgctcatttttaattggttaaaattatttctagagttctgaaaattccactaaaaatcttgttagcatatttcgacatgaagaactcaagaaaaatcccacatgccaattccgattattatttgcattaatttattagggtttcactcttgcttttacactgatatttttttgggaccatttataaatttaatttaggcttgagagaagaactttagggtgtgacagtctaccttttaactttctgaccaacagaaacgagaagagaagagcaaatatatgcgtgactggcgtgccagaaaaaaggctgagttaagtggtttaagcaaggtggtaacaccactcactccattacaagcagcaaatgttcatgtaccgtcagtacacggtgagtgtgaggtacacataactcatcttgccgaacttagtgacagacagaagagagaagagaagagcaaatatatgcgccaatggcatgcaaggaaaaaggctgggacaggtggtgttaatgagcatgtaacatctagcactttagtgcaatccacaattgtttctccaccagaacagagcgattgtaataaggtccacataactcaacttactcaaagtgatggaaatggactatttacaacgctattgcaggaaccaaccattgcatattctcagcatattgagagttgtgtgctgcagacaactgaactttctgaccaacataagagagaccagaatagcaaatatatgcgtgaatggcgtgcaaggaaaagggatgagttaagtggtgttggcagtactgtatcatctggcgatccaatgcaattagcagctatttcaccttcaatttagattgaaggcgatgattttcaaaaaaactcagcttacagattcaagtgataaacgaaagagagaagaaaggaacaaatatcaacgtgaatggcgtgcaaggaagaaggccaagttaagtggtaccggtaatgttacatctgacagtccagtgctagcaacaactatttcagcgacagaacttagtgaagggggtgaggtcgggcgatctgcaatctccagcacagaaaagaaagaagaaaggaatagaaagcaacgtgagtaccgtgagaggaagaaggctgagtcaaagagggttagtgaagatga

SEQ ID NO: 69545 - DNA, 11755 bp, Oryza sativa
gcgtgcgctggcacggctagccgtggctcgtaacggcgctgttcggggtgcatcggctctcggtgtgacgccgtgcggctccgtggccagcagcggttcgttgcagcgcgcgcggcggctccgtgcggcggcgtggccaacggcggtgctgtgcggggcacggctagcagcggttcacggcagcgcgcgcggtggcgcgagcggtggtgcccgagtctgcgccggcgtgccgtggcgcggctcgagagaggtaggcggcggccaggtcggcgaaggggacggcgagccgacggcgacaaggccgatctctccatccatggcagggagcacggaagcggcgactgccctatccttgcccggaggtgccgccgccgacgaggccgagcgctgtatccctgcccggagccgccgataacgaccaccgatgacgacgaggccaagcgccgccactccccatccgtggcggcggcccgtgggaagaggacatggccgccgccgtttctctcctcaacctgctcctgccttgccgctgctcttttcccctgccggtcactggtcaccggccgccggacctcctctcctctcccgcctctccatcctcgtcggcgccgcaccaagtcgctgccgcatcgcatcggcccccagacgagcagacgaggagaaagtgagagaaagagaggaagggagagaagaggggaaagagagagatgatgtggcatcctgacatgtgggacccacgtgggtcccatgctgactcagtcgccatgtagatcaaaaccggggtcaaaaccaccgagagacctcgggtgaccggttttatatagttaagggacctcgtatatctggttttgcggttcaaggacgtttttttatctcgctgacaagttgagggaccttcggtgtactttttcctttcagtttagttggggccttccataccgaattggaaaagaagcccaagtgtcctagccagccaacccaaatccaccaggcccaacattgctgaaaccctaactccccccaacccccatccccagctgtacggacgcgccgcacttgaccggccgccgcttctcacacgccaagtgacgccgcctcctcctcgcaccatgccgccttcgcaccaacagcatcctccttctcctcctcctcctcctcctccatcctcacgtcgcgcatccgtcgccgccgatggtccttgtgccgagctgttggctgccgcctctccttctccccgttgctctgccgtgccggtcaacccgaagcctcgcgatgcgtggtgactggtgagggggtggaccgtgcgcattgggctgtgtccgaatagttgatggtcgccttctcctcctcgttgtcctgccgcgcctgcaatgctcggtggcacgaggtgagggcatggaatatgagtagcaccacctcggtaatgtttaccatgctgataatcttctccacttatttgacttatctgatccagcagtttgtcatattttcggatttgtgtgatttttattctttttttctgggattattggtcagtgtagttctaatacttacaatgattgttcgattggtttgttaatcgatctttgatttttttttatttgtccggcacacacgagttagattttgtatcggactgtttttttttttatttttgccgttgtacgcgatgtaagttcgcgtgtgtggacggagggatggagggtgccgcttggttggattgacggaaaaaaattaaggcatgtttagattgtagccaaaataaaccttaagttggtaatattgccaaaattttggcagaatttcttatatatttactaaagtttgacaacatttttttttgacaactttaccaaaaaaaaaaatggtatcgttgaaaatatcatcaatctgaacagcccctttctgtggagattggaaagttactaatcttttaataattattacttcctccgtttcataatgtaagtctttctagcattacccacatctatctatctatagatctgactatacagagaccgcactctatattgtcttaactagagactcatcttgcctactaggacaccaaatgatacatgtcttttttcttcttcttctagatttttcttttaaattatttatccgatttataatcctattacactactgtgttcgttgcaattaaatctttataacaagatcttacatgactatattttgataaaagaaatatctatgttgtaaattacttttattatatatctaagttacttttatcatatatataaattacttttcgatttgattaaattacttattatacattcataatattgtgagttgtttattttattatcatttttagtcaattccattatttgtgctaattaaatttaatttctagatatactcacacttttacctccataacggatctacttttaatgtcatgacaaagttacttcctttttgttttaagttacttctataatatatgtaaattactttaaagctttactgaaattacttttatatgtctaagaagtagtttagtgaaatctaaaagtaatttagatatactataaaagtaatttgcaattttcctcaaaatataattatgtgagatcttgttataaagatttaattcttacgaacacaaccgtgtaattggatcgtaaatcggatgagtagtttaagagaattttatttgaaacataggtgataccaatatattttctatttacatgttgatatctagatagggtctctcgttagcactaaaacgagaggcctcttgatttagattttgccatctatctatctattatattattaaaacagctttgaaaggaggcactatgttcgcggtgggggctagaaattcccacattaatcgcagaaaaagaaaaagagtgtccaaatagaaatacagtttaaaaatatctgaaattcggaattaaaaataagcaatatggaaagaagagtccgtataagaacctaatacgagattaatcaaaatctagaataaaaataaaataaaatctgaaattagaaaagaaaaggagagtccaagtaggaatacaattttaaataactgaatttcggaattaaaaataaggaatgttgagagaagaatccgtataagaacccaatatgagattaattaatattcaaaataaaaataaaaataaaatctgaaatcagcaaaaagaaaagaagagttcaagtaggaatacagtttaaaattaactgaaatttgaaattaaaaataagaaatattgaaagaagaatccatataagagcccaatacaagattaattaaaattcagaataaaaaataaaataatatccaaaattagaaaattaaaagagagttcaaagtaggaatacaattttgaaacacttgaaattcaaaaataaaaatataaaaatattaaaagaaaaaagatttttaagaaataaattctgaaattataaaaagaaaaaagattttaattaggaatacaatttataaataactaaaattggtgataaaaaataaagactattgaaagaaaagaccatctaaaacacataacgagataaattaagtaacatgcctataaagaaatagagtggttgcggttgatactacatataaaaattgttaataaaacatcaaatagaatcctaatgacgattaaaaggagggatggcaggcaggccgtgaagtaaacgagcaaggcgattgccgagacttctagaaagtaaaaaaataaaccccatttataatcatatttgatttttaaaatctcaataacaataaaaaggagaagcagcgggcggggtgtataagagtatagttgtagagccgccgacggttagcgggacctctagaaaataaaaaataaattccgacgatagttatgttcgatttgtagaatcccaatgacaataaagagtaggtggcgaatgggccgtagaggagtatactgacatcgtttgacgggacttctaaaagttacaaaaaatgaaacctaacaagacaataaactctaaaaactacaaggtccaattaaggttcagaacttctaaaaagtaaaaaaaaaaactaatgataatcatgttcaattttaaaatctcaatgacaataaaaaagggagacaacaggcgagccataaagaagtacaatgacaaagccgctgacggtttggtgggacttttagaaagtaaaaaatgaacttgaatgatagttatgttcgatttttaaaatcccaatgataataaagaaaaaagacagtggacgggccgtagagaagtataatggcagcgtttggcgggacttctagaaattataaaaacgaaacccagtgagacaataacctctaaaaactaagatccaatttttaaaggtttcaaagagaatgaataaaaatagtggtagatcgagcaagcaaataaagaaggatatgatagaagtaaggggtagcagctagggcgacttttaaaaattatataattagaaatacggggatgataatgtttggtctttcagctatttaataaattttaaataaaatcatactgaaaaatattgtttgtttgctagccgcgcaattgcgcgggccacccagctagttcatatagatgttaatgaatctaaacatgtgtgtgtctagattttttaacatctatataaagatgagtcatctaccctataattcaccaactcatcttactcatatctcatccttacactcttacaccttacatatccaacggctcatatctacctgctctataatccaacggtccagatcgtgtgcagcttactcccttctccctccgcgctcctccccacgtccacgcggctccttctcgcgattgccccgtcaatctcgtgattcccgtgaatcgccccaatctcgcccccttcatcggctctagccgtgtctcccatcgccccgcgccgccgcctcaccatcgtcgtcgctcccttccctctccaacgccgccgtcgcctatcacgcccgaccccctccatcgcttccccaaaccgtgtccctccccgccgccggaagccctccgtcgccaggtcgccgccgacgctgatctgctccaccacccactccccgctgcacgcgaccagttcgccgtcacgcgccgtgacccgtgctcccacaccttcccgccgccggaagccctccgtcgccaggtcgctgccgacgccgatctgccccgccacccactccccgctccccattgcacgcggccagttcgccgtcgtgcggctagacccgttgtcccacacctccccgccaccggaagccctccgtcgccacgtcgccgccgacgccgatctgctccgccacccactccccgctgcacgcggccagttcgccgtcatgcttcgccgtcacgcaccgtgacccgtggtcccaccggttagtttatgcctagcgctaacacaatgccaattgctgtcgttcagtacgtgcaatgctcagtatatacaatgtttccgccaatatcaggttatggaatggggtgaactaatacatccggattggtgagatcagggtgattgggctttttttttcagttttttcttatgatgaaaattttgggatgtttctcatttaagtgggatggtaatgttgaactataaatctggtgtgtagcattgctactgtggcagcagtttgctgcttactggctgaataaactcataaaattgtttgcctatgtgctcaatgatgtacagttgacaccatcctccccagctccccgccgtcaccacgcatcccaccgcgtcgcccccagtctccgcatcgtcaactgcctccgctcctatgtgagtcatcaatcgcctccactccacctcgtcaaccacctccgcgcgtccacttgtcttggcctcttcaacaacgtctcccgcctcgacctgattcaccggaaggtatcatcctcctcccccctcaccccttctctttattacccatctgaaagaatcaaccaaaataagtgtatctatccacactttttgtttctaaagattgagagagggcatctatccacactttttattttacaaatatcatagtacattgagttgcacttcactggttatttgacaaataagtgtatgatatgcttctccataagaatggtgctggtctgcactgtactttattatcttaaagtcgattgctcaccaactaagtgaccggtacgggttatctaactcttaaatcagacaacacctattagcttgttacacatgtcagttgttcacggttatttaattcaaggttacttacatgttctcctatggtctttagtactgtcatccatattctgatgcagcttaacatttttcttaatatacatgtattagttacaatacattcagaaatttagtgcactgatttatatgcttttcaagggtttcgacaaggctattactgtgttttggctgtgtttgaggaggttccttcgtatagcaccctaaatttatagacgggataaaatattaagatgaatcagtgttgattggccttatgaagaaaatatatattgctcataatatttgttttacaactttgctccttgaaggttttttttttggaacgtattgatggttttcctcataatatgttattgaaatccgacacgctcacaatttcagatataaatagctgagtgtagggatgtcactaatcataactttgtttggggattacttagcgatgtgttgtttttcatgcaattgcagttcattatgaaattctccaaatgatactgctaagttgcaacttttagaaaacaacacaatgagctccttggaccctgttatgaaggcaaacttggagcctgttatgagtatttagctttttaatacacggctacttacctttctatttaggatattacgtattccatgattatttaacttcagaattaatctctgaatatcattacggcgacctccacctgtcactgacgaccatccagagaagggcatccctgttcctctctcttaatttggtgataccatttttgggtctttctgagtattcagtatactcattttgattttaatgatgaatgaattgcacactaactttaccacattggttttctagatccatcgccgtcatctggcaggagcagaagcgaccaattcatcttggcatatttcttaaggtaaaaaagttaacttttattgtacattgtagagttcctacctcctgccggtggatacgttcactcaagcttacggggtttctgttggcaaagagagttcctgggttttttatgttattgcaactgtgcaactgatgataacatatggtacttcattttacaggttggatcataggtatttattttgtaaaaaaattagctggtttagggcaacaatatggtaggtgtggatgtgtattgcaacagaaaaagctaaagtaacagtaaccattattgagggttcggttttcgtgctatgagcttttaaaaaaatatttcttcagttagagaaaaaaggttggattttcatataaaatgagtccaaatcgaattgttcgtgttggatcagttattgtaaaatacaatagctagagagttctgttccactaatcgaattgttctgggatatttattttcaacaaaattagacaggacagagaaaataagtatagtcgatagtgattaatgtgaaagggatgatgctcacatttcagctgtgatgaatgaaatatttgatggcactatggcaggacatttaattttcaggattatattcaactttttttttacaatttgtaatctgtagggtgtagactattcaggtttacaggttattatggtccatcaaatctttgtatattttttgtgtaccataaactagctccagtagcatgtgatgtcaaattacctacttcataactttaggggtaaaaggaagaattacctacttcagaactttagactctaaaaatgtaatggcagtgatttccgcctccagatcaccgacaccagccgcgccgtgattccgacaccgggactccttgcccctgcgacagcttctctaccgcaacaccgtcaagtgatatcttttgcaccctgaccggaaacctctctactgcgttgcgaacaaggtaatcatcgctcgatcattttctttcagccattactgtttaaactcaaatgcggattaaataatagtggatgtgattgtgaagtatagtgccatggctgaatgtgtatatatgcatatccacatattaaataatcaacggccattatcaagaaaacttactgaataaaaatgaatatatatatatatatatatatatgaatataattttcctccctaccaccatagcatacaacagtgggactattgaaatgttccttgtgaataaataatatgaacttatagcaacagttgagtacatgcgaatgtgaatttcttttactggaaatcagcgaatttgaatttaagtaaacaagaatatggtttcagtcaaataatgttatcttgcaaagttatgtacaaaatgttaagagtataatctatttatatatatctattaatttttatgctgttaacatacatctacttgcatggtactgtcaataggttgatgtattgtcaatattttcatgcataatggtgcatgttttgcttttgagttgctttcatctgtctaaaacattaattttcaggcattagtaacatgattggattttgtaatcgcattttctttgattgcaggttttggaaatccttaacggatgacttttgaagtctaaatttttctttcatccctgccacaggaggtacatactgtgccgtggaagatgtgtaatcctcagcaagtgatcctttgcctttccataaaaatgtgcaaaaaaggtgtaacaagacaatttgacaggataattcgtactaaaatattgggcataatgagaatatggcttgttgagctttatgggattatggtctttgattgagtgctttctataggtcgtactattaatatgtcctactgcatgttttacaagttgtgctacctatttatttattttctaaaaggaccaacaggtgctatactcattcaacatgtttatgagctgtcattattgatgttagtaaaacttggattggcagttttcatggtttcaaattagtacctacagtcttcattttacagtatagaccaaatgaagcggcaacattttttagtaatgtattagatggttaccatcaagcttttggaaaaatgtgctgatgtgcatgtactgtaaagctaagtatgttcattaatctcacaacttgttaattaggtagctatggatggaaattgccctgccaatggagcacgaattacgttgggtgatataaccaataaaccaagggtaaattgaaaccatgccattataattttataataatattgagacatacatagtatttattttgttcattttttcaaacaaaaatcacaggtaataatttgacagacaagcatgataaaatatgcgatcaaacaagagaagatagtggagagcaaacagtgtgccgtactgatggtactagagtgtctatgtcacgcacaaaaattcccgaatagaattccaagcagaatgtgcattaaaaccctcgtcctggccggggtacacaaacgacaaatttgacatatagatccacgtcttacaaatattataaaagccttacataaatgcagcggaaaattaaaagataactggagctaagccttgacttggactgcagcgggaataccacttcacaggcatcctcgacggcacggacgaagcctactcctcggaaaagccaccatctaacacgtactcaaactctggggtttggggaaaatagagcaagactgagtactacccactgtactcagcaagtcataccggaataggtgtatgatgcaggatataaccaaaggatagctagagcggttcatttgcataaagcgagcatttaaagacagtagttgaaagtagaaaaatagttgtaataattaatcaatattaaccatccactgtccaacgctacaccatgttgcaacaggcccaaccacccacctgaactaatcaattccattagactaagctagggtgagactaatcacggtgaatctggttgaccgcccataaccgcgggcacggctattcgaatagttttactttgatcagaggtgtacaactgtacccacaagacagccccacgacacgtttccgtgcgccgacatgccaccacgacataccggatagaggccgtgataggacccttcgcataaccccctctaaccaagcacaccacacctcaggtttcacccccactcctcgcaaggcagcgggcagtcccctctcgtgcctaggtgaatccggaagccgcataggccgtcgcaaggcccatccaaactccatcacgcccacccttgcctggatgtgtcagctagaggaaagctacactacaagcccagccgttgcccacgctggcttgtggtaagtacgataagttcttccagggcatcccgcgaaccggtccttaagtgccatgggcgcgaccatcaaaaccatgcacccacagcccaccatatgatatattttaattgaccaacaccaagatggtggcactaatccaacatcaacactagaacctgaagtctatgcattaatgcgattctcccattgtgtgctagttaaactaagcatggctaagcaatccctagtccaatatctagtcatgttatatcccaagctaacaaaggagcaaggtacaaatagcatagctaaaacagtaggtaaccatcccatggtatcattgtaaatcaatgcagtatttaaaggaaaacaatagagcctttgcaatataggatcaacatgttcaagtgacaagcatgacttgccttgctctgctgctggaggaacctcggcgactatttcaaaatacaccggagcgtcgggagagccggaatctaagcgacatacaaagcaaacaatataaataggccataagactactgaaacagagaacaaaaccatttttaatggattctttgcatttttcttgatttactgagacttgaatgggcttaaacggagctcggatgaattttctatgaatttaagaagattcactgtgtttttactataaacagaaaaaccctaaatgatttattgcgcaataattaaaaccctggagagagagggggcggcgctgacatgcgggccccacatggcagtgacacgggtggcggtccgcggtggaccgagtccacagaccggggaggaggcggcacaccacgtggcgctgatgtggcgccgacacggcggccatgcggcagccacgtgggcggccaaatggacggccccgatctaccgcccggtagatcggacggcggaggcggctcgcggccgggcgcgcacgggcacggctcaagccgacctgccagccgtggcgcgcgatggcgcggcgcgacgcaaggcggcgaacggccagcggcggagagcggcggcgaccgacggcgagcggcgatgcacggcgagcgacggcggcgcggccccgagcggcaaggcggcggcgctaagagggagagggggaaagacggcggggagatgctcacggaggattcggccggcacggaggggcgacggcgaacggcgacgaggaatgaccgggagacgacggcgaacggcggacggtctccggaaccacctagcgaacatgatgaaagggggttagagagagagagag

SEQ ID NO: 69546 - DNA, 10734 bp, Oryza sativa
gtccgggcggcggcggctcccctccccctccctatcagatctggccggaggagggagggggaggccggcgggggcgacggtggcggctcccttcccccctccctcccagatctggccggaggaggaaggggggaggccggcgggggcgacggcggcgacgactgtgcaaggcggtcggcagcgtctcccctccctccctcacagatttggccggaggagggatgggggaggccggcgggggcggcgacggcgacgaaggcgcggggcggcggtgaagacgacgacgacggcagcggctcccctcccctctcagatccggccggggagggcggcggcggcgagccgcgtgcggcgatttttttgttcgttttttttttttgcattttcgcaggcgggccgttgccccgactgctaaaatcgatgattttcacagtcgttgtgatgcaggcggacctccctcccgcctacgaagattagttttggccacctgcgaaaattagttttctagtagtgtatgcctcacacatgtatttatgttaggcttgtatggcttctaattgagaaacaaacaatacatgtgatgtattttacatgattttcaccatcggaacaagatggcgactcatttaaacaatttgtaagataagtgactaaattgcacttatatcacaagttgtgataccacagaatacattttactcaaagaaaaatcagtgtctttatatgcataatacttcctaactattctatctatcctaaaattaactactagtcatttaggattaactacctagttatagttatattcaaatttgtaatactagataacgatattttaagatgaagagagtatacatattttcttaaattagtctaagctatttatatctgttgagttctttactactacttccacccaacatttcaaacatttcaatttgaagattgtccaagaatataagcattcatacactactgcttactctcagttaaatttatctcatcgtactcccaaccaccttttcaccctaactctctctcgttaaatgtgggccgggcactaaaatcttttttcttcaatcttaatctttgctaaataatctagaaatgttcgatgaagggagtagttagtttttgttgttatgttaacgttgataaaatagtaaattaaaaattaaaaagatgatactccctccgccacaagccgtatgttgtctcgttacggtcaaaatttgactaacgattatcctattttgatatactttttatgacgtaaaattgatgttgttatattcatatttaaaagtaatttgtatcatattgatatattagtaaagtgattgttttaaccttgtcttagattggcatgttagaattgaggagatggctatgtttttaaataatttgtggcaaaagtacaattttacccctacacgtctatatttttatggataatcatacctcttcatatttctactattgttaaataaggttatagtataaaaagatctgaactctcaaataaaattagatttgtggttcagatcgattaacttctactactagtagggagtaccatggtaggactcaaataaaatacgttatatttatatgaagtagtgtaaatgagaaaaaacttgttctaacgagcttagctcaaccaaatccgtcttctatcagtcaatctagaaggcctgggtgccacccaagtgcaaattcttctcttggctagtcacgcaaaatagagtttggacggcagataggctggagaaaagaggatggtaaaaccaaaatatttgcccactttgctgcactgttgacgaatcgtccttacacctcctggccaaatgcagactcacaaagaggatatgagcagaaatccagagatggactgggacttacctccaaatggacgattgggaaaactgccactcagtcgatcagtggtggaccctcgtaacggaatccccaaacaccccgcacaaacccctaaggaccctggtgattttaatctcgtgggaaatctggtgcgaacgaaacacaagaatatttcgcagcaatgcatctgcgccgtcctcaattttagcaaagatcaaggagaaaggaagagcatggatcaaagcaggggctgtaaccctgcaggagtttggaactttgggagatatcacttaatatccgccttttgtcttccttttgcgggttattgcttttttctggctaaccctgtatatatcttgttataatttttttctactctattaatatatacaagacaaagctttttccttctttaaaaaaaaacgagcttagctcagctcacgaactgagcaaagttaactagccttaatcaatcgagctgtagcctcgttatccacctcaggtgtggctgctggcttggcttgtgggcttgtggcagcgtcggtgtgggggcgatgattttgcactcgatgctgtgaccttacttggaagatgctatgctgctattcactggcccgttcgtttttgacagccttttgtggcgtcaaggcttgatttgatacacgatgttcacgatgatgtctccagccatcgtgccttggcgccttgcttctgtcgctagcagcggtcagggtcttggcgtcgaacatgccatcatggctcgccccgacaaaattgacggactcacgtcgcatgatgcttactattaaccattcaatggaagattggaagaactagtgtactattatggtctgtgaatttccaactaaattaaaaataactaaacaaactcctcgcctgtttggtttctatttgaagagaaaggtaaaccagagtggttagcgtctttctttaatcccactggccttttgtttctcttcaagcaccgctagatttattctactacatcatgggagtgatacatgtagcttttggcaaaagcgaccttaggagaaaatttggattggaagctaacagcagcattaacaatgccacgaaattgttgtccaaacattactacggctcctaaacaataattggaattgactatcatggatggtgctcctaaacagtatctatctttctcattgctttcgtgggacacaaatcaagaaaagctaaaaaaacaggatagcgacttgggcaagcaattagtgagaaccttgattgttccttcttcaggagaggaatacacgttacacagtcctcccagtggcagcaacttacagagtacaagtgtaagaaacttaattattcttacaaaatctcatagtagtaattaactacacagtgttcacatttctataccctttatttatatttttacccatgcagaaatcataaaaaggtgttaattaaggagtatggactagtgaaaattaacagagtacagtctctactctcccggttggtcatgccctctgtgtaaaatgccttggaagaatattgtatatacgataatggcttaattcacaagaacctcatcggaagtactcgaagttgaagtcgccgaccaccatgctccggctgacgtcgaagtcgaaatgtgtcatgccctgctcttgctgcccatggcagggcagcccgaacttgtgctccatggcgtccccctcgccgtagcccacgaaaggctcgaccttgctctcggtggcccaatgcagcggctcgctctcgagcgcattgttcacctccggcgcgcccacgccgcagttccagttgctgctgttgctggagctctcgccgtagcccaggttctccgacacgtcaagcacgctgctgtagtccacgaacccggccgcgtccttgccgccgaggtggccgtacaatggcatgcccgtggcgtcgaacccgctgccgaagctgtcgatcaccgggaacgggtcgaacacctgctgctgctgcttcagggcgaagccgtcggcggtggccggcggcttctggtcctgcgtcgacgtgtccaatgccgccgccgcagcagcagcagccgtggagatgggctggtgggtgctggggtcgatgccgcgctgcctcagcttcttcttgaggcagctgttccagaagttcttgatctcgttgtccgtcctccccggcaagtgcgacgcgatttgcgaccacctgcatcggattcgcctcgctgatcaggccacttatcgctaacaaatcacctccacacaaccacattgcgacgaaaatagtactggtacgcattattgccggagcggcagtacgtacgaacctgttgcctaggatctcatgcaggccgacgatggcgtcctcctcctgctgcgagaagctgccccgcttcaggtcggggcgcaggtagttgatccaccgcagcctgcagctcttgccgcacctctggagccctggagcacagaagaagatcgttgcacggcacgggtcagcgatgagacactgagacacatgcatgcaaagagcggatcgagcagagcaggagcagcttacgacctgcgagcttgggaacggagctccagcaaccgacgccgtagcggtagatgtgattgtagagcttctcgtcttcctcgggagaccagagccccttgcgcagcttctgctggacaccggcggcagagcacgcgtgccgtcccattcccgcccgacacgcgagcagctacctgccgctgggttcgttgcccttgccggcgtgtatctgtctatcgatctctctgtcgatcgaggcggccggctgggcgcccgatccagggggtatatatggggaagcgtgccgagaactactgcacacacacacgtacggtgcgcgcgcgcgagggaggcagcagatcgagcagcgatcaagtggcctttaagcaatcaaccaacgagccacggagccaagcgtctctctacctagtactcctcttctctgtgtgtactacctggtgcgtgcggcttgatatcgtgcttccgctacaatggattggagcttaagatatctccggttcgtgagagaaattaggagaggagaggagcgcagacactgggccagcgagcgaaagcgagcggcaagctagggccccgcgggaacaggacggaaaggacggaggaaaaaaaaagcagggttagttggagattatgactaagatttttccatcaacacttggttagggaagaacacggtacagccatatcactattaatctcactattaatccctccaggaaacttgcaagttgcagctacacgaccgaagctataagcgaggcagcgaaaaaacacacgcctcgtgcagcgctcgtacactgggagggactaatgggcgggcgatcgccgctcccctatactctatacactcctccctcccttcccctctccctcctctctttcttctcttcctactatagtacaccacacaaatttttttaaaaaaacaaaaagttagaaaaatttatgtataaaaatactatatataaaaaatttgaattcaaattcaaatttgaatcgggtatgtaaactttagacttataaattttaggtgtatagaaatactatatatagaaaatatttgaattcaaattcaaatttgaattcaaatttaaaattgaatcggctatgtaaacttttgacttataaactttaggtctataaactttaggtgtataaactttagatgcataaaaatactatatatagaaaatatttgaattcaaattcaaatttgaatcgggtatgtaaacttttgacttataaactttgggtttataaactttaggtgtataaactttaaatgtatagaaatactatatataaaaaaattgaattcaaattcaaatttgaattagatataaaaacttttgacttataaacttttggtctttagatgtataaacttaaggtgtataaactttaaatgtgtaacttaaggtgtataaattttatgtgtataaatttactaaagtagaaaagtaatacggtgccaaaaaaggaaacaggtggagagagggagggaagggggattgatcgctaccccccccccccccccccgcgtcccaggtgatcaatcgccgtttaggatttccgtactcggttgctatacctatatagcccgtggggccaaatcaacagggtaagatcgtacggcggccatagctctgccgctaattaaacacggcttaattagtctgctgtgctacgcaatgcagatggcggtctttggccacgtcttcaattgattgtgcccggctcggtcgacactggccgtaccgaccgcgtgtgtgcctgtgtccacgcatggcaataggcgaactactaccgctgctgccgactgtcgcgttccatctatccgtgttgatttgcaggtgccagccccgtgcgccggtgcgcgggtggcgcggtggccaactgtgcgcggcgagacagccgaaggtaaagctgccatccaagttgcggccggtcgggggacgtcacattcgtgcgtgtaaatacggcattgtttttcatagatcgggttaaactgatcactgtccacgagatcctgaagaggatagcagccgacagttggaattgcagcgttggccccacgtctttccacgtaagagtccttttgtggggtactggtactactacttgtagtaggaaattttttacacggccgaatcgatacagtacctagaacattctttcagaatttctactttgttatgttctaaagaaggcataaacacttaaccaggttgcttatcgcacagtgtcagtttcatgcatgagaacatgtacaggatacctgtcgtaggatctactgacatgtgggtccgatatgcgtccgtagacggaagaagaagttgatgattttttttttcttccaagtagagagtggatattctgtaacagttaaaatgtcgaagcataaaactatctttaatttaggtgcgggggtaaaaaccttgctcgttctagaaagacatgcaaaggtgaaagttacacgctgaaaggtgaaaataacgcacacgctttggtctcatcagctgcaagaaagcagaaatgagagagcaaaatgaccacagggagaggggtacctgattaaccgccgagcctagccaaagttactgcagaacaaaacgggaacaaacaaaccaagcaaagcagcacagcagtaggccctggccatcgtaccactaggaaggaaaaggtgagatgcagatgttcagttcaacgtaccagacggctcgatcgatcagtcgactccatcctaaattcgagtactacgtacttgcagtgcgtggctcgatcaaccgtgcaatcattcagctttcagtacactaaaagcgagggtccctaaagcctcgggccatagcaattgcatgcaggacagggcagcccccgcttaacccccagcacttagcctcccacgcttgtgcgctaaagcatacgcatgatcgagttgtacacgtcaacctttttattttcttttccatctatctggaggccctaggcactaattaagagcacgatactaaaacgatcaaacttgccataatgccatgcacgcgttgcaacgaatttctcaataacggcacacatcatccgtggtgttcatgctgttcttgcatgccaacgcagcttgtagcgcgaaaacgatctgaaaaccacttaatttaagtgctctggcctgtaccgattaattagctagtgccgtgaccctcgttagagtggcttgaaggctcgtgccaaatgatggcagctagttctcagcagtatgactgtgcagggagatagagataagaggccaagagcagtgctcgatcgaggctggctacaaccgcaaggataatgatgtagcgaggggtgtgtccgttccgtccaggaggggagggggggcaaagctagcgtgctccggagaaagcatgcagggttagcgtagcgcggagaccaccagcaccacccgtccaccgcgcgcgcacggcctcggcaacaagtttggtggccaatcagggtcaggcttagcttccagcctgctccatgtacatgtcgagttcggtttagttgggaaccctagtatccctaacggccgcgcacttaattttttttaacttgctcttggcgttgttttgtgcgcgctgcaactgcaaatgcatgcagacacaccaagttgcaccaatgtgctcatgaattgtaatgcattgatcttgtgccttcacagatcgattggaataacgggaaaattgtgtttgcagtgaatgatcagatctgtgaatgctactgagcatttgtctgattctcccctcttttgacttgagagactgctactctgctaggcaatatcagtgatcaatcacttgcctaacggtgtctacaaaagctaattgcttggaaataacaacacatgtgtgagtggctaagtggtgatagcagtgcggagtcactataatgctggaggcacaattttgcatgtcaccggtaaaaaaaggcatatttttcgccagataaacctgcatgagtgaaactcaagaaatgtgcgtcaacgtagtagtgttaaccttctgataaaatgggatgatctacatgttccataggcgacaatgcttcttctccaattcttctgacgaagttacccgcgtaccaggaccagggtaggcagcttttccctttcgaccgagcttgcagcagttgctaaaagacaagctggcctctttttcacccacaagaaaaaagaggctcacttgaagaaagttggacaataacacaaaaaatatatttgttgacaacttggtactgttatcatcctctccttcctttttgtactctgttttttttctttcttcaagggaactccaattgtagtaccaagggggccgggggcaactgcagtgtattcttgcagttgacgttgattatttcagagttcagacaagtggacggctaaaagaaggaagaattaggactaccgactaccgagctacgtagccactataaggcaagttgttaccgctgcaacttccgcagcactaactaagacgacgactacgtggtagtatgcgggatgcatgggcgacatgtaaaagaatcgcccggcaaagtagtcactaatcgatcaattgggaattacctcaagtgcatgtctctattgtggccaaaaggatcctccaggattctcctacctgaggcttgatcttgacatgcctcctctataaaggaaagtactactagtaagtaaaaccccaaaggtgagagagcgagagaagaaagaaaaaaaaaacaaactaaagaggtggtgcatcatggtagctcctctttgaagttatgcaagcccaaagctagcagctaagtggctgcattacacatcacatacacatgttactactagtttactcatcgccgagcgacgacgtcaccggccgatatctctgggctcccgaggttggtgcgcccggccggcgctgccgctacgtagtagtagtaatactagtagtacgagttagaggccgttgctgtcacaaaaagatggcgtgatgtgcacttgccttgcatgactaacctgcatgattgaacttgctgctggctagctgcaatggaaagcgcctgctcaagccatgcagaactgaactgtgcactaattaattctcccctcacctaattcagctcgcctctctctgttttttttttcattaggaggccggacttgctgcatgcatgcctggctgtctggatagtgcgtactgttcctttcctacccctctttctcgctctcacggcacactgacaagatatgggctaaggtacgtagctaatagcctaatatctagtagtagtagcaactaagctagagccatggaggttacgcaacggaagccaagcaacataactaatcagtggtactctccagtactgtccaactgtcctgatgcttggagcttggaaagtttggatgctagctgcatttcagagtaaggagcgtccgtacacgcagtttactgaattttccgttcttcagttcagaggattgtttcttcccgtcgtcctctgcttcgtttcaatattggtgccgtccgatctaggagtagaaatggaatccgtttctagtgcattccgagctacctgactaatcattccagcgtgattgctttcaaacggaatcctaccgggcttgaaatcgcgggcgcaatgcagttatcttcgtagtgcgtaccaagctagacaatagtattgcgcgtacgtcatttctacgtatcagcctaatagcctattagtgatcaatgcatgcatcagatgcatcttagaaaaaacttacgggcaaagcaagaattaatcatctggccgtgcgggtgtaatccgtatctagccacgaggaaggccgtacacatgtttcattgcttaatataacaaacttgcagtactgcacccacggcgaacgttgaaatgcaacgtgaatcgttctgccattatttgatcatccgtagctcgagtttctgaatattattgggtactccagtctccaaatgaagtttttgcaaaacaataaagtgtagcttcaggggcagaaaacaacgaacttccagtcgttaagtggaggtggccttcagctccacaaagctgcacattttctgtgtctgccctccgggctgcggcttcagaatgttctgccggccgacatgcacgtcagaaccagcatggactagtcgtgtgtgtgtttttagagaagggtattttttacccggcctctacatccaaccggatatatacggccattgaaatagggaacttagccctgcaaacaacccaatctgaaattcgctccatagg

SEQ ID NO: 69547 - DNA, 29484 bp, Oryza sativa
cgcgcctcccgttgcatcccgcgcgcgcgtgccttggtggccgaccgcccggtcgccgccgccgtcagcctctgcacgcgcctgtcgccggtgtcgccgctccgctccaaaccgtcccgccgtcatcgccgtcgtcatcgcctcggccccgccactccgcgcgcaagccgccaagggacggaggcagagcccctcctccctctgccgcgtcgcccccgctcccctcctccttttcccaaagaggcaaggggcaagccccctttctctccctccttttccccttttcctcccgccggcgtcatcctccctccgccctgtcgccgatttggccgctagccggagcgccagctcgcgccttgaccggccaaagtcggtttccaaaccgacattgccaccctttaaagcccaggcgccctcccttcctctttcccccccattcctccccgtttctcgtccgcgccattgccgccgccttccgagctctgtctcgcctccgccattcatcgccaagcgccgggagagctggtgcgttcgtggacgcggaaggggactccgggcgcgccctctccttcctcttccccggcccgaggccggagagattactcccgcgccgtcggcctctcgtcacagcgccccacctcatctcggtagtgcctccctctgttcttcctcctcgctccatctcctccccttagactcgggtagtagcacgagtagcctccccgtagctagccagcgccgccccgaccgttgtcgccgctcgccatgtgctcgccgccgtcgccgcccgtgctccgtagcacccgctcgtcgccggcctcgctcggcgtagctccgcccaatccgacgctagcaacggattcccgtagccgcgtagatgctctcgccgccgggaatcggtccctcgtgacctcgtcgcctttttcctcttccctccccgccggttgccgccgccgcaatccgccgtcgacgcactccctccggtgaatccgagcagttagctcgtctcccctcgtcctgagcaaccacccggtgtgctcgctctcgcctgtatcgccgtggttcactccgccgctcgtcgctgtcgtccgccgtccgttccggccggcgtcgtcgtctacctcccgccagcccgcgtggcagccacgtaggcgccacatcggcgccagctcgcccgagatagggtcgggctgaccccggtcagcccctcccgtgcgcgcgttccaccgcgagccgtgaggctgcgcgtgggcccgccgcatccgttcctccgcgaaccacgcgcgtgcaccgcatcccttccccgcccgcgcgtgtgcgccgcgtgctcgctccgcacggtgaaccgtgtcaccgacaagcgggtcccaaccgggaccacgcgtggtgagcccggtccaccggctctctctctccttccctcccgcgcgcgcgccttgggccgccttgggccggccggcccgtttagctcggccgaaccgctccgtttctctcgggccgtgccctagccgcccgaggaaaagtctattttccctccctcttttcttttcttttcttttctttttcaaaaaaggatttaattaaatccttttcctttagaccaaaaatccaataatcttagaaattcaatattttcccaatcgtaaatccgtttgactccgttcaacttccaaaattcctcaaatctcgagatctatctaatggcacgcttagaggtcattaatagagctttattttcgccgtttgttgagttgtcccgtttcgcgtgtagtttcggagcccgaagacccgcagtgcgaggatttcaaggatcaagctccagatctcgagcaaggcaagccacctttgaacatcttgagcctatatttgaactaaattatgttgcttgaaaaatattatgcattgataggattgcacttaatctgttgtctcgtctgcaaggcagattggcggacctacctaatttgttgcatttgatccttcctttgttgattgatataccatgtccccttgtaactatctagttgcgtctcgatattcgtgcaccctgtgcgagtatcgacggacgccttcaaacttaaaatctgagtaacaacttgggtaaaacttgggttttacaaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccaaacataagacaagtacgaccacatgggtgaaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactattcgaacagccatgcccacggtcatgggcggatgtgaggtgattcctagcttagttttgtttgactactgcttgtgaaattactgttgtggaaaggggttcgatgtttgaaaaatctgcagctgatgggatcagctaggcccgggtggccgtttgaaagttgttggcccgggtggccgtttgaaaagctgttggccgggtgccaaccttgtttcaattctaaagactgatacattgcacatactccgaccggacaagacgcactgtctcatccgtgtcgtttgagaagcactcacttagtcgtttttagaaaagagttcaaataaaatcaattgcaaaaacaacagcctctccttgaagcctgcattaaacacttatttcccatggcttgctgagtactcccgtactcacccttgctctatataaataatctcccccccagttgctgaagaagatgaagcggatcctgctgatgaggaattcttctaggagcaagccggctacgatgagttttagggtttcggcctagttcccaagtcgcgcctgtgttgtttggtccaagtcctggcttccgcttcccttttgtaatgcagttgtgagctcgggatctgtccacagcccaacatgactgtacctctactctttaataaagagacctctgtgctgtggtaatctgtcttcctgtgataccagcactgtgtcctgggactggtatcgattaacagttaatttggagcgtcacgggctagttccggtcggtactagttcggggcgtgacacaatcaacacccaccagaagccacaacaaagaagcctacatacgccaagacaaaccgccggatatcgatatcagagatacgcctggatcgaccctatccggtaccttcagaggccggccatagggatctagtactgtctctgattccgtcgggcgctagctcgaggaggaaggctaccctgttgtcgactacgagtcagatcgtcagaccgccatgtcgacaacagttagataggctaccccaaatattgtactggtgtgattattataaataagagcaataccggctttggccaacaggatgtagggttattacctgacaattcaggggcccgaacctgtataaaaatccatatctccgtcttttttacctcagtctcgcatatatcttagcgccgacgatccccatactatgcaaataccagaattgcgacatcaaacgtcgacactcattcacggtactttaaatagtcactttactagtgtttggtttgctatcaatatatgccaacaacacacatataaattatatattaaaaaaagatggcactactaacacttacttcatccgttttatattgtaagttgtttgattttttttcaaagttttttatgtttgatcaaatttatagaaaaaaatttgcaacatctacaacactaaattagtttcattaaatttaatattaaatatattttaataatatatttgttttatattaaaaatattactatatttttctataaatttgataaacttataatataaaaatggagggagtaccaaggttttagtattgtcaacattttaacatgtagctaaccagacataccctttggatacgtactaccaaagagacgtgccaaggtgtacggggagtcaaagaaattgcgtcgccgagggaggaggatgtacggcagttattagtatagctgcaacttatattgttagtaactgcgaaaagaaaaattgttattacacgtacactgtagataaacctgaactcttggattcggatccaacacggaagccatcacacacaccatagatttgcagcagatccggatctctctcacacacaaacacaaacacgactcacaagtcacatgtgacagtgcaggattacagggcattgacatcggcgagacgctgacgtctaagctgacgccggccggagcacgggcacctcctcgctcttctttcgtttttttgtctggcgtcccccgcctcttggtcctacactcctactaactcctaacctggtcgctttgcttcccctccgcggccaggcccaccgcgcggccggccgagacaaggcccaacatactaagcccactgcaacagcaaaaccgtataagctcgcaccgtgccgtgccgggccaagccgccacacctccggtgcactgaagactgaacagcggcgtgtagacttcgcctggtggcaagctctaggtccccatataaaaaccaaagagtcctgcgaggcccatcatcacccatggccacgaacagacgaactgatcaaattccaatcagaccatatgtagtaatgccggtttgccggtctagcgaacaacgtgaagatctggttacagcacagtattacatcctctgcttgactgcttcagtaacaaatttcaggactccgtcgatcacacggtccccaggtggaaactgtgtcttaatcaacgagatagatgatcaagctagataagtttgttaggggctaatagatattcatggcgacaaattcatcaacatttatgccaggaagctggaaggctgaagaatgcttgcttgcccggttctctaaaatactccagtgctcggttatattctagcctctaggcaaggtcttacagttttcatctgcacagccttttcttcagagtgtcacgcagagactgatcatcagggacaagatactccagtcaagatccgtcagaaaaagacagctcgaagatacatagatgacacggaaacagggatccccagcttgagaacctttccgtcggcgcagcatttacctccctcaccggcaataagatctcatagccgcaagaaactgacatgttcccatccagaaaaaggcaacccctgttgtagaacagagtcctggagaatatggcattgcctttatgtcaatggatcatcccagagaagggaaggccaacttgcaaaatcagaatgctaacaagccattgttaatcttgatatctgcaacataaaatgtaacatcagatttaattcgggaacacctagtagtgcacgtgcacgaatagtgggtcagtgaaagattatccctgccacaacataggtaactacgacgataatcctttagccaacatactgatgtggatagcatatgtgaaatgaatagtttcaggtgagcgttgacagcatagtaaatctaatttaattaggatatagatctagcaatgctgtttcagatatcgaaagagagaatatacccgtcttttccttccctttcatcaattgcctcttgtatcagctactatgcaatatactggaaactacgtgatataaatgttgcaataaataagaaagatatgttttgagatttgatacactcctttcaacccagaaagagcaggtaagtgtacatccttgattgacgaccatctcgtggttaccaattccatcaccgagatcacagcagaactgccatggatataaattgatgagtacagtcctgagaactgcaagctgtgagctgatgaatccaagatctaacatgtctaccatggaagagcacctgctgcctgtagtccaccgtgatcaagtatactcttcaagacaagacagaagaaaatcctccgatgtcccaaacaggttcgtgacttcctttcacccaagtacaaatagcaaaggtaaccccaatactcccaatcatccgttacatactagcggaaatggcaatatagttaccgcacaaaatttccagcgggtgcattcttctccttctatgttcacatcaatcaaagaaactccctgtgcagatgagttcaatgagcaaagccatgctgcacaacacgtaccatcatttgcaaggcaggctatcgttagcgtcatcttgtacatctcaataggagtccttgtatacatcacaaatgttgaaggcttcaaggggaggtccacactgaagttagttgatggcctttacttcaccatcataagcttgtgcaccataggatacggtgacatagtcccttgcactaccttcacaaaggtgttcacatgcttgtttctactaatcggtgttcgctttgttgacattgtgctaaatgagctgttgacaaatgtacttgacaagcagagaacagtcttacttagcacaatggatgataacaagcttaatagggtatttgacacctatatgattgatgctgaaaagaaaagatcaagagggaggatgaaagtactacttgcgttaggggttgttgtaggcaccatctcaatttgtacaatcatagtgcatgaggtggagggtctaaattggattgatagcttctatttatcagtcatttctgtgacaacagttggatatggggattatggcttctcaacaccagcaggaaggctctctgcaacagtgtgtttgttagtgagcactttggcagttgccaaggccttcctgttcctaacagatctaaggatggatagaaggaaccgaaaaactacaaaatggatcctccagaagaaaatggacaatgagccactggctgcagacctagaccatgatgcttctgtaaggtattgcacaaattttccatgaaaccatatacctgcatatgttgtttaacaagtacgttttcatgttttgcaataagaataccaagagttcaattaccaaaaatgtaagaacatttttctttgttagtgatgaaactagggccagagtacagttttgtttgaacattgaaaaatgtttgataaagaaacagagttgagttactcaaataaacatatagatagggcattagggcaaggtcacatgcccgtgatgtaggtgacaccatgaaaattaacacctcacggtccttcatgaaatttactttcgttaccttttgtttttttctttattgtattaatctgaaagtaatttataatgttgcattacagtgtgaccttttgtattcaaggcagttatccagtcctaactttgtggtctttttctttttatgccacagcaaatcggactttctgatctacaaactcaaagagataggaaagatcgatgacaaagacattgcaatgatctcagaccagtttgatcagcttggccttgcaaagtgtggaaagatcactcttgcggacatcattggaaaattataagtatgatttacagaatgtatatgaatacctgatatcatagtgatagttgctgtcttatactttgttaaacagacactaaagcatgcacatgtgtgggtaacctattaaataacctcgctattcgaagtactctgtttcttggttagaagtaaaagtccatgtgctggttgaatgaattcaatcataacttcagcttcaggatttcttgcatatttgtttctagattgtattgatatttaggtatacaagcaaagaggcaggtagacaataaacaattgatattaaagaatcataagatcgtctcatacaagaaaatagtgataatctaagctatgtgcagtgaaatcaaaacaatgacacaacttaccatgttacaaataaaagaaacagggtttgatgtcatcaatacattgctttatatacttcgctatgacctcagtcctcagatccagcctcctttactgtattatccacaatctttgcaatcctgaaataatgggtggttatgaagcttaagtatgtagtagccatgcagtaactgtataattaaaaagtatcatgccctttgaatacgctgtgtttctcttcctcctcctcctcgactcacctttctctagtttcagttacaagcttcaatacgtcagacaatttttgccacttggcatttattggcttctgaatgtccacctgttctgctagttgggaactgatatattgttcaatttcacattctaatgaatccagctgaaaaccaatatggtctagaaaagcatcataagaagaatggttagttatgctgtttggtgattcaagatcactggaaaatgagaagctatcggacgtctgaagttcactttgctccaactggccagtcatgcctgaatgcaccacatgttgcagatcaaatgccttttcagatgatttcgcaggagagctagtagtctcatcagcctcatcaccaactttactagagaaaactcttatgttgtcattggattctttgccattagacatccctggatgcaatgcatgttcaattaacatgttctgcttcactgaaattgcctgaatccaacaaagtagaaaaatagtaggatcatttacataatagaatttcaaatgcatagatgaacataaatttgaaatttgcttccttagtaggagtggtatatgtgagatatcagatatgttcttgttaatgaccaactctataaagaaagagaatctgtaacttttcgtacttgacacaatcagcagaattgccaatttagcacatcaacagtacagcatgtaactgctgattaatgttttggcaattggcagtagctaggtaccataagcttttggcacaaactacataatatattcgttttcctaagaagaaatagcatatggtacatagtaaaaaaaaaagacatgacctcagtacctcactgattttcatggaaagcttatcaagcacctcaatgcgctgttttatgctttcaagagctttggtcagcttcttcttttgcacaagtaaatccactgcctcattctctttgcccattcggatgctgaccgcagctcttttcttaagattctcagcagcctcagtcaaccgcacaagccttaccctcgtgctatttgctacaagaacaaaccacaaatttgagtgcagcagataccacagtggctgtccactcaattcgcatgcacatacacaaacaatctcaccatttgactacaagatcctactcaattccaatcaaaattaacttgacatggatcataacgtactatcacaagtctggagcatataacagataagttcccctgtccccgaaggattcatcattccacaactccccaactactgaaccagtagagccgatctgaatagcagccacgggatgccggaatgcgtatacctttggattgggtgaggtcggcttctgcgtggagctgtaggagctgctcccgcagccgctcgaacgtcggcggggccgggtcgccgtctctggtagatgccgccagcgcgaaccgcggaggagttgccctcgcgcggcgcctcccccatgccgccgcgggagaaggtggaggcggcgctaccggcggcgcgacggcgaaggccatctccggtgagcgtccagatgggcttggcactgaaagcggaaacttagaaatacgcgacctccttaaggcttctccgtgatgggccgaaatttcggcccatccaacaagtccttaccggacgacgtatctcggtgcagtggtctactgcagtactgctaaataggaacgccccaaaattcttctgaaaaatttcaaaacatttctcatgtgaagctcttgaattattaggttctgatcgagaatttaagtagatcgcatgaagggaaaattctactcctgaataaaacattttttcacaaaccgcaagttcgtagctaccggtcaatccaacttaccaaaatagttttttcgtacctggaacagaacacatttctgtacagatataaagagggagataagttgcctgaatttcatggtccagtccaacctgacggtccatttgggcgacggccggcccgatcgctcggcggacgaacagcgtcgttgctatatagcatccactgccagcacagtgccagtgtccctaacccttcttcttcctcaactcctccacacacaatgtccatacatatggagcttgcaatttgaagcattttcaagtttgcatgcccatgagaaggagaagcagttgtgtactcacactgaatgcgcgaatgctgtcgctacttcttgattcaaaggtcatttccgctctgtcaaattgtgcgatgcattatattgcctatctgttttgattgaagtttgaagttattgttggctgtgattgacgtttgtaggttcagaccagtgttcttgcttactggtattcagatgctataataaaaggttataatacatatcttaggttttggatgtgttctttgctttcatgcttggcattactctgtgcacttatgcgctgtctgtcagtgtgcagaatacatggaaacctgaaattaagtgatagttaatctgtcctggataagtgtatattgcaggctttatccacagaatgaagtgtatatggcaggctttacctgaaattgtgtatttgtgcgtctcctagtatgactggcactctcgaacaaaatgaagtgttagactgttaggtgttttactgaatccacacacaacagcggaaacatttcggatgacatcaatggcagtatgttctggaataagaacagatgtagcaaacaaaaaaataacactaatgagctgcgcatacgtgcatatatagacagacaaacctgcagggttgtgagctgcaaatgctcaaattgatcactcgaataatgcacacagcagtagtataggtgcaagcattaagtcgtacatacgttttcttccatcacatacacatcaccggtcatgactcagcagacaagctgttcttacatgttttctcatggtcaacttattccctgatcaatctcccgaaagattactgtttggattccatgacgtctccatgaccaatctcaccattgccatgctcgtgatcgttgccctcgacgacgaagagatcgcctaactgctcgtcgttgatcagagaatcaagaaacgaggagaagtcgtcgtcacccaccatggcggaagcggaacccatgtcgaagccaccatgaactgcatcctcggcacagaactgatcgccaaatcctccttcgaatccctcggcatcggcggcgctcaccatcgctgcgaagtcaccgccaccgtcggccggtcgggcacgatcgtcgctgcactcaatgccagcggccggcgaggatgccgtcctcggcggcttggccggcaccgccttcttgtaagaagtggcggcgacggcagcggcggcgttggagtgatcggcggcggccgtcagcggcttgtgcgtccgcgggtcgatgccctgcgcgatgagcttcttgctgagatgcgagttccagtagttcttgatctcgttgtccgtgcgccccggcaacctcccggcgatcagcgaccacctacaagcacatgcacgggcggtcacctcaccggaggagcagtacgacctttgcacacgagcgatcgccttcggtgcatcaagaattgcttaccggttgccgaggaggcggtggaggcggaggatgaggtcctcctcgtcgtcggcgatggggcagcgcttgatgtcggggcggaggtagttcatccaccggaggcggcagctcttgccgcagcgcagcaggcccgcgcgccgcggcagcgtgcgccaccggtcgcacccctcccgcgccacgaaccgcgccagcacctcgtcctcctcgggcgtccacggcccacgcttcagcgccgccgccgccgcctcctccccgccgcgcagcgccgccggccgcttccgcttcatcgtaggatcgatcggcgattaatttgcgcgcgagctagcttggcctcctcgagacgtctcgatttgcttaattgcttccggcgatggcttagctcacaaccagatgagacggtgtgcggggctttttctcgccgtgcaccgcagcgccacctccccggagaggaaatggtcggtgggggtgggtttgttctcctcggcgtgcggcctgtggcgttttgcgggaaacgggaagaattctcggggacggatccatcgggtattcgggttggggtacaacgtgtcacgctttttatccgaaaaggcactgcagatgcaaatgtacatcgtcgcgatttcggcaattcggcgccgcggtgatagtcctcacggggaaaaagatctgtagcattagcaataaaatttggagcaaactgaatagatggaattatgaggattatttctgtctacattcataaattacatggctatgtataacttctgtgaacgaataatagcctaaaattaaactccaaggcttcgtcttttttcaactccaaactaggtttcctttttgttcgttaacacattttttaaaatgttaaatagtgtgttttttctttaaaaaataaaataagcctatttttaaattttgtaataatttatactaattacagatgtgctaatggtttgactcattttgcttgtgctaaaaagctaaaccaagttagagattcaaacagaccctaactacagttcaaacttgacagttaaacttggtggtcaatactaaaatactttgagatggtctttttggacaatcggtttagtaatgggtccaaaattttagcctataaattctacaaatttttttatttgagtaattttactttgggtcacctttttattaccggtgtctcgctttggatcaccatttaactaatgtttacattttgaaccaggtaattttacctttgtggcactttgaaccatccctcaactcttttatccatctacatcaaaattatcatatgtcaaagaaacaatctacatacatttgagggggttttgacgaggagaagccgacgtacttgaggtcgttcatctgctcgagaagagagtcggggtagtccaaagttaaggaaaggcaagattacttggtccaaaatgaaaacattggtttaaagggtggtccaaaacgaaacatcggtaataaaatttgtcccaaatatgaaatttactcttttttgtttttatattttttgttaaaatatttttaaaatattttttcaaacttttgcaaatctatagcacgcattaggagggcatttcctagagggcttctttatgacatggtagatggttattgacgtgtacgtctatatatgaacgcccctcatatttgtatccccagctgtgagagatcagcgtcgagagggttctcgtggtccatagtggcggaagagaagagaagggagccgatgagctcaagctcaccaagcatgtgcgagaaggaggcggcggcggtggcggtgggcagctagagtggatgaggccgcagcctacagcagcggaggaggagaggacggaggtgatggagaagatgcgcccaaaattttaaggtgtgcttagttccacgataaaattggaagtttgactaatattgaaagtttgaagaaaaaagttggaagtttatgtgtgtaggaaagttttgatgtgatggaaaagttggaagtttgaataaaaagttgggaactaaataagggcttagtctataaatttcaaaagttgaaaggttgggctgatttttttttttttttatgttttgaggttaagagaaatgattgagttggactatgaaagatcccatggcctatggcccattaccaccctttcaagctcaacaagttcgagatggcccaacttgttgcagccgatcgagcctatcctaccctagctaagcatgactcgaaatgaacaagacgtgccagcaggagtcatgctgccttgtgtaggaagcacccgagccgctgaacaatcaactggagtattgaaatttgaaaggtgctctcgtggaatatttgcacagctggtggacgtgcgaggactaggagacctcgaatcgggctacggaaaatcccaaaacgctagcgacgtcaacgtgtgcttttcttggcttccaagcaggtctgcctcctgccttcctgcctcctatggtgtccaccagttctctcctggtcaaagtatgtaaagtttaactgggcgttcggcttgactagaaagggatagattattaatgaataattaattaattattaactattttcaattttaaaaatagattcctttttattttttaaaaccttctatatataaagtttttttaaaagaaatatatacttttaacaatttaagaagtgtgctcacgaaaacgataaagttgctcagtcaaaatgtggaatcaaatccagctaggtgaaggccttgccatttgcaaattgcagtggcacattcatgagggtgtgtcgctaaggtgacagtgacctgaagaattcctagttctagatgtattgatctgctctaccgtaaaggatactccaggtttatattactctctctatttcaaaatataagaagttttgattggatagaaaatattttttaagtacgaatcagattcataatagtatgatgtgttccatctaatcaagatttttttatattttgaaacggagggagcattagtttgctcaaagctcgtacgaaattgaccgttggtatctgcatcagaaaacatggatcggtattttacacacgtgtatgtgtggcgctaggcattttttgcgatcacgtggaagattcacacgtataacacgcacgtaacgtatgtacgcgcagacgtcctattgcccagctagccagcatcgattgcctgaacgtacatgcatcgggacgccacgacgaagatttcggccccagttgaaaattcagctaatgatcacgcagaaaaggaacagcagtacgtacagctgaagaaaaacaacacgggtcttgggctcgtcgcgctcatacttgtggttgtgtaatctttgcaaaatcctggcgtaatcacatggctagtacatcccgccttccccgtcagttccattttccaagcaccgaaaaaacaggagtgcgcgtaacagtcaaaatcctgcacaggaaatgcctatatatgcaggtacctcctccacccagtgatgtcacccagctcgagcaaataggctgtagctagccggccggcgagaaaaatggacgagtcaggcagaggaacaggtgatgatcatggccgggagacgaaggatgctgcggcggcggcgtcgtcgtcgtcggggaagaaggtgccgctgttcagcttgttccggtacgccgaccgcctcgacgtgctgctgatggttgtcggcacggtgggcgcgctcggcaacggcatctcgcagcccctcatgacggtcctcttcggcaacgtcatcaactccttcggcgcgaacaccagcggcagcgtcctccgcagcgtgaccaaggtgagtgcccgcgggcgcttagtgatacgcgatggagacacaccggccggtagccaaattaactttggatcttctttctcctccaggttgtcctcaacttcatatatctgggaattggaacttcagtagcttcctttcttcgtaagtaaaagtcctttctctgattggaacacctctttagtgaagtagagagaagctcctgcccttttcgctgaaaaaaacaaagaaaaaaaaagaattagtggaacctgtagcttcaaattatggatgtgaaacatataaatagtattcagcaagggaatttgtagtaaacagtattagaaattctttcaatatctaatttgttcctattattcaatgagtctccgggtatccataagtcaataagaaatttcatttaaagggtctcagagtatccatcagattccaaagcaaaattaacactttttattcaaagggtctcagtatccataagtcagtaagaaattttgtaggatagtgtgaaattaggctttgtttggtaaatgggattgagaaataatatcccaccctccaaaaggtaatattgcatcctagctatccattcttcacacctcatttaatcctagccatttattctttacacctcatttaatcctagtcattcatccatttccatttcccaatcccacctgccatatcccatttgccaaacacacccttaggataagtaattaatttgctcttgcatggatgcgcaatcaccaatacataatattcattattaacatcatggttgtcagttgttactacatgttagaattcggttattctcaactgtgatacactaacacagtataaacatcatcatgcacttatccggtgagaagtaccaaatgcgttccctaaccatataatcctcagcatcttcgatctaatctgttcggttaaatatatcacatgctaatggtacaactgccagtaaaaaactcaccttaatttgtcccagaggtatcatgctggactatggcaggagaaaggcagtctgcccgcatccgttctttatacctgaaagccgttctgaggcaggatattacattcttcgacacagagatgacaactggtgaagcagtttctagaatgtctagtgataccctcctaattcaaggtgctcttggtgagaaggtactaaatacctagtagctccgttgtaaggaacatactattttttattaaattgctactgaaaaaaaaacatatattttcatcacagtgcaaacaaaagtgtggatagacacaagttgatggcaggcataattatttgcatatttaggaagatatatcaaacggatatagttatcatatttactaactgtattatttcatatattcaggcagtaagttacaccttgtgctactgttgctgatgtgttcttggatttttaatcttaacctttacagggagggaagcttgtagaactgttatcaagcttcatcggtggctttatcatagcattcactagaggatggcttctcactcttgtcatgctaacatcgctaccgttaattgctattgccagtgcagtttctgcacaggccctaactagagtttctagcaagagacaaacatcatatagtgatgctggggacacagttgaacagaccattggatctataagaacagtgagtttcacatatttatatgaattgtttaatgctataacacacttctttttttggagtagcagacagtaagtttgataaatatcctgtgttaacaggttgtgtccttcaatggtgagaagaaagcgatagcaatgtaccgtaattttataaagaagtcatacaaggctactattgaggaaggcattatcactggttttggcatgggctctgtcatgtgcgtcgtatttggcagctatggattagccttctggtatggtggaaagctaatcattgagaaaggttacacaggaggaaaaatcatgactatcttgtttgccgtgttgaccggtgcatcgtaagtttcagcaaatcctccactgttgatatcaaaatacatgctgtttagtgcactacaataatgaacccccaatctattcatgtattatttggattgatggaaatataacaagaaatttatatatattacctcaaaatcaagaaggctggttagcatgcaattttagaagtgcaaatggcagttttgttcatttctcaggtgttttttagaaaacttctcaggatttcaagatgattttcagaattaccttaaattattttcaatattttcttgattactatttacaaaaagacaatgctaattgccaatgcatgaaagtaacttgtttcttgtaaacagaatggaatgaacttaaagtttgatggtcaagtcaattgcttgactatacataatccctaggccctattaccattttaggcagacataccaattgctaaggagtagttattaattccagttagtaaaaggggatcatgaactgagatatagacataagtacctaatagctaaatcaaggtatccttagcaattgcaagagcaggtttaatcaatatgttctgcgctaacaggagaagtagacaaacgctaggcttttggaatcgtcacgaagagaatattctcctgagaagtacattacatgttatatgcaaacgattgcattgggtttcactgctttacctacattacttgctatttctcctaaaatcacattaaagttgaaagatttacaacaaaatagccattaaaattttatcatttgatatggtatataatgttctgaacatggcactttccaattgtttgtgacagctcattaggcaatgcaacacctgcagttgctgcagttgtggaaggtcaatctgcagcatacaatttgttcaaaacaattgagaggaaaccagagatagattccgatgataacaatggcatggttttagaagatatgaatggcgatattgagctaaaggatgtgtactttcgttaccctgcaagaccagagcagttgatattggatggattgtcgttacaagtagcgagtggaacaacaatggctatagtcggagagagtggaagcggaaagtcaactgttatcagcctagtcgaaagattctacgatccacagtctggcgaagttttaatagatggaattagcatcaagaaactgagacttgattggataagagggaagatcggtcttgttagccaagagcctctgctttttatggcctccattaaagataacataatatatggtaaaaaagatgcaacgcttgaagagatcaagagagcagcggagcttgcaaatgcagctaacttcattgacaagttaccaaatgtaagaaaggaaaaactgaatgctccaagttctcaaatttaattgtatattaatgaaataatcagctaacaatgttttcatgtcataccagggttatgatactttagttggccagcgcggtactcagctctctggaggacaaaaacagagaattgcaattgcaagagccatcctcaaagatccaaaaatccttttgctcgatgaagcaacaagtgcacttgatgtggagtctgagaggatagttcaggaggcactaaatagaatgatggtagaaagaaccacactcgttgtcgctcatcgtttgagcactgtgaggaatgttgattgcatcacagtcgtccgcaaaggaaaaatagttgaacaaggttgaattaacttgaaatgcactgtttttctattatagaaaatttctgcggtcaaccttaaatgattcattataccaaaacatgtcctgcgtacacaggtcctcatgatgcactggtgaaggatcccgatggagcttactcccagctaattaggctacaagagactcatcgtgatgaaaggcataaactaccagattccagatcaaaaagtactagtttgtcattcagacgatcaagaactaaagattttctcagcaagagcaacaggtattccttcaagagccccttaggattgcctgttgatatacatgaggatggaatgacaagcgaacaacaaaaggttgaccactctgacagtaaggccattaaaaaaacaccatttggacggctttttaatcttaataagccagaagtgccagttcttttgttaggttctatagcagcatcagtgcatggagtcattttgccactatacggtataataatgccaggtgttctaaaatcattctatgaaccgccagatcagctgcgaaaagattctagattttgggcattgatgtctgttgttctgggggttgcttgtttgatttcaatcccagcagaatattttttgtttggaattgctgggggaaagcttatacagcgtgtccgtacactgtcatttcaaagaattatgcaccaagaggttgcttggtttgataagccctccaattccaggtgcgctactctaatgtacttttgctattttatcttttataaaaaaatatttacatttaaaccaatgctaagaggccatcttatttcttacagtggggcacttggtacaaggctctcagtcgatgcgttgaatgtccgccgtttagtaggagataacctggcccttatagtccaggctgtagctacactaatcactggctttgccatagcttttgcggcagattggaggcttgcactgatcatcacttgtgtaattcctttagtgggtgcacagggctatgctcaagttaagttcttgaaggggttcagtgaagaatctaaggtgacacattacagcttacaactgtaaaaattgcttgctgttttattgagaatgatctagacaagtgatctagaattaaattgattgccattataatgggatctcattatacaggagatgtatgaggatgcaaaccaagttgcggctgacgctgtaggcagcatcagaactgtagcatctttctgttcagagaaaagagtggtggcaatatacaacaagaaatgtgaagctttaagaaaacagggaattcgaagcggaatcgttggagggattggcttaagtttctcaaacttgatgttatatctgacttacggtctttgcttctatgttggtgcaaagttcgtaagtcagggaaaaactactttttcagatgttttcaaagtaagaaatcctaaagtatttcaagtaacaattgcctatatgaatattaattctagtatcattcacaaatgggctggatgcttttcaggttttctttgctttagttttggcagccgttggtgtttcgcagtcaagtgcattgtctactaatgcaacaaaggcaagggattctgccatttccatttttagtattatcgatcggaagtctaggattgattcaagtagcgacgagggagcgataatggaaaacgtcactggcagcattgatttcaataatgtcagtttcaagtacccatcacgccctgatgttcaaatattcagtgactttaccttgcacattccttcccaaaaggtatacttccacattcacctatttgtcttcctttttcctatttcttgaaactagtgcatgcccaaaatttccatcagaaaattaacttgattattgaactatttacataatacaactagtaacatacttcaaaatagatgcgagtgtgacccatccacttccgtgacatcatatgtgttgatacacaactctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtacacaactttacattttattttttgcatctcagcatttccatgcactgaaatagttatgactaaaccttttccttccttttctacagaccatagcacttgttggagaaagcggtagtgggaagtccacgataattgctttattagagcgtttctatgatcctgattctggtaatatctcactagatggagttgaaattagaagcttaaaagtcagctggttgagggatcagatggggcttgtaggccaggagccagtgcttttcaacgacacaatccgtgccaacataacatacgggaaacacagtgaggtaacagaggaagagatcactgctgtggccaaggcagcaaacgcccatgagttcgtatcaagcctgccacaaggatacgacacagtggtaggtgagaaaggggtgcaactatctggtgggcaaaaacagagggtagcaattgcaagggccatcctaaaggaccctaagatactgctacttgatgaggcaaccagtgctctagatgcagaatcagaacgtgttgttcaagatgcattggatcgagtcatggtcaacaggactaccattgtagtggcacaccgcctctccacaatcaaaggggctgatatgattgcagtcctcaaggaaggaaaaattgcagaaaaaggaaagcatgaagcactattgcggatcaaggatggtgcatatgcttcacttgtacaactccgctctaattccgagtaaaatgatgtatattttgatggtgtataacttatttagccataaattctagctacttgtgatttgagaagttgatgctaaactagagggtgttctttggtagtttgttactttgttgcatgaaagacctatggttctgaacgtatgatcttggtagccacagacagtaaattcaactgtgtctgtgtgtacgcactaactatgatggaataagccttgtggtctttggtctttgtggtccttctcttgcttttaggttgtttttccccttttaggacagcatcctttcagttttgcttttagcatctttcggttttgcttttagcatccctaggacagcatctagcatctcctttatgctttattcagtttggatgctctctaggacagcattgcgttcaaattttagactagtgtgggcagcaattagctagcagccatccagccagctatggctatatatatatgtatccaacctccctcgggaaggtatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcagtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccgacgggaacccagacgggcgcaggcgtgccggcggcagcccggagctcgcacgcggccctcgcaggcagcacggctctctctcccctgaccggcgccatggtcaccacggtgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcaactacgacgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacagacagatcgctcgctcgatcgaatctctgctggacctctccacgatgttgatcgaggaggcgttaggtcgcctcaaggtcgtcgatggtgatgagccacagcctttctcggggcccatcaccatcggcgggaagctccatctcactagggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacgcctgccgcaactgtggcaagcttggccattgggccaaagactgtcgacagccacgacgcggccaggcccacgtcgcacgggtggaggaggaagagccggctctgctcctggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactccagcgtccgaggctccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacgaagcagcggcggctcccctttccccagcagatgagcttccgagccaaggagcggctcgagctcgtgcacggggacttgtgtggcccagtgacaccggccacaccaggaggacgacgttacttcctgctgctcgtcgacgacctctcccgctacatgtgggtgacggtcctcggcagcaagggagaggctgcggacgccatcaggcatgcacaggctgctgcagaggcggagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgtcgtcgagcggcgcaaccagacggttgtggggatggctcgggccctcctcaagcagagggggatgccggccatcttctggggggaggcggtggtgacggcaacggcaacctcaacaatggcgtcggatggtcagggacaggggcggatgtggctaggggcagatgcggcggcgtgggaaggcagagaggagtgcaagcggcggcgccggatgcagccgggggtggaggtgatggtgtcggatgtggcggctcaaccgggggagccggatgaggcgggaaggagcgacgctggaatactcgccatgggtgctcccttgaggaaggagagagaaggaagaggagaggttgcgggaagggggagagggcatggggcacaccattggccaactgttgtggctggctagatttggccagttgctagcagggtttggccagcgggatagcttggtcagcccgttagagaggctgttggaggacattttttttcatgtggttgctataatttggtttggagatgctctaacaattgtgggtggggcggagccaaaagaaaccatcttcatgcatagtttttttttatagataatgcggtgtctcttagattaattaagatcagacagcagtacttcctggattggctcagggattatatcacggtagatattacaagtttttagctctgaacattgagctaaaaggtgagccgcggcattagttacacgacatgcatagttaaacgtgtgattatgacacactccgttgtttccaacatgaattttcaacttctgactaatatcggtagattccattccgatggccccttttccgacataatactgatattatcaatatcactacttttttcagatctaccaatctgagtccattttcgattaaaaaatggaaatgaaaatggtaaaaggtttttccgaccgttttcatccctagctaagttgatttgttcttggtaagtctctttatatcttcatttttttcacaatattttgtataagattttaatgggaatttggttttaagtctagcactcattgatttcgtcatgtctattcctctggggctagggccagtgaacccgcggaggaggggggcggggatgttcctatccaacccaccctcgccctgccccattgccacctctagcgttcaagcctaattgtctcacccttgtccctacccttgatgggcaccatagtgtccgttagacttttgatgtacgaaaggtaatcctgctaaattttctctccaaaaaccaaatctaaatagtaagtttatgagacttgcattttatgaaatatttatcatttctcacaaatctatttgcaaaaattatgtgaagttttcattcttgaagcttaaatttagggcatattgtgcgattatttttctgctagtggaaaattgtagaaatacccgttattcatagattatgaggtaattttcactttagataaatgttgaaggactagagggaatgagtgatatgttttttgtttactatatgcattggttcatcgtagatgagtgcgcgtgagaagccagtgaagaactgaaggaagtagtgatagattgttagcctggtagttgtgcttgagatgcattctcgcagtcaagtaataaccaatttttgagcttctgccaaagtaccgtagtttggcgcaggcctaagcagagcattgtagagacgtgagatgttatcttgctattccaacagactctccacattccactctctattaaccaatggaccccacctgtcattctcctctttcttcttcctccccttttctcccatcctctgctcgttcttctgcagagctcgtgctagcggcggcggtcgtggcgggcgacgacgcggactgcagcggcggtcgcggcgggcgacggtgtggccgcggacggcggcggggctcgcggacgacggcggaggtcgcggtcagcgacgacacggatggcagcgacggtcgtggcgggtgacggcgcagactgcggtagcttaggccgcggccggcgatggcgcggacggcggcagtggccgcggcgggcgacaacgcggatggcggcggcgggcgtggcggacgacggcgtggacggcgggcaacggcgtggccgtggccggtgacggagcagacggcggcggggctcgcggacgacggcggaggtcgcggtcggcaacgacgcgaatggcgacgacggtcgtggcgggcgatggcgcggactgcggcggcggaggccgcggccggcgacaacgcggacggcggcggcggtcgcggcgggcgacggaggccgcggacggccgtgcggtcgcgtgcaacaacgagagagaatagccggatgttaatgtgcgtagggcccatagttggctagtcattttggctggccaaatttggctagtggagggagggttttggccagccagatggcttagccatccggttggagaggctgttggagggtgtttttttcactggaatggctaaaatttggcttggagagtcatttggagaggctgttggagattctcttacacctaacaaaatctgaagtataggtgataagtggttttccatacaatcttgagaaaattccctctatgcccctaaaactttagtcgatcccttctatgtcgctaaattttcttcgcttccttgtataccccctaactttagattttgatcgcttccatacccttgccatcaattgaccactagttgaccgttaaataggtgtaaaaaagttagttttacacatggatgtgtaaggaatatgtagtgatttgtgaaatctattgttgaaaatataacaatttattgcgtgactattatattcataagtttatttcatgaggaattattatacgtaga

SEQ ID NO: 69548 - DNA, 34298 bp, Oryza sativa
attttagcttctaataacaggattgtaagctgtattcctgttggctaatggcaatagtgtaacttcaacaggaatgctgaacagacttgtcctcaaaaaggatgttctattgtattgtacaatacatctcaatactattgtatcttccaaacatcccaagcaaatcaaccataaatcagactatatcaaaactttacagcacagtaaaaaagtaaggaattacaatataggattactgattggcacaagtagatccctttggaattgaatttctaaatcacctaatggcactgtaacatcgccatgcacttaataagcaatacaagattaaatgttagtgttattatgcagcttcatatttattgtacaaccgataatagatcggaaagttaagcacaagttgcaaagagtatatgaactgatcaagtataaaaaatatgcaagggttatatatgttccttgagaacctttgccagtaaatattttttaaagagaagattgtatccaattgcttttctaaaacattctttcagaaaaatgctttttctaaaagacaccaacccaccacaacaaaagagataaattaaaaaaaaaagctccttacctgccatccgtttttggcaagggactggtacagatagaagcgatggcagaacattattgctgttgctatagtcatctgtggtctgaaagaaaaatgttaaaataggtaacaagcttagcaaacttccagaataaaagaaattattgtgtgctaactaagggcacaaactagccgtaaaaccaacatataagtttgaaaagtgagctatactgacattaaaaggtacactcaacaaggaaattggcacatacagtttcagtctaatgccaacatcccgaatgaatgaacagtacaactgccgaatttctgactccattatctcagtaataccatctttcctagatggggaaaatttctccagttcttccctggtgaagtaccaagagtacatgtgctcacatgataatttactcgtctgggattccccatccatcagtatgtttgaaaaaacctgcttaaggaccctccaaaatcttcagtgtagtttcagacagaacttccgaattgcttgtgctgaacagcctgcagaaccatgaaatttatgtatataataaaaatatctacaatatgaatccacatactgagcaacgaacattatgaatgtaaatttaagccaatatgtacagattatagctaaattgtgcatgttttacatgatctattcctttgatagcttgctacagttgcattcaccatgctactgtgaacatttttacctccctttccctcaattggcagagaacgaaattaacagaaatgttaaaaaagtttctcatagccacaaaggaaaataaattatattgatgaagatgatattttttaatcaaattaacatacatggtataacaagatactaatgtattccatcccagaaaatctctcccctatatttttgagtataacatgagccatcatattaagccatgtcatcatcattaaaatgctaatcatctgatgattttactttaaaagaaatccataagatgacctatttcaattttatccataactaatcaagagtcacggatactgatttatattcatcaaaatgctgtgtgcagttatattcattacatttccttccatttaaaactcttttgttcagaacctgtacagacatgtgaattccacgagattgaatcttttgaacatgtactcctaatggaagacgatatccggcattgaagcgtctatactccagaggaaatcaatgtgtgctgatgagtttgaattccaaagtctaaattccaaaaccttaccaaaaatgtagatgagtttgatccgcctcaatgcactaataaaaggaaaatagcactgagcagagcttagaaattctaaagcctacttgcatggtccaatttgtaaccataatcacttatcagttgcatttcaagatttctatgcaaacatcttgcaattactgatttgtctgttcatttcagttcattgttgtttgtgccctcttatgtgccaattaaattgttgtttgtgttctctgaagtgcaaacatcagacattctgatctgttgccatgcaatgtggagcattgtatggatgggatctatcgacaactatacatgagacaatgtggatataggagtacgatgtgagatttccgagatatccagtgtaaatacatggtgaaatgtttaactaggtcggaaacatgtaaaccacagaatataagttctcaaaaagagttttatttgaaaaaaagaactcaatgatagctatatgaaattagatgggcatacaaaattcaagataaaactcaactttgtttgtgagatattaagtttacaaatagcaaagaaaaaaacacaaataaagaatactctttttttcctcactgtttatcaatttcatatgtcctgaaattttatatggttgtctaatataaccttcctgtatgtgagatattttagaaatttatgcgatagttttcccatgtttaatatccactgcatgtttttcccatatatcaatgtgcaactacacattacccattgaaagttttcgcatgtattgcctttccggttagaagcagacaatacacaatttcaaggatgtggtacacggcccttgggttctgcttaataacaattgcacctgagacaagttaacggtattccattatacaaagagaataatgctcttatgccacaaagttggatgcgaaaactctcattttgaacaaaagtttgaagcctttactaaaatgccacaaaattgagtaccaattcattcttttaccacaatacagtgtgaaattccaaattaatgcccaccttcttctccttctccatttttgtcctatccccacccttcttctctgtgtccagcaaggacagacctagctctgtccggccaaagtttgagccagacctggcagccagcccactcctgcacgtccgacgccccactcctgcatgtccaacgcgcacgccatctccgtgcacctgagctcggcatgagctatgacaccctagctccagtagccagcttcaaccttagcattacctccgcctctggccgccagcagcacaacaatatgcgtcctgccctcagcaactggctctgtgcagcccacctactccgcgcacggctttcctcctgaaagccagttccacgcgccctgctcccggccgcagtggcggacctaggtcctaggcctgggtgtaaaagcccatagagagacatacatttttaagatataattttctgttgggccaaacacagtgggcaccagcccgtgcggccaagctccattcacaaactcatagaagagagaaagagggtgcagaagaagggaaaattgcacatttggtgggttaaaatggtaaagtgtggcagataaacgagtatacaactgaactttgtggcatttttacaaagccaacaaatcatgtggcaaataagagtatggcatgcagctttgcggcataagagaaattttctgttgtacatacaatcttcacagtatagaaattctggttacaacaaaaacaacatgctgaaaactatgtcttttgttggcagaagattgtaatatctcatccaaatccaagcttaactgaatgtagaaaagatttctcaactagcagtaactatttatgtataggcacaatcttcttgaccaagtaaataatagattctacaaactgcgctcactaaaagttggcagactttgggtgtaatttcaaccaactcccagttaataaactgaccaaatttctcgacaaaagcaaagcagtttgtccacccctttaggataacatctttgaagacaaaatcaagaatacacacaagctagtcccagcccgacaaaaaatctagcccacaagatatcgttgtaaaaggtggagaagcaatgaattcacatcgacttctgcatatgccatacggccaatacgtcaaacagcgagaagatccccaaattgaataggaaatcacgacgaagctcgtcggctcacccatgaattcacctcccaattcgccaaagacagaatctttgacctaaccgggggcatgatggggttcagttgaacccccaaatctattgtttgtggaactaaggcggagagaaaagcttccagatctaggagagaagataagggattaaaaagaggatgacgcgagcagggtgctcaccggcctgcgaggatgcggcagaagcagcaggctgctactcgccctcgcgagatggagatcggcgcaggcggcgggtgggcagtcgaggccgaggggacggggatgcgggggagatcaatttccctaggccgggcgcgacgactcggaggccacctacgccgtactgcactcggatactattgacttgcgtccagtgccccaaaatccacccttgaaatgcatccaacgtctcaaactgcctcccctactatccggtgtcactggtctgtaccgtgtaaacagctcacttccaaggtcggacctcgccgctaattctgctatcatattttggtctcaaatatataattctaaattactcctagctattcactgggtgaataaggccatctacaatgtgtcttcaacccgccccagcgacggccgttcgcttttccgttcgagccatgccctggtgatggcgcgcgacccctgcttgggagacgcgcctcctccttttcggctagggaacgggctagaggcacgcgctgcggcgacagacgcctcaggcgactgtctctccaccaccatattccccttccacccctctccccctctctctcctctcctccgttctcatcgcgagacggcctaccccgctgagccgagctcctcctcgggcaccgccgaggtgcgccgtctcctcagcctctgctagcgggagagagagaggcggtgggcggagtcggccaccgtgcggcagccgtctgccgggctcgtcttagccatcggcagagggagcggcgggatctcgagctacggccggaaatagcagcgacgagagagagagagcgcgcggcgagcggcggcaacggcggatccccggcggaggcaacgggttcgcggcggagtaggcggctctcctcgtcgccctcgtcgacaaagctccggcggcgagggtggtcctactcgtcgcccttgcggccgccaccggagagagagagagctggggtgggtggcgacgatggcgtgacggagaaggccagggaggatgccacccgcctctcgccgcttgccgtcggccaccgcagcggtgcgctgggcctgagttggaggcggcggcgagagggagaggcgagtgcggtggcgaaaaaaaggagggggcaagagagagagagattaggggtaggatagtaaaaataaatatggggctttgtaggctgtgatacctattgtgggttggagtgtctctattaagttgtttcagattttgaggagcccatccaggggtatcctccattccgagctgagttcctctacagcactctagaagtggctcacattgtggattccctaaggacaatagcagtacaatctactcaaaatcatgcctcgctatgccacataggatgaggttcctatatggacactagctccacaatggaggctccacctaacaactttttttcatctcagcccttaaattcttctatgtcagcccttcctatattttgtattaacaaaccatccaattttttatatttcagaccctgcaacaaaaaaaaaagatctacacacataatcatgcctgcccactgacccacttgtcagccatcccttactttttcctccccctcaccccgttctctcgctcccaattgcatttaatcctcatcccctcccaagtcccaacgaagacgccgacgcctctccatcttcgccgcctcaccaacatcgcccccagcttcatcgcctactctcctctccatctccgtcggcgccacccatctccgtctaccctctcccgttccccatccatcccctcccctccagcggcaaatcaagttccaatgatgcaaccaagctcggtggcggtggagcttcggcggcgggaccgaactccggcatcagcgaattgaactccgacggcgcaaaacaaggttggctttctcctacgtggatcaaggccgacagtgtgggcggggcagtctcgtctccggcaagcaccaagtggagcaacgtcggggccatcgcgacgtggagcatcgacggcatcctcgggctcatctctggcaagcggcgagtagagcagcggcaggcccactcgtggtcgttgccacgtccggaaattcactagtaatttccgaacttatttgtgcataaaaccctcgtccaggaatcagccgaggtacacaaactgacaatttaatatacaaatccatcataataataacgttacatacttacaaaagaaaagaaaacagcagcggaaataacggtctagcgatgacttcagctccattcccacaggcagctcaactggggtataagccaaacgtcttctccttctggatcccttttcttcaattgaggttgattgattattgcaagaataagcatatgacatactcaacaagccacacagcaaatatgcaagtgcacaaggataccaaaggatggcataatataggctcatttgtaaaagcagcatttagcaaagatttaagagtagtaaaacaatagagtaattaatcatcaattttaatcaacactgaacagcaccccaatgctgtacaggcccaaccaaacctgaacaaccaaccccggctgtacaaatctaactccaaaccaggagctaagcaaattattaccaattatagcatcaataattattgtgagatgtgtgagactaatcacgaaaaacattgctcaactcgcccataaccgcgggcacggctattcgaatagttttactctggccagaggtgtaccactgtacctacaagacacagcctcaacatcatgtctaccatgcgtcgcgatactggaaagtacccgaatagaggctatgacaataccctctgcacaacacaactcaccacagtgcaccatacctggatcataatcaccccctctataaatacaaccagaggcatggactccccagcgacccccacggacttctcgccgcttctcagtctggtgccccgcaatgaatcatgctatacaaaaggtaaagccgttgcctatgctggcttgtggttggcacggttaatgttttacaacagtagctcgcgaatcggtccttaattgccatgagcacgaccttcacaaccatgtgctcacaacccaccattgacaaattttaattggcaataattaattaaccaatcacgattgaccatcgtgagctaccattaaatataaccataagtgatagtgtaacattagttatcccaatcatgtgctaatgtttctaagcatggctaagcaattatatatatatagcatttagctgaacccaaaccaatatataaggttctagctaatcaaattataacccataggaaaataaagccatcttcggccattaattaattgtgaaaggctcaccacccgatgacattcgaaaataatgcataagttgaaatcaaacaatagctttaaacgggttcaacatgctcaaagggttgtttgggatctttgtgacttgccttgagcttccgcaaacacttccgaaccttcctcaacgaaaacgctctcctccggaacgtcggaaactaaaacgaaagaacaaaatcaacaaaatagtacaaaaacaagcataaccagtacatgtggatatttttaacatgtagatcttgattttagaaaaatttagcaacttgaaccactcgaatccgaggtacgatgatttagttattaatttccgaagtttaatcgattttcatctaatagagaaaactaagaaaagggattaatgacgtcatcgctgacatcatcaatgtcgactcgacatcagcgacgacctcgccggcgctagaagactcggccggacttttggagggtacctacgcgtagaggagaacaacgcgatctcaccggtactaaccaatgcgacgaacgacgaccggcgacgagcttgtgcggcggcggcggctctccggtgaccggtggtgacggcgaaggggcggccgagcttcccctcttccacgcgcacccgacggcgacgtgaggaggcggcggcggcggctaaaacgacggcgcgaggcggctgttcgccggccggcgacggcggcggtttgggtggcgcggcggcggcactacggggcacgagagagctcgggacatggggcaaacgaaagaggacgactaggggatgctatttataggcttggattgaagagatcggactccaaccgagaggaatcgaagccggaaaatccgagggttagttggagagataaactcgaaaacgaattcgattccgcgttgatttcttcgtgataaagtccgattcttgggggaaaggatagaggaggataagaggaatatttcccctcaactaattttgcaaacggagcacgggatgcggcggatttggtggaggaagcggcgtcggctagagcacaggacggcagctcgggcttctgtccaagcttgaagacgacactgtagcagggaggagaattagacttttcgtcttgggctggctgaaaacaaagcaaagaaagaaagaggaggagctcggatgggccgacttgggctgcacagcacgcgcgcgagggagagagatgttgggctgaaatcagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaacaaaattataatcagaccatttaatgattaatttaatatgtggataattactgaaatgttctttgtatggttaaaattaggaattgagctccgaaaaatccgagaaaattccagagagtataattaaccatggagaatttaataaaaaataaatccgtccatgctttatatttaggaaattttatttcccacatttaacttctcttgtaaattaatgaacatttaatataaattctaataataatttattaaataatttataaatcctaaaacgaaaatcaggatgtgacagtcatcctcctcctcgcttcgagaggcggccccagtggtggatctctacgctgccgaccggtggtggatctcgagcggcatccccggtggcggatctcgtgtgacggcccggtggcgactccagctccatgagctctcatgatgaggacatcaacaccatcgatacatccacgtctccacgactacaacctcatggtcctattacctgttgacggtcattatagacgaatttcgaccatcaatactgttggaaataatggagaactagaaatgcttgcatgcatattcatttagaaataacctatttccactagtacttgacaaagtacttgtatacaggagatcacttcataaattaagaagaaatgatggaaaatcaccaatcagaggtcgacatgcggtagacatatggatagatgggcccacaaacctattgaaacacttgcaaatgggaccaaccaccataccactgggcccaggatccatcaggagacgttcagaaggaaggactggcccagggaggcctgccaggcgtcggccgacccaggcttggctccgctggcctaggcccaagccaacgacggttactactgaccttccaatgacggttgtacctgttttggcacctccaaccgtcattctcaagctataaaaggacctcatctccttcattccaacacacaccaacaaggaatcaagtgaagaagctttttagtttacatattttgctctagtgctagtagagtcagaattagaatagtcttccttagttcttcaagtcttctggagaattcgggtatggttctactatctcttccctctcttgtaagattttatccattaatgaaatatttttctttatatagttttggtcctttactatacttgtataattattcgagtaccaaatttggtttatacttgactcgtattaaatatgtggctagcttaccaaagatatgcaatggtattggcttagtgttcattcatatggttgctctatgtcatctgcagaggtgtagagtaatatttagtaatgtaagtgtggtgcttagattattagatattattaagtggtgttatatgccacagatctgtagaggtaggccgctgatggtgatagctcagcacgggtattcctccacgtcgtatatagggctaagaaggttcttggtgcaggtactcctccatatctttaaccggttggatagccatgacggattgtagtaaggaattcggcaatatggggtggtttctcaatatattaggaggacatagttagggggtattagccataaagttgtacaatagcaaatgtatactaaaatgactatatactagaagtgcataaatgatatttttctttttttttatccacttagcctagacttatcaattatcaagagtattctaaactgatccttctgtgtgtcaacctatccttatcctaaaatgattaactcctgcaaaagactttgattttatataagtgtaatatgaatttatagcatagtactctcttaccatatcttttcttggaattaaataaatacgatacttggaaatatttccagttgaaatgctacagtggtatatccgtgaggatttattctataacccataagaataccgtctaatatctctggcaacattgcttgggattaatttcctagtaatgtcgttaagaaatatcaacattacctgcgcttgtgcacgtcaatatcaacattacctgcgcttgtgcacgtcaactcaactatcaggtgagttcattcttgagttcatgttcatcttatttatacccccagagacatgtgcactcttgttttacttaggaatgatagagaggatcaaaagggagaggattcgcgcgggctggattcaaactacaggacaactccaacttgtgacgaccgccacgacttcctacgaactccgatttgggcgtgcaagtacttcatggaaagcttatcaagtctactttgaaatggatctggcctcatgtccatatcaattctggagtggccgcaatcatcgctttatcaccgagcctttttctatcaaaggtattgcgtcaacttatttgggcccaataggctatgtatcaagttgggtccattaaggacgcgtcctatgattagagcacaaccccaacacccatgtggttgttctccccctcttcttatacctttatagccactgccaagaacaattggtttttgatgatcagagttagcaacttgctacctgcttgcagcgcgcgtgttggcgaaaccgcccgtctgcttctattcggaaccctgccatattgtgatttcctagtgaaactttcatattcatctagcagttctacttgttcttcgattgcttgcagggcatacgagtgccctctaggtcgggttgtcgtgcaccacaagttcgtgacgaccattggtgacggtatatcggttgctaaggcgcaacgtccttggacggttatagttgggccataaacgtcgtcttcatccaatcgagttatctccgcctcttattgaaagattgggatacaaatccctcgcgggttcacaacaggtggtatcagagcgtggttgatcagtgagagattatttaccctccgttgtttattttttttcctatagtctagaaaaagccaaaaaaaattagattagttagggcttgttgagttttcgattgcatcggttgtgtcaacttgttggtcttagcacttagtctattagagtttcttgttcttaccacgcacatcgccatcttcatcaccgccgccatcaccacttttgtcgtcatcagcaccatcacagccatccaccaaattcctttctgtttgtgtttgatatgttccttttattgagtttaattgtcgttgagcctgctgccaccagaaaggaaacagaaccctgattcgagtgatctaccttaaaggaaatagaaccctgattcgagtgatctcccttaaaatagtcgtatctttttcatatggactcgaaatttggcataatatatccacggacatctacctaaaaaaattacatcgccaaattccacactcgacaaaattaaaatcgcgaaattccacttgcaaaattatgtttttgaggcgagaagctttgcaaaacctttagatagaactttgaaaaaaatttacatgcttcatattttgtccgtttgagctaagaatttatgtggttggttccaatgtgctcctaactgtgaaaaaatatcaaaaaaataaaaataaaagttccatctctctcctcagcaccttccgccatttcctgttgtcaccactgtcatcgttcctgtttaggtttgtgtcttgtgatgttctttgtggttaggctcacgtctctacttcggctagcctaggaccagtcaggcccggcccgggggggtcgagctgggcctccacacagggcccacgaagtgaaggggcccaaccccatatatgctgtacataatagcccataggaactaagaagcccactagctcaggagaggaagaagcaaatgtacaggaaaaaaattgcgtcgatttggcttccttccgtgattccgtccgatcgcttcgccttcgctcgcaatcgcctgactcttcgcatgttcggctgttcgccaccctcccaggttccagccatgtttcagctacgtcgacgactgcgcgcggctatgcgtcaacggccggtgtcgtgctcagtgccgtcagcggcaccacgacagccggtagccagatgcaaatctcttatctctctgactctctgttcagttctaggagaccaggaggtaccccattgctctcccctttgatgtatgctaagtttatatgtttaaattttgggatgcaaaatgttactccccaattgctcctcttctgatttctgaaattttgatttaggatttagggatcctcgcggagtcgcggtgcagctgtgcaactagggcagtgaatagttattttctttagttctcaactaggtaatttgccagcactcatttttattataatgttgaattgaatctagtatgacataattttcataaattacttacttttttctaaatttacagtgaaatcatgtaatgtctcaagaaagattaaatggtttggcaactttatgcatcgagaagaaactattagatgaaattgatattgatgccatcgtcgatgacttcgcatcggtacatgttagaagaaaattttaaggtaagatatataacttgttttataagaatgtttttttatgcattaaatttattagaaacatagttatattattatagttgtattaaagggcccatttttctagcttcgctccaggccactgaattgacaggaccgggcctgtgaccagcactgtacaaaccttgaacgattatattattcaacttgatttggctaacttggttgctagttttctcttgagcattactttcagcccattgacaactcaaccacaaacctgactacaacttgataggtcttgttgctacggcaccgatacacctcgttccacggttgcagacttgtgggttgacgtcccctcctatgagtaaggtaagaattggtaagggcttgtaagataggctgagagtgagcatcttgcaaaagctacatcccaatagttgtagggcttatatttcctcatttgttgtttttgttgcctttgttttattagccatggcatgttcagaggataatgatgaggagggtgcgtttcattccccacgcaccaaaggcatcataaaatattttacaaggcaagttaagtagcacaaagaaggacttgatgctgatttgcaggtgacaaatgagaagaatggacaattggagtccacacagatcgccaccaacatcaagcttacagggttggagacatcgatcgcttgcattaacactagccttgctgctcttgtgaggcattttgatgatctcaatgctagaggtaatggtcgacgtaatgaagacggcattgaggatgaatatacgctgacactaaacaagatgatcgagatgctcttgatcgttgacaactacgcaataatcatagaggtatgggtggtcaccgccaacgcaaggtacgcaataatgatgatgtttttttttctaaaattaaatttaagatacctcctattgatggaaaatatgatcccgatgcgtacctttcttgggagattgttgttgaccaaaaatttgcatggcatgattttcctgagaattctaaagttactagttagttcactgatttttcttcggtttggtgaatagaacatggcaagaaaaatcctaataacatgccacaaacttgggatgcttttaaacgggtcatgcgggcatgatctgctccttactttgcgtgtgatttgttgaataggttgcaacaattgagacagggtgtgaaaagtataggggaatattatcaggaattacaaatgggcatgcttcgttgtaatttagaggaaactgaggacgctgctatggctagatttttgggtggtttaaatggtgagatttatgacatcgtagactacaaagattacactaatatgactcgattgtttcatcttgcttgtaaagctgaaagggaagtgcaggtaaatctacattatgataggcaggcaccacttctccggccggccgtactccttcctcatcttccacacccacacccagtcgagcagcacctcctccatccagtaacaagccacgtggccctcctgcaagttcaacgacaaaggctgtttagctagccgcgagtgcttcttcaattgcatccacgggtaaaacaagagatgttcagtgtcaccattgcaagggctttgggcacatgcagcgtgactaccctagcaagcatgttttggtagtcaaaaatgatggtgaatatttgtctactagtgatttcgatgaggatacacttgctttgcttgcagctgaccatgcaaataatgaggagccgccagaagagcatattagggctaatgatgcagagcactatgagaacctcattgtgcagcgtgtcctcagtgcacaaatggagaaggcggagcaaaatcactgacacacattgtccaaacaatgtacgtcatcaaagagcgttcttgctgcatgatcattgatggaggtaactgccacaattgctagcagcgagatggtggagaagcttgcacatagcaccaaacctcacccacatccatagtacatccaatggttgaacaacagtggtaaggcaaaggtaacaaaactggtgcgcgttaattttgcaattggaaattaccatgatgttgttgaatgtgatgttgtgcctatgcaagcatgtaggggtgaaatcgggtcaggttgggtcggatctcacccttcccgtatcctaacccacattttgcaatcggaatcgggtcaaatacgaatagtgtcgaatacggatacaaactcggataatatctggcacaaatatgaaatggatttgtaccaaaacatatatacgctatcggttacgaatgtttatttggatatctagtcaaaaaaacatccctatatatccctatatattcataacgtgactatattaggccattagtatcttacaatcaacgagcttctaatgtgatattgagaaagggaaatgaatcatcggcatccgtctttaactgtcctgtgtgaagtgactagtagttgtctggctgctaaccaatgaagtggggggggggggggtggagacgaggggtatgcagcgcaacgagctcatgagtcacgacggtttccagcggacttccgactgcgggtgcattggggtgtggtgaaccgacgggtgcagtggcaatggcggagactcgacggggcgtgcaggcgacggaggatcgacgtcacgagcgttgtggagcttcaatggacgcggcagcggcatggcgacaacggtgcgtagcggcagcggagctgtgtggctatgctacctatgtgttctgtgcatgcttgggttaggctgcctggctggtggctcgtgggccatttgggcctggtggctggctgggaagtagcatgttatccaggtaatatccggatatttaaccgggtaatatccacatattttaccggataatccatatccatcggataccaccctccctaactcgatacatatccgaaagaaaatacctgtattcgatgctattgtgttttcgaaagttgatttgcgtagtcgatgccaccaaattcacatgaaactaggggatgaatggaaaactgctttcaaaaccaagttcaggtgatatgagtggttagtcatgccttttgggttaactaatgcacctagtactttcataagattaacaaatgaggttttgcgtgctttcattgggaaatttgtggtggtatactttgatgatttattgatttacaacaagtctatgggtgaacatcttcatcatttacgtgatgtttttaatactcttcgtgatgcacgtttatttggtaaccttgagaagtgcaccttttgcacagatcgagtttctttgcttgtctatgttgtcactttgcaggggattgaggttgatcaagccaaggtggaagccatacaagaatgccctgttccaataactatcacacaagtgcgaagtttttttaggccttgctagatcttaccattgctttgtgaaggatttcagcaccattgttgcgccattgaatgagcttactaagaaggtgttggcggctgttaaatgccaattttataccaccaatacatgcataaaacatagattataaaacatccaacgtagtggtagggtttaattctgacattttccaacagtgttggtgtatatttgaatgtaggtaataaaccgccaaagttgggaggaaacttagaccaaagaggaggagaattctatctatacaagaatttgactcataagagtttactacttgttatgaacggtttactacttgttataattggactcataacaagaattggactctcaacacagactgtaggatcgagatgtcgactagaggagggtgaataggcgattaaaaattaaatgacacctaatcaaaactaacctaagttgctaggctcggtgagggacacgactaagtaagcaactaagttatgttttgcaatcctagggtgaaagtggctcaagtatatcactaggaaagtaaatcacactcctatgtcaatgtttagcaatcctagggtgatatgatctcaagtatgtctctagaaatgtaaattgcacaaatgtaaatccgacaatcaaaagagacaatgagacaagagatttttcaccgaggttcggaaactcgccggtttcctactccccgttgaggcgagcccaactccaccgctcaaccacgaagccaccgcacacccccttcgtcaaggggtgggcaaggccggagccggcccacggagaggactacccaagcctcgatcactcggggtagttcttccttcactccgaaggtagtgaactccaaaccactcacaaaccagcgccgggcctcctccacaatcttctcggagaggtcaccgggtaactcctccacaagccgtctaggaggcggcaacctccaagagtaacaagcaatgaaccggcgtggagatgatcaatcaagtgccacactagctctacaatggaagcaaatgcacttgacacttggctagaacaacctcaaccactataatggatgaacactaagctcaaagatgtgtgagagaggtgcaaggggtgtatgcaattgaattgggtgccaagagagtccccttgctgctggtgggggagtatttatactcgccgttgggggcgaaatcccccaactcagtgctctgccggtctgaccggaggtatgtggccggtcagaccgtgctactctacaacggctagttgctgtcattgggccccacagccgtggccggtcagaccaacatggggtggccgatcagaccggcctcggctcagtcagaccaccatcagctcggtctaaccgaatacggctctggcggctcgggatcggcacaccgagacggcaccatcctagccatatggccggccggtcagaccggcccgcacccgccggtcagaccggccttgaggtggcggtcagaccggcctagaccctgcggtcagaccggctgccctggccagtcagactggcacttgagccgcggtcagaccggccctggtcaggccgaaaacagtgagataaaagtttgtgtgtgtgtgtgatgaaatgagagcacaagtctaaatgcataatgacctaatgtggcaattaaaatcatctctttgctaggtcattaaccctcttaatagttcggcaaaactataaataaactagcacaattttgatcgcccaacgcctcgatcaatttagaaaagaaaacactagtttactgtcttctcttcctttagctttgtgccgtcaattttaatccataggtagacatccatgcgcacacataatgtgaacctaacttaaagatatagctcaaaagaacggttagtccacaattagcgcttgtcattaattaccaaaattaacaccgggggcctagatgcttcacacacctttatatgcatcgtttggggatgacaagtagtagaaaacaaaagcttagtccccaatttagcccacaaagttctccaaaaatggctatgaaatttagtgtcacgatcagaaacaattgtgtttggcacacgatgcaagcgaacaatttctcaaaagaacaaatatgtaatatgggtagcatcattagtcttatgacatggtatgaagtgtgccattttagaaaatctatccacaaccacaaaaatgctatcacgccccctcttggtcctaggcaatcccaacacaaaatccattgaaatatcttcccaatgaacactaggaacagggagaggcatatacaaaccatgtggatttaaacgtgacttagcttttttgacatgtagtgcagcgagcaacgaatctctccacgttttttctcatcttagggcaaaagaaataaccagcaaggatgtcctccgtcctgttggcaccaaaatgccccatcaaaccacctccatgggcttcctgcaacaacaataagcgaacagagctagctagaatgcatagcttgttagctctaaaaacaaacccatcattgaagacaaatttgtccctgtctttccatccttacaatatagcaacacatctttaaaatcagcatcatgcatatattggtctttaactgtttctagcccaaaaattttttagtcaagttgtgtcaaaaaaagtatatctctactagacaatgcatcagcaatgatattttccttcctttcttgtgcttgataacaaaggaaaagattcaataaattcaacccatttagcatgtctacagttcagttttccttgactacaaatatgcttcaaagattcatgatcagaatgcatggcaaattccttgggccacaaataatgctgttgtgttttcaaagtttgcacaagagtatacaattcattatcataagtagaataattcagaacagacccactcaatttttcactaaaatatgcaacaggttttccttcttgtagcaaaacaccacccaatccaaatcccactagcatcacattcaagttcaaaaagtcttattaaaatcaggaagttggaggagaggtgcatgcgtcaacttatctttcaacatgtggaaggcgttctcttgtgatgtgccccaagtgaaaggcactctcttctttgtaagctcattcaatggtgcagcaatggtactgaaatcccacacaaaatggtgataaaaccctgcgagtcctagaaagctccgcacctgtgagaccgttttaggagtcggccaactctgaattgcctcaacctcaatcccctgtggagtaacaacataaccaagaaacgagactcgattggtgcaaaaactgcacttctcaaggttaccaaacaaacgtgcatcatgcaaagcattaaaaacatcacgtaaatgatcaagatggtcatctaaagatttgctataaattagaatatcatcaaagtatagaccaccataaattttccaatgaaaggacgcaaaacctcattcatcaacctcatgaaagtgctaggtgcattagttaaaccaaaatgcatcgttaaccactcatataacccaaactttgttttaaatgttgttttccattcatctcccaacttcatacgaatctggtggtaaccactacgcaaatcaactttagagaaaacagtagagccaatcaattcatcaagcatatcatctgacctaggaataggatggcgatatctaatggtaatgttattaatagctctacaatcaacatacaaacgccatgatgcatctttctttggtaccaaaatcactgaaataacacatggactaagagactcgcgtacgtaccatttatcaagcaattcttgaacttgacgctaaatctcctttgtttcctcagagttggttcagtatggcgcacagttgggtagtgaagctccttgaatcaagtcgatcttatgctcaattctacgcaccggtggcagccccggtggtacgtccttgggaaacacatcctcatactcctacaaaaagttagtgaccacaggaggaaaagagatagcatattctcaaaagaaaacaaggcctctttgcaaatgagagcatagcaaacagtgtcacttgtatccaaattttgagtattattaactcaaattttaaaccacatataccattatctctactacttaaaaaatctatagtagtggtcttgattcctgacgtagcagagacactagacagacacgcgcagtcacaaccatcgaatcgccagatccaacggcgtggatcatccatcgcccattcgcccgatgctgtgagttttctttctcgctaaaccgctcccgatccccttcctcccactctcccgcgccgccgaaccaccctcaccacccaccgcagccgcgtcctcctcctccccaccgccgccgcatcatccccctccccaccgcctccgcatcctcctccccatctcctgtcgcgtcgtccttcgccacgacgatcccctctctccgtgcatccatcgatcccgcggcgaccaccgttatcgtcagtccctcctccacgcccccaacaccgatcgcgccgtcctatctactgtcgtcgcgtcctcctccttctccggtcctccccatcaaccgccgctgacgcccctgcctctgagtccactctagatccgccgacgcctactcctctgcccacacgcaaccaccgcccccgccgccgagtgtcctccccagcgctccctccctactccctggcgcatcctcccggcggtctctccttcgggcacccctcctccccggcagccctctggacgtcgaggggggcagtggcggccgagcaaggattgccctggggggacgacgagtccctgctccttggcatggcatcagcctcatccagcccggcgacctctcctttgggcgcccctcctccctggcggccctctggatgtcgagggggaagtggcggccaagcaaggattgggacgatgagtccctgctactcgacctggcatcagcctcatccagcccggcctccatcactgtgcctctctcttctcagatccactgtagccggagtcatcctccatcgcgcctctgtgcttttgctcaccggcgccgcctaccagcattacatctctgaactctcaccctctccatcgagagtttgcacaaggtacacgtaggcctgataacagcttgctcacttaagtctgtttatgtcttttttctttacaattttgcatcattactttgcctttccatcttccatatattccttaagagttacgactgtgtgtatttcagcctttataaacatattcaatcacctagcaatttggttgtgggagatgacttgcattgcataatggaggtaaatggaccatcagctgtggtaaatgaaaatccaacacaatgtaattccatacagggcactatttgaatcgcttatctggacaactatcttttatacaaagtcgtccccaattctttaccagaaatcttatgtttagttattggcaataattggtgaataattgatgaaatatgtggtacagttaatgtgcgtggcatgcaggaaagaatagccatcgatctggactaaaaatgttgccaccatctggaattaaaatactgccaatgaagttgctcagtaatattcccagggtatgtgccctgcagacaataaccatgcatttttttttcaatatactagattcaagctatcacatatcattgttgtcgcctgtcaaacaagtatgataatgtcatgatctggctctgaaatatcttgagtactgtttgaaggtaaatattcctgaaaggattatagtaatatgtggggcactttgcttaaatttctaagatacgcctgtcgtatgggaaattttcattattttgggtaagataccatgttttgctttataaattgcacatctactttttaccaatgcttgcaataaaatttcagaagttcatcatctcttggtgctactttccagctatttatattgcattatctccttctgtagccttttttattcgccgttatagccttctatgcctgctacaatatattgcatcatctagcaaggtttgttttaatcctcttcattattacaaacactactagaaaaataatttatcgccacgaaaaaaatcatagcatcaatgttaaaattgtggcaatagatacatgttgccacaatcttcaaatcgttgctagccgtggtaataaatagcgtggtaatagtttattgcaatgatttttatttagttgtaataaattttgatattgccataaaatggatgtggcaaaaaatatatattgcaacacttcacatcgttgcaataaataactattgccaccactccatgtgtggcattagttctacataccaaattaaatgtttcaatattaatttatcatcctaactattttcttttgatatcttgtcatggccaggattcgaaccaaagatctctccctcacgcgcgctctccatgaccaactcacctacgcatcaattttatttaaaaatgcatataattctatttgagactgcctaacgagatttgaatcatgaatttgagtatctaaaatatttcaaatgaaaaattgaagttttagatctcatcgagaactataaatttcatataaaatttgtcctaatccgtgtccatatgaaaagaataagttaaattatgagataataaattttttattacaacgaatttgttgatcatggcaatagaaaatagtgaaaagtaccatgtactatgcaaattgccacaaaaattaaatgtgtggcgatagaacatgtttttttttgcaatagtaatgtttttttgtggtgataacttattttctattacaacaaaaatactgaataaaacaacgatcataaatcgttgcagcaaagtatagttatttgccacagaaaaaatatcattgtgatagtacaatatatcgccacgaattattttttgttgtaataaattggtggcgatagctaaattatcttgtagtgaaacggattcacctagataggccagataacctgaacatgatcccatatttttcttcgtcagataagcagtgggaagcagttggaggaatttctggattacaaggactcgattgaattcatcttttatgagtagatagagtagtccttgagcatgagcctggctatttttacattatttgcacacgattaaaaaaagatggataaagaatatgaggtcccaataatttctacacagtttgatctgaaattcggaatattcatatcctgagactcagagaaccatcaagcatgtctacatgtaggatgtttttctttgatgctgtagtgtcatttgcttgtagtgctggagggttatatctattgacgtgaactgtacttcaaactttagagagaatctaacgtatcaaaggtagccctgtacagctgtactccatacatcacttcagtgtcttccttggttgttcgctagcagctgaaagtgttgtacttctctgaacgcgcatgcatgttttgagaacgaacataataacactgcagaggattatcttttctaactgcaaacatgagcgagttgtatcacagtggtgttgtttggatgcttctgccgctcctcttcaaaactttagctgaatttgtttcatgccattttgcggtttggaagattgtgttacttattattgttgttggtctatttaattgtatgttttggtgatcagtgctcaatatctcgacctgcctaaaactttgttcgtaatctgaattttcgctctcctttgattctcatgttgtatgtaattttaattttcccgttgcgaattaaaaccacttggctggttgaataatttactctttgactgtatatttagtttttcaactaatcacatagtcgggggctacacctattagtcgatgcacctaagtatatattccttattgtttttaatttttttaacccttgacagcctcatgatttggtaaaagcactcgggagaccattgttaagatgattgaagcactcggcttttgatgatttaagttcgggagaagattgtcttttcgactatgaaagtctcagaggctattgtggagattatggtaacatttacccacatggatagcttatccgactggagataggatgtgggccatattcgtatattatgtaaatatactagactttggaatatatattgcggtgtttctcaaggcatattccataagtgttactagtatacaattatgtaaatatatagaggatccgagtcatgtccgattgggtcttcttcctcgtaaccctgccccccgacctatataaggtgggtagggaactccctaagggcataaccataatcagattgtcagatcaataaaacacttgacggatacaatatctgaaatattaataaggtattacttatcgtcaagaaggcgtggaccgtccctttactcattcattttagatctcgtgcgctaccctcttttctattgccaatttcattaaattttgatttataagtataacaataagtgaagagaggggctacaaaaggtttgtctagggagaaaattcgatctatagcataggaaaaaaccgggtaccaaaaaatagcacaacaaatttcttacttcgatcagaagcacaggccactggtttttcttcaattcgtagcactcctgtctttgcgatccaaacatattagttgggatgaggaaagactaatttttcccttagtcctctctattgagccgccacccgtcgccccgccgcctcgcctccgccagtcgcgccgcctccacccgttgccccgcttctgtccgtcaccccgcctccgcatgtaagtcatcgtccccgcactgaggtagggcatggggaagggacactagtacgggagggagaagggagatgtagtatgggtggaaaaaaaacaggatggaagaaggttagttgaggctaaaatatgggtcctatttgtcatacttgtaatagagatgatagatggagaggctgttggagtaactaagagtttgacttgccaaattagatggagagttggtcaaatagacatttggagagttaggtttggagagactgttaggagatgctcttatattggatccttcgctcctccaatctcactcctagagcctgtttgggagagtttttagctgctgcagcttctcccagaatcagaagctcccccaaacagtccagcttttggtatagattctgagaagctgtagttgtagaatccaaaaaatgaactagacccagcttttccagactcacagaagctggctttcaaccagccatttcttagaatcttaggtggtgtttggatccagggactacacgtcagatgtttggacactaattagaattattaaacgtagactaataataaaactaattgcataaatgagagttaattcgcgagacaaattttttaagcctaattaatccataattagcacatgtttactgtagcattacatagactaatcatagattaattaggctcaatagattcgtctcacgaagtagtccaaggttatggaatgagttttgttattagtgtacatttaatacttctaatgagtgtccaaacatgggactaaaattttagtccattatccaaacagcctctcaagctcccaaaacagcccctagtatcggagaatgccccggatcggtctaccggcactcggcgcacaggatcggtcgctgccccagcgcgcacgtgtctctcccattgggccccaccacgtgtccctgtctacctaccacgtgtctccaccacatactccattgtaacaaatcacccatatattttggaaccctctattaagggaattcgtttcatttttttttccacaaaaaatatttcacttagtgtactcacaatgtttcactatgtatagatctaatgttgcagtgaacgaaacattcttttgcaacaaatcatccacatattttggaaaccctatattaagtgaattcgttttatttttttttcaccaaaaatgtttcacctagtgtacttataatatttcactatgtatggatcaaatgttgcagtgaactaaaatattctttcgctatttgctgaaatattatttttatataaggtgaaacaacacccgatttaaacgattgaaacattttcgatctacttatgaaacaattccgatatacttggtggaacatcatgcaacatttaaaaataatttaataataaactaaaaattgttttcgtcggaatatatccatgtgtggtcttgttttgaaaatttaattgtaatgaatttaatggtgcaatcagattataattttgataaataatttaaaagaaaaaatagtttaaagtggttatgtacgcatgctgtgactgaagtcagtgcccaatcggtagtctcctccccccgagaaagttgcatatctaccattgcaaaagattggattcgctagaataccatcacttaagttggcttcaaaaaaatgccacactcaacaaagacggattcgctgaaatatcatcgtagacgatattgtccctggatcctcttcttcctccttcgagcgcaagaaagctcgccggcgacgatcgcacgccatggcgagcaacaaggtggagccgtggaggtggtacaactgttgtctcccaagatccacaccattcccatccccaaataaagcaagcagccccacaccattcccatccgcaaataaagcagagcactggtggtggctccgacgagctagcgcgtgatgtgagtgcgcgggcggcggcgggggatccttgacgcgatgacgcgagcaccaggcttctgcagcaatggttccttagtatgatgatgtgagtagtaggccccggcggttgctcgacgcgagcaataggcgaaggcgctggtagcggctggtcagcgcgacgagcatcaggtggcggcggtggcgattcctgtatgcaataaaacgagcaacaagcgtaggcggccgttcctcgttggggcatcatagaaggtaaccggaggaaaagttttgcatcatccggctgaattgatttttttgtcatccctgagattgattcctctttcgctggaatcaatttccattgattcatgccatgtaatttgcattcatcactgctgattgagacggtgacaacttggatgattttgccatttttttcattgctggtgcggtggtgcccacgacgtgcagtcgttgccgtcgagcttcttcggcgcacgaaggagaaagaagaggagctaggggcaatattatctagaagggcattccagcgaagttatttgtattgagtgtggtattttttcgaagtccacttaagtgatggtattatagcgaaaccaatcttttgtgatggtagatatgcaattttctccctcgcctggtatcgctgctgctctggttgtctctcgtcctgagtctccgactgagcgcctccaatctcaacagccacctcccacctgttccggctccggctagacctcgccgccggcgatccccagcctcagcgcatccaaccgacggaagaacacaaggcgccgcaccgcaccgcagcgatgacgctgatcaccctcatccgcgactacatcgatcgcatgctccacgacatccccgggatgaaggtcctcgtcctcgaccccgataccgtatgcgctccctcgaaccctagcctcttctcccctgcggggatgggatccgatcaccccctgaccagatccgtgctgttcgttccaggtggggatggtaagcgtggtgtacagccagtcagatctcctccggaaggaggtgttcctcgtggagacggtcgacaacgcctccagctccagggagtccatggcgcacctcaaggccgtctacttcctccgcccctcctccgataacgtccagaagctccgccggcatctcgccgccccgcgtttcgccgagtaccacctctgtgcgtaatccccctacatttacccgtacctatatgttttttttgagtgaaatacatggctggtcccttgagtggtgtcacttagtttcatgaacttgacaattgtacgtttagatccgtgaacttggtttaatgtaccaccctggtccaaacatcttttgactacgtttgaccgccaacgtggtatgccacttaggcaacacttttgctctcagccccctccacatcacaacatgtcgcatatatctccttgtagctatatagacaccagaatcccaaaaaaaaacctcaaatcgttcttccctctcattcttctccctgcatgtacagaaaatgtggtcccgattagcaattgccgttgctctgcgctccaaaatgaccttatccttgcacaacgggcacttaatcaacaacaccttcttccggcgacttcaagacaaggacaagcttggagaatccatggggatacctagcgtgcaagccgcattgagctacctcccgctgctaatccaaccgcactgtgccaccgctaaccccgctgcactgcgctgtctcctgccgctaatctcaccgccgaggccgccacaactgctacctctcagcctccttctgctaacctcaccgtcgaaaccctagctgatttagggatattttgggggatttgggttgaaacgcactggtcagggcaagttatgtgtgaacgtatatgtggagggggctaagcacaaaagtgttgtatacgtggcatgccacattggcggtcaaacatggtcaaaggatgattggaccgggagtggtacattaaaccaaattcacggatctaaacgtgcaattttcaagttcacggacctaagtgacaccaccctacaaatttaaggaccggccatgtatttcactctttttttttctttcttgcatttctgtgcgtaatcaccctcttgcttgatttcttgtatgagtttcttaagacttaagttaggttgagaggtgcagacaatttggtagacagactagttgttacgtgatcaaacccaacttgaccaccacctcctcttcgctggttgaaactctgctaattgaatcttagatgcttttgtgtggtcattctccaagttatgtgcgtgtaggtgttaggatttcataatctctagtttcattctatgttggggtttaatggtgtgcaaatgtaatgttttgtgtagtgttttttttttatttgtttgttgattgattgtctgcagtcttctccaatgtattgaagattccacagattcaggtgctcgcagattccgatgagcaggaggttgtgcagcaagttcaggtatatgatatatatggtattatatgcttattgcaacgaactttttgtgagtagagtgaggagatgggatttttatattaatgttttgctctcttattccaggagttctatgctgatttttgtgccatcgacccttaccatttcacgctgaacatacgcaataaccacgtctacatgcttccaatggtggtggatcctcctggtatgcagagtttctgtgatcgggctgttgatggcattgcttctgtcttcctggctctcaagcgccgtcctgttattagataccaaaggacatctgatgttgcaaaaaggattgcacaagaaactgcggtgagtctattgcccctgtaaaatatgtctatttggatcctatgaacatataaattgatactgataacttttttatattgtgtttatttttagagagaattgtatgcatgccagactaaaaaaaatatttggaatgccactctaaaccttaaacatttctgttttgttacttcggcatattttttggtgttaactcaaaaaataggtacaatgtcccttgacacaatgtcaattattccctggcatttaaacacaatcttctctttctatctctcatctcatgactagctgttcttagctgctttctatggcacaatcctggagcacttccagcctcctgattgaattttcatcagtcgctaggcttatcttctactacctccgtcttgaaatataagggatcttggcaacggacgcggacaagcttgtccaggtgcgttgccaaaatcccttatattttgggaggtagtagttacaaagttatctttagagatcatttgttaggccagcttctcctataaagaacgtacatcacccactttggaaatcatgcagtctttacaaaatacttctacctgtccctcatgtcagcaattcttcctgcctaatctctcttctacctgcctcctgttcccattcattttactatcaaattcttatgtcctacccaggtactcttctagacttctactatccaagcgcataacaccaacttattatgcctaattagataagttatccaaaatgttccaataataaggatcatattctatcagtcaaactgctaactattcaaaatagccactaatatcgaacttgccctgaatcacttacattctgggtcctgcagagattgatgtatgagcaggaaagtggcttgtttgattttagacgaactgagaactcttccttgttgctggtgattgacagaagggatgatcctgttaccccgttacttaaccaatggacatatcaggtatcataaaggaaataaacaccgttatttttcatatttcagttgtacctgtgttaactttcttgcaattttgcatacacaggcaatggttcatgaacttattggaattgagaacaataaagttgatctaagggaatatcctaatgtccctaaagaccagaaggtctatcaaaatgttgaatttatgttcatattgtgataacatgcatctttttttgaatgttgatccatctgaaacatacttacacaggaggtggttctatcatcagttcaggatgaattttttagggctaacatgttcgagaattttggtgatcttggtatgaatatcaaaagaatggtagatgactttcaacatctttcgaagaccagccagaatattcagagcataagtaagaaacttttgcctttcttgtttcctacgaaagaaaggaaaaaacaattatgtcactggaaagtaggcagtgcagatttgcctttgctgtcactgacatgtagtcccaggactcatgtgagtcacacatacaatggagaataagtgaatccccctgaaagtaatgtttaagctagccacccttctttatattgttacatttggcaacctcatgcttccaatttttacttttcactagcattcgtaatacatacttacatatgtttattttggaccacttcagctaattttgtttctcttgccaatgctgctaaaattccatttcttatcatgttaggttttggttctgtatatttttgtgtatatgtgatgtgcatagttggggtaagggcctttagacctattcgaggtgtcgttggacccaagtagcgcaatggtgccgttgaggctgccgtgccacaagggcagggaagaagaggaagagtctaaagcctagtggctccgtttgatatagattattgcagcagattatcgatttaattatagggatacattaaatataataagaaataaacttaacaaatagctcaaaacaagtggtccaagcgatgaaatagaagaaagttttttttttttttgagaacgtatttttcgaagcatggagcaaataacccacttcagtaatctggtgaataagttcaatagaacatggagttcatttcttgcttaagatactatcccatcctcatgggatgagtgatgacttgactcttaagaaacatatcactgagattaaggaaatagctaagtaaatctcatcctatctagtttaaacacctgcctgtgccatgtacagtaccacgcgtgaacagtagcctcgtgtgtactgtttacggtggagtaccactagccctagggaggctgattgctcttttgtccctaatgggctgcacatgcagtataagtacatatctctgagcagtggcggagccagggccagttgcctgggctccgccggctgcacgtagccattccccagtagattacacctaatttccttgctaatcgtctttcttagtcaccgtatgaactgaagcagcagcaatatatatagtttacatacttaattaacgtgcttagcgcaaactagcaaagcaaattcttacaaaatgatatatggatttgaatagaattgtgtggactatatttgttgttaggcttgcccaggctcataaaaatttctggatccaccactgtccctgagtgagtattgacctttatgtgttctttcctatttttgtattttatgtctttcaccaatttagattttaaaaagtaaatttcacaaaatcccaggtattatggttaaggttgtataaaatctatgtaccacataccaaaacctatgtggttttgtgcaacatgaaccataattaatacctagggttccgtgatatttaattgattttaatgcatgtgcattgttgtcatggcaagctgtgaccgtgattgggctgtgtgcacttggattgaagtgttgaatgggttgctgacgatgcttgcaagctggtcctaggaagaagcattcatgagtaggcctgctaatggtttgggtaggaatgggtttatgcgtcaatttaaatttttgctggggtggtttgggtgaagctggaaattgtttggtagtggttttgtcttggtcgctaattttcaggcccaatacagtttcataaatccatggggacatgtggtttcaggttggcagccttgatcagactcctggaccttgctgccatcctcctggggattttgttgtcctgagttatcagtatcacttgtggttacgggcctccatcgctgattttgtgcccctagacagcttagagggagagggagggagaactccaaatccacttcttctccatctatgtcgaccactggagcccgcctgccggcacttctgggcccaatgcaccgctgttgctgtcttatccacctgtgccttcaccattggtggccctgttggcttggcttcctaactcatactcattagacactgccaacacgatttggttccaaattccaccgacatccttgggcagtgccccaacaggtaggggctcgctgtcgtccttgaccagtcgatatagagctgccactcacagttgacgttgctgctgctggtttccctctatcgccatagacagttcttgtcctcctttccacctcagcagcagtggctggatctggttgtcttgcacgtggtggcgagaccatggccgatggtcacagatcaggttattggtggcaaatgggccaaatggccaaatgggctgagtgtttaaggtggatttagagtgagctgaaatggtctgggaaagtggattctaaactcatataggaggaaaatgggctggttcagtttgggctcaggtgg

SEQ ID NO: 69549 - DNA, 22595 bp, Oryza sativa
aaacatgaaacagcttctccatgagcttagctctacttctgcctcttgtagatcttgtgcaggaaggatttcaatacattctgaactgctttgttcggatgtgcttcgatgtcggcaatcagcttattgtaactctccctctcgtattcatgaaatacggcctgcagtataacagataaaagcagtgcctcaggtcttgcaatggataaatgagaaattctgaattattgtttcaagcatcttcaacaaatgagttccttcttattcttaaaaaaacaactgagttctaagttttgttcctcatcgagttgggatggtaattattctttttcacacctgcgtatgatgtctgcatatgtttactcaggtgatgatgatacacataacataaatacagagaacggttaagacaaacctccagattaagttctttatacagatccttcacttttgcaacacattcaggatctggcttcccataattttcctgtcaattagacataaaggattcagatggtgcccatgggttgataaaaactacaaagttaataatacttacaaatagaatgtgcttttggttctcgtcagcacgctcgagagcttgcacaactaaccatgagcacttgtagtcttcaatgtccgttccaatctgcattaagatttctactgatcagatcataagctacagataaaataagcctggacagcaatggaccgattggcagtagccatactcattgggattagtacaaccacaacgggcacactaaccttgccaataaactcaggatcaccataacaatctagataatcatcctgtgagaaaactcgtattagtgcggtagtccagtaatatataaattcacaaccaacaaggtgaaaaggtacctgaacttggaagtatgtccccatttccacaagaatgttcttaacatcaccgaagttatccaaattctcaccagatagcagcaaagcacatgcaaccttggataaagaaaaatattattgctagtgatgacaactattcgcagattaccgaagtgagagtttaaagatggaaaaaatccataggagaatggtaaatcctaccggaagatagaatgagtagtaagctgtcttgtactgaacaatgcggcggtgactgcacaatatgtcagttaaaagaacaccattaaatgaagatcataacccaattctgaactgctaaaataaaatatagtgcaaatacaactcattctagaaactacacatggaacacagaaaaggaactatctgttattttttccgttcctttgttttgtttgaaccttatttttagaaacaaatggacaggaaatcatgcaaagaaagaaagaaacaaacacgtaaatgcaaaatgaacttacactgtcaagttgtactttgtgagatccttttctccctcatgagtagtaataagatccaacaattgacctgaagcagtcttaaactcaacctaacaaaacaaaaacatacaactgggcatcagggagaagcgtacagtatttttttcccaacaatatgtgcatgtcagaagatacaacttacctcattgaacaaatcaatgagatcaacataatacagctttcctttaaaatggcgttgaagaattcgtgaaatatggttgcgaaggataataccatcatttacagcaatgagcccaacctattgcaaaacaatgaaatacacaaatttagttttataggtaacagatagcaattcaacattgtgctaatctgatcacactccttacaaggattgaaaaaagggaacatgaatcagttacttaatgcatgacctttttttttcaatgcctgtgcaattctggattataattcatacagttataaaaaaacaatatatataaaaaaattgatgcatacaaaggatgattgttctgctactgacctgaggcaccctaaaccagcaaggctggccacgtcgtgtttgagagttgtccataatatcatcaagcacaagaaaataagcttgaagctgcaaaattatgcagaaccatcagtggtgccacacttagcatataacttcacttggctaacaaacatcctacaagatagcatttggagaaaacattacccattcaatgcaccaaccaagggtgcaggcaagaaatgtctcctccttattcagaacatcagtgcccttcaacatcttgaaactatcaatgacagagatcccgcggttgcactttcctccgagcacattgtaatccagcatctgctccggataaaaaaaaaatgtcaactactttaacatactcaaatatactgtatgtccaatttctgtgggtatgattctgatatcaatacacaataaataacaatggtaaatggaaatggaaatggtaataggtagaggataaaaatcaaacaacagaaacaaaccatcagcaaccaatcatttacacttagctactactgttgtgtcattaacagtaaaaagtagtaaaacttttagaatacacctgaacaatgtattgtgctccccagcttttcacctatatatattttattaccggtgtttcgctttggacaactctttaaccaatgctttcactttggaccggataatttacctttgtggcactttgggccaccctcaactcctttatccatctgcattcatatgtcaaagaaatgatctacatatagccgagggagtttattgacgagtatgagccggcatactcgaggtcattcatatgcttgagaagagagttggggtgtcccaaagtgaaacaaaggcaagatttacctggtttaaagtgaaaacattggtcaaaggatcgtccaaagcgaaacatcagtaataaaaggtggcccaaagtgaaatttactctttatttttgaaggaacatctgtaatatttatactgtctaaccaacgggatctgaaatattaacatgcaaagtagtaaaaacaactagctctttttatctttccacggttaaggagatgcagcttggatctgaaatattgacatgcaaagtagtaaaaacaactagctctttttaactttccacggttaaggagatgcagctttgatagatcgtttttgctgcaatatagaacaactcaacatacggtgagttcatcttttatgtcaaggaaacccacagcattttcaccttatcgatctaaatattccaaaagatgtacttaggcaaagatcaaaatactcaacaagaattttgtgccccccttcctccaacacacacacaaataaaagagaacatggtgtccaaaaggctagctttactaattttttaaaggatctgttgtacaacagaaatgaaatccgtatgcttaaagttcataaggtgactttatatgatctacttcaccagcgactgtaggtaaaaaaagacactcctgtccggcttttcctaacaagttgatcgatcaatcactgtagcctagaaaagccctgccttccttgttcacctactcttgttaacagataagagagagagattactcgctctgttgctcagagttcagacccactatgcaattcaacacaccatatcgatctgtatgtgagacgtaaacttacttcgttaccccctagtcattgctcgcatactccatactcctaacattctaccatcaggaaacacatataccaataacagagcgaatccaccagccaagcgccactcgtaagcccagaaaacccggcgaaattccaaaagcctttgacgcgtcacgcgagcacgtaggcatcaacgccaccccctccctcccctctcgctaaaccagatcaaaaaccaacatccgtatccctcccagcataaaggatcgagacggggaagagagcattacgcggtcgatccactggagcgactcgtcggtgaactcgaaggccgggtcctcgagcatctcctccttgagcctgctgtatatctccgcgaacgcggccttggaggagtcgccgctcgcgccgttcgccaccaccgccgccgccattgcgccgctatccctcgactgcctcacgtgcgatgcgagggcgcggagagagagagaaagagagaagaaattagtggcgagtattggagaggagatgggggatgaggacacacaaaattttgtggggagaagcagcttcggcgcacgcgtttatttaaggacgggagatgggcgccgtgagaggcacacgtttgcttgcttggctggtttgcggaactagcgttccaccctttccagaaaacaccgtgaatttgacagagtttagggagattttaatttgaaagaaacgtgtagaataattgggaggagatacgaataaacgagtaacggattggagggcgacagactgacagtgcggtcttggctactgatttgggtagtactccgcaaaatcatactattttgtttaatttgcaatttggttgtttagatacaaacatttattgttattgttttagctgcaaatgcatggtaactcaatagaatttccactacaattaaagtattcattagtaaaatctaccgatgcatgttcatgtcatgtaataatccagaaaacaaaatatatttgggttgatcggattcatggtatacaaatttaccgtaatgaaaaaaaaacattattatttattgtaccggctccgtgtcaatggtatttttaaaaatttgaattatgccattatatgtgtttgaggtgttgttaaaccagtttttttcataccgtatttctatatggaccaaaaatgctcatactagttattacttcatttgtcccaaaatataataatttttagctcttaggatttgtcccaaaatataacaacttctctaccaacattctcctcccaaccaatcacaaacctccaacattcacttttcccacctacctccactattcatccaatcacaatgcttcatcattcacttctacctacatttcttaataaccgtgtccaactctaaaacttcttatactatgagacggagggagtatcttcttatttcctatccctcgtcaacttcctctagctctatgagaccggtgatggctttgggtggcaggttaggagctttgatgtgatcggggtgtagcgagggagctctacgaggccggtggtactctcgaagtggcaggtcgaagctcgacgaggccgagttgcaactcgcaagcttaacgaggtcggtggcagctcaggagccggtataagcgcattttacaactaatatatactactacgtaaaaaaaaagaatttctagctacgagcctggaaggattggtttttttattgggacagagagggtacataatagatgagctacaatggtgtatctcttttttctcatctcgcttcctctcctctattatatttggtgcatctacatttaagtatgtgaagaactaagtcataggacctgatttttttctctctctcctttatatacgcttatagaataccattattacttagctccccatgccaacgtcagcactccacactccactggcacgatgggtcgatggtagcgatggagaatctcgcatatcagttagcggagtagttggcaggtaagaacgacaaagtaacattgattgattcgcgatatgcacgaggtaaggatttttttgttgtcgtgggcaaccgaaaaaaaagctcctggtacaactcccttggaagatagtaataggccgagcaagcgaagaacatgaatataatcaactgcaatgagaggattattggaggccatgagtacttttaggctgtattttggataactgaaattgataatgtataatctgatttttttatagctattagaaagtacatacggataaatgaaccattacagagttgaaaatttgctttcgaaaaatattacaacaaaaataaatttacaaaaacaacgtttataagtttggaaaacaggcaaataaaaatccaaaatcacgaaataagtgtagctcaattagttagattccatatgatggaaccggcccacttgattcaagtcttagatttgacacaggtactcgcaattatagctaattattattttaatgacaggcaacgtacctgtcaataacaatacatgatgttccagtcttctgaatgtgctcagagataggatgtgtgtgtacacgttcatgggaaatatttcggatgtccttatagaaataggatgtgtgtcttcgtgtttatagggatgagtgtgcatatactcgtctaatttttttagaggtgctcatagcgatagaatatgtgtgtacgtatgttacgagggtttgcatttgtactattttttcaaagaaaatcaaaagataaaaacagaaaagaataaagtcgaacgagaccacacgaattgctccatagggtaagaaaccagtagtcaaagaaataatagtcgacgatcggttatactctttcgtatagaaccatttagtggttttaaaaacatgctaagtcaaaagagagagagagagatattagtttggaaaataggggaaggaactcagcctatatgtcattcttaatggattatcctgtcagcatttgcattagttttctgtaagatcaatccactttgttaagattatatgggactaatcaagatgatgatgctacacgtatgcattatatattttctgattcggccgtccgaacacgttgagtgcgactgtgcaaacacgtgagcagtgagctaggagtacgcgagtcatgtgacgaaagaaaggaagcaccgggctatgccaaaagaaagccctcagggagtttaggagtagagtagttggacagtgtgtagtgcactagtgccagtgaactgctcgctaattccaatgggcttatgggcttactactggattgtcacctgtcaacgaggagcaagcaccggcgccgtaacctccggccacgtgtgtatcctcccaatcatgccagcacagtagatccacacgtggccgcggcccacaccgtgacaccgataggcgataggatcgagttgcacggctgcggctctacttggtctcgaggcacggtgccatctccgcgcggtgcgtctccgtcgctctccggggtccggggctccgggccggagaactcttccaccgattttcccccaatccccccaccaccgtatgccgtcaccagtgaccaaagtggctgcccgtacgcaggtaggcaccgatcgtcgtccgcgaaggccggcggcttgtgcccaggtgctcaactatcacgtggctaggtggcttgaccagaccagggacgtacttgaccaacggatcgagtggcgcacggcgcaggccctacgctagcacgtagtacgcccgttaatttcacgagcgagtcgcacgagacgcatgtgtgtgttttggttgtatatagagttgtgtcacttgtgtgttttgtcttggggcttctccctctcgtgatcgcgtctgtggaagaaacggcacgacggtctcgctttcaccggccggtcgtacaacggtctctaggctcgtagccgccgtctcccgcagggcgcagcgacgaggtgggctgattgataattataggctgggcagtaggtcaataaactgggccgaaaatgttggcccactctgagccaggcctagaatacagtactgtagtagtttcgaccgggccgaatacctttgggttggcattcgctggagcacgagcgcaaaccctggtatatgttctcgtttggtttctgctgaaaaaaactacgtacacgcgcatctcgatcgaccacattcgagagatgcaacaacaccgcaaacaacacacacacacacacacacacaaaaaaactcttttacacatttcccgcttgtctacctagcctaattaatccaagcatatctttttcacatgcaagtgtatgcataaatattcatcgtgccgtcatcagcaatatcgaactaggtcagtgcacgcatggttggcgtgccagggtttttttttcttttctttttcttcttccgtgaggtgcgacgcatgcgtcggaaggcgcggtatcagtagctccgtattcatgtcagcttgtttttctagctgagctcttgcttgcagagagggcaagaggagatgatcctgagccacctgtccacgcatttcaggtggaacatgtgcgtgcacggcagctgcctcacctcctccttctccttgtactgagccaggcatatgcagcactcctgccatttaattccagtaagtatgtaaaagcaaggacaattcctagtttcctataagttgtgagctctaaacaataataagctagctagagagcaaactaattggcttagatgtataaaactggacaacatcaacacatcatagctagttagcactagtttatgttggctaagtgcctaagttgttcctaagcaagcaccgaaccaatgggaaaggtaaaggttttagcagttcttatgttagctagttagcactagctcatgttggctgagttgttcctaagcaccgaaccatggggaaaagtaaggttttagcagttcttatcttagtatatccgcccaaaaaggaagattgttctagtttggtgcgcacgtttcatcactttttggatatcctattctggccaatagccgagttcaccaatcatttgtttggcgagtttctccttaattcccctctctgcatcgctaaactttcctacctccccgcagagacatgcacgctgctttgctactgcctaatcatctctgtgcatgcaaaactaacatatcccacgatattaacgtacgcggcaacggaacgtgcgctcacctgatcgtcgtggtcgcggtctctcggcgcgtcggccggctccttgaaccgccactgcggcagcgcggcgagctgctcgtcggaggcgccccggccgacggacgcggagttcatgttgtacccgagcgcgtagccgacggccgggacgaagcagcagagcaggaggaagaggaggaatgggagcgagtagacgacggcgttccatgcgaggaggccgatgcagagcgcgtacagcctcggcgcgcggtggaacgacccgagccgcgcgtcgaacacccacacgttgcccatcacgaaccacatcgcgaagaacagctccaggaacgcccgtgccttgttcatcagatacgacctgttcctgcatcccacacacacaatttcaatttccatcaagaaattaagaaagctaatcagctaatgccgttttatgaaccttagagggtcgttggcgccgtgcatctcgggatcgtcggagagcgtgccgccgcgggcgccggaggaggaatgccggtggcgccagtagaggagggggaggctgagcacgttgcccacgttgtaggcggcgacccaaacccggagcggccacgcggggcgctccttgggggaggtggcgacgacggcggtggtgacgaccatctgcgccatgatcacgccgagctcgagggcgagccagccgggcgagttgaaggggttggagcccaggtcggacctcgggccgttctggtactggtacacccgcctcaggaagatgaaccaccgcgccctcgacatgcgcgccaccgcgcgcatcgtgaacgccgacacccggcccgtcccgggcgtcgccgacgacgagggcggccgcattgtggtggccggtcaagggggaggggcattgggggcgcggctgatttgagcgtcaagggataaaatgggtgggaggggaggaggcgatcgagttgggtttgagatggtgaccaacaatctaacggctttgctttggcgccaagagtggaggtcgtggtgtggtgaagataaaaacggttggcctaaccgtccccttcccgccaatgcttctcatggctcttaggctctagcttgtgtttggttttgtttaggtgggacgcaaggagagagagccacagaggttcggtttatggtgggcagacggcatgactcaacaaagatcccttgttgatttcatcctgtagtactaatacattgacacattgtttccttaaacattgcatttaggtcacgattttatatatttgaatgtcgagtttgatttggtttcggtaaaaaaaaaaggtactagcttgtgtgtatctctattgtaatggtaggtgaagtgcaacagtttaaaacagcattacttgtctgaaactatatatcttgaatcatacagtgcctttcagtcaaggacgacgagagggatcatcactcatcagatgtcgctgcctcatccattgtgttgaatcgaagctactgacaatgaagcttatatagcaaacatcacaggaaattgattgttttctctttttttttggggggaggaaattgattcatgaagctgccgcagaggacccggagctcctctgtataggttgaacgtctctgtagatgtggtaggcaactaccagcagtccgcttcctcattttggttgagaaatcccgtttctgacacggtacttcaaacctttctggtcacttcccgatcgcagatccaccatcggtgaattaccgagacgctcaatttggtatcaatattgtcgtgtgcactagcaggtaaacaggcggggtccggggatccattgagcctgaggttatcgctctcgttgcatacgtgcgtttacgctctttaccttgtgcagaacgggtgaatgggtgatctgcaagttaaatctgaagtcttcgtgggaaggtgacatatgcctctctctctcttgtctagttgtctcttctctctttacgcgaaggcaaagaccgttcctgctacacttccctcgttaaaaaagaggccgtgcctgccagtttggtaacacccgcaaagggtgagataaaaccggatcaagttcactttatgtccctcatgttgatattaagtttgaattatattcttaaaccagaatatcataaatatcgaacccccaaattttaaagccaaattaaataagatcctaaagcaataaagatgattattttggttgacgtgaaatcctagtcaaaaaaaaaatgtggggctacatgtaagtgggcttctagaggctctcttctttcttccccatctccacctctccggctctccccactcctccataggagcttgctggggggagacggtcagctactagtgagaacggagcaaggcggcagcggcaacggagtcatagagctcaagcagtcgcctactcgcctcactcctctcacctcacgaccggagtgcagcatcgagggcggtgcttgggcaaaacacgatgcgacggctcctgtctcccaagcacaacattggctgcgtgtaggacagaaacggatggctcgggccttggtgacattgtcggcctcgacgcctcggcagtcacaacaacgacgaccatatcctcctcctcccttgcccttccctctcccctaccagcggcaatagctgcacaagcacgagccatacaccccccgccccccgcccccgggtgtccagcgttggagatcaggcgaaggtagaggccaaacacgtgtggtgcagggcgcaatgggagtcatcgtggccacaccacatgatgcgacggctccggtggaggacgagcgtcacctccaagtctttcggcgttgtggcctccacaacaccctgtggagggctccaggcaccatggagacgctcgtttgcatctgttgtggctgtcgaggcaggctagcatgggatgcgcatggagcttgatgatggtggcgttggcttcctcgcctgcaggcgcggtgaggtgctctccacgcaggagctggcctcgtgctagcgatggccaaccggtgggaggcggtcgtggtggtggaagtcgcctcacacagccacaaacgcatcctctctagttgctcaccgctaccgtcgctttcaaggaaacggctgccaagctcgagctcatcagctccttttcctcctccgctgtggaccaccgacaccccttcgccgttgacctccaactaccgcttccgtctcccatgacagactcatcggtcgttgtccctctcctcatcggcgagctcctagagaagagacgggagagttgaaaataggaaagagtcgataggtagaagtccacttacattttttttggaacgactcacacgagacggtgcgaggttctattgatagagtagtaaaaaattacaagattataaccctagagagtcataactaggaaaaggaaaaaaataccaccacccacacgccgacatcgccaacacacacgcccaggagaaggctaccaccggatcggccgccgctaagcgtgaccgactgccactagaccaacaaagggcacagacgagatcgcccctgcgaaaccacggctgacgcaccgatgctccaccaccacacaagctttgccgacatgtgggaccccctcaccggcatcccccgccagctagccttcgtgcgccgaagaccgcgccacacccaccggcagctcctcctcacacctaggtcgcctcctccaccgccggcagtgcctcactacgccaaaccggcctcctctaccggacgcgcctctcgcgccaatctggcctccctctaaccgtcgcacctctcgcgccaagccggcctccatctccgccgcccacgcctctcgcgccgagccgacctccgctgccatcggttgcgtttctctgcaccaagccggtctccgacccctccatcgaacggtgccacgccggccagatgcggacgtctcccacgccttcggctagtcaaccgaggctgccatgcctccggtgaccgtgaacacggtcaccaccaccacagccgctactgccgaacacctaaccacctcgccgtcatcatccccacctcgcacccgactccttccccgccaccaacgtcatcaccgcctctagagtcacagccaccgtcgccgctgccaccgacaccaaccaccgcctccgcaaaaccgccgttgcgccatcgccctccaccaccgagtaggtagcagcccgacgccattgcttccaccgccgtcgccagatgacacggcagccaccacgttgccgccggcccacggccgccgccgctgccgtcaccacactgccgccgtcgtcgcccactgccgccggcatccagatccggccgagaccatcgcctactgccgccggccgtcgtcgtcgtcgtcgccaactgccgtcggccaactgcctccaccctccagatccggccgagaggcgcggatctgggaggcaccgccgccgcctccgcgccctcggccaactccatccccgccgtcgttgccgccaccctcgccgccgccagttgccgccccgccaaatccggccggagcgggccggatctggcggtcaccgctgcttcgcctaggacagccccctgcccgcccgaaagagaggacgtgagaggccccgccgccgcccttgcggccggccggctttgccggcggccgctcgggcggtggcgaggcggagggggaagaggggagggtgaggggcggccgggttgccgcctcccgtgccgcccccaggggaagacgacgcgagagcttgtttctttagtccacttacatgtgagccacacatggtttttctttctgattaggatgccacgccaatcaaaacagccattcatactgtcttatgattttatttaacctggttttgaaagacaggggttcaacattctgacattacagttcggtgatgtaattcaaactcaaactcaacgtcaagatgagggagcaagagtgaacttgttccaaattttaaattccagcaggatcctggttgcgaaaatttctggtccacattgacatttccggggcgttgcgacgaggaggccacgaggccggagcgtccccgtttcttcgaggaataagttcactttaggtccctctatttgtcgtccagtctgattttcgtccctgaaccgcaaaaccgggcacgacccgtcccccaacttacgaaaccaggcaaacgagatcccttggcggttttgacagtggttttggctgacgtggcgcatacgtggctaatttgacttgtcttcatatgacgtggcactgacgtggcaattcgatccggaaaaataataaaacccgtgggacccacatgtaagttgcacacataaaataatataaaaatggtgggacccacgtgggtcccacctgtcatcgtcactcctcatttcctcctcttctctcggcatcttcatctctatcccctttcctctatctcttctctctacagcagcgccaccaccacggactccgccgccgctcccgccaccgccacatcccttgccggtgatccagatgaggttccgcggcgtgcaggtggatctcgtgtacgccggcgtgtgcctcccgtggtgcccgacaacctggagtggacctcagtgcgaccggtcggtgctccgcggccttgacgaccttgccacggcgcgcagcctcaacggcatccgcgtggccgacgagatcctgcggcttgtcccggagaccgccgtgttccgcaccatgctgcggtgcgtgaagcactgggctaaggcgcggggcgtctactccaacgtcgcgggcttcctcggcggcatcggctgggctatcctcgtggcgcgcatgtgccagctctaccccaacacatccccagcatgctgctcccgcgcttcttccgcggctttgcgcggtggaagtggcccagcccggtgatgctgcgcgccatcgagcacgacgacggcgagctcggcctcagacgccaccctgcgcgtcatcaccgagcagctcgccgtcggcgacgacgtctgccaggagatcgtcaaggccgacgccatgtgggtggtgattagttaagtactgcttggtcttaatgatcggtaactgtatgtgttgcagcttgactaacaaatcactgagtctgagaaataagagtggaagtgtagctagttcgccgcaagctcgtgtttgtccactgaagtatttgcatcacttgtgtattccttcgtgcgtgtgtgacctcgcgtgtgttttgttgtttctctgggccaaagctcacagggctgggtggagtcgcggttgaggcagctgtcggccagggtggaggcggacacgtccgggatgctgctctgccaccttcacccgcaagcgtacgccaccgagcaccacaaggagccgcggcggcagggggagcgggaagctgtctccgccgcggccgcctcgacgccaaggatctccgggcggctcgccggcgctgcacggatggccttgaggagagcagctagctcgctcagatggccttgaggtggtcggcagcggcggcggcggcgatgtccttgccgtcggcgtctcagcgagggcgacgatgttgggggagtccatggccacgacgtcctccgtggtgaacccatcctcgttgcggaggagctccttgctgccggcggcgaccatccccggcgtaggcgtggcagtgcacggagcatgcggcagcgtcgacggcgaggtccgcctcctgagcgccgtcagccttcagccttcccgagccttggcacggcggacctcacgtggtcctctcccaccggggactgagagagaggatatagataactgataagaggggagaaatagggtgacaggtggggtccacgtgggtcccaccattatttttattattttgtatgtgcaactgacatgtgggtcccacgggtttgttatttttccggatcaaattgccacgtaagtaccacatcagtgccatgtcagataaagaccgagttaaatgagcaacgtaggcgccacgtcaaccaaaaccgctatcaaaaccgccgagggacctcgtttgcccggttttcgtaagctgagggacgggttgtacccggttttgcggttcagggatgaaaatcagactggacgacaaatagaggaaccaaaagtgaacttattcctttcttcgaaagcgaatcaatcagcgaaaggcccgcgctaacacctcggcgcgcggtgggactttgggggctttcagtgtgtggcccgtgtgtgcggccggaacagaggtggacaccgtttggtgcgggcgcgatggatgatggcctgctagctgcaggctgcgtggaagtccagttctcccaaaacatgtgagccagggcccaaaaatcccgcaccctccaattaccgcaaacggaattatacgtcgttcgtcgatgtacgattgcaggccgagtcgccgacactggttcatcgatgcatctgatctgatgcattttatatattttagtttacttgagtacacttactttgcctctaaagctagacctgtgaatgatttttttttcaaaaaggaaaaaaaaatcatcaccaaactgatcgatagaggcgctggttttggagttttccctcgttttggtttttaccggttcagttgtcggcctggtaataattactttacctggaagtaactaatttatcttgtgcaacgtttctgtctcgtcagaaaaactgtgcagccagggaagctagccctgaaagagagatggtatggccgagccgcaaatctcttctccttgaaatggcaagctaaagatgatctcatcgatgttgatcgctcaaggaggcaaggaaaattaaggaggcgagaaaagtacgtaaaggagatgggaacaataagtgtaaaggcagaactgaaaactaattacccaaaactttatggattcgatcactgcttgacagggaacatactctaagcccaggaaaacgaccgccagatatattagcatacctttttgcagaaaagaagaaagattgtcatcttttttagtcgcaaataaaaggggttctcggctagtggaaagtattttatgatcctagatgcatatgcacagataggctcctcttcatttgtacacagttttagacaaggagcgtgcatccatgcttcattttattttttctcgtcgaaagctattcatatggagtatggaaaccaatcctctgtaatattatcctttaattttaagtgattgatatttgagccttacacatcaaagggtggatatcaagctggctcgggcttggactcggctcgttaggataatgagttagctcgactcggctcaagctagctcgcgagctctactaggcagagcaccatgccctatcttctccacgagcgcgcacgagtaggaggggctagtgggcagcgcaaatggatggcgagcgaaacaagaaggagaacgtcatggttggcagcaccagccgacctcaccgaagcaacaggctccacgacgcgcaaaagctcaccagtcttctgtcgaaacagggactcgtcatcctccgcatctcgtcgtcttggacgggaagaagaaggacaacagtcaacggatgacgatacatgcagcgcaggcgccacaacgtgatgggaagtagagcagagagctgccaaatccaagtggcggcgagagcgcacgcggcagcatgcgcatgtagtacaaccaggtcaaggccaatagagtacagtgaggggcggggcaacaagcacgagcctccaaaccaccagcggctgcggcaagtgctctagaccttcaccttgtttggctcatgagtagctcgcgagctagcttgagctggtttgttatctctaacgaactaattaaaacatgagctcagctcttcacaaaaatgaaacgagtcgactcaagcaagccagccacgatctgtccaacctacttacaaaatcgtgcccacatgtaagtcacccacattagatggcagccctgtaaagaaacccatccatggagtgtagatacccacatagaaaaatgaaaataaaacaactaaagtatcgaaaagaaaatctcaccgtggtgtactactaggagtactttataacaacctttgaacttgtttgaccgtgttactttacagctagttgcaattgtggttgggcgataactattagggtttaccaaaccgtttaaggtgggattattgccaccccatggtttggtggttaccgcaaggtatatcgtaatttcagaatctggtaaggttatcgcacatgataaacacgataaccgcacgattctatatataaactcggatagatagctataggacgagcaattattttttttcgtttgttgtgaccgtgcatccgcaacaatctctctcaaacacccccctccccccccccccaaaatatgttaagttaaaatatccaaataaaaaacaaaaacgatacgaagattggacatctggaatgaggatcaataatggcctattggcaggttggtctgtacacgtccagtcactgtacaataggtagatttggacatataccgttgcagtaccatgcgtattactactactactactacaaacgaaaaagaggcatgataagaaaaggtcagctatcaagttttaatccccgctgtaatcaagctgtgccgcaagagaaggaattctagaagcaccacacacaccctcggctttcctcgctgattggctgatggagaccacgacgagacggatcgacaattcgacactaacataagaggggtccaaaatcttaatccaccttgtgtacatatagttaactccatgtttgggcacagtggtgtcacccagcccccatcaccaatcgatcgacgggttatttcccaatcgcacttaacgtgacattgaagtcaatgatccccacggcgatcgattacgatcgctaaaccaatgcgattaccgagcgattaattaggtcctgatacatatattagtcactttttttcgattcagatatcccgtcctgccgtccatccgtctatccgagtcgatcgtagtactacatggctgtcgctatacacacagcaaattaatttcttacagatggtgcatggcatcgcttgtgtgcattgttgatgactagatgtgcgtggttgttcaacgtcacgtaggtttagtggtacgttggatcgtgctaaaactcttctcgcttgcttgcttaattagttgccgacttgctgtgtgacctgacggtattttcagtcggtgaatggagatatggagttggacggatgcgacgatcgatggatggaacgaggcatgcacgtgacacgtcgtcgttaaggtgagcctttgtcacacgatctcctgctagcgcatctcggctcgctcgctcgacgtctcggctgatcagtccgacccgatcgacgttcgtgcgcgcggcaaacgccaacaccgttgatttcgcctggtgtacgtgcgggtgagctgtgcatgcaccgcactgcaggcgacacgaatgtatggctcgagtgatagggcggctcgctatctagcttacggccttccgcgacctcgatcgtgccgacactcccgcggccgggcggcgaacgccgccgatccttgtgagtgcgccatgcggggcctgcaccaccgtcgacatattgggcattggccgattggcgttccacgctctcccccgcccctatagctatctttgtttcctaggtgtggaatatcgcacagcagcgtgcgaaagcaaccgcgccatggatcgatccgtagttcggtacgtacgtatagtagcggcactgcggcagtagtgctagtgtgatgacggcaggattgtggcacacgatcaaaagcaagcagctcccctgaagacctgaatcctgaaaccctgatgcggagagaccacgtaccggccgctgggccgggccgcgtatgtccatccagtggattggtcagtaactcagtatagcagcctcacaggttttgtttacgatttcttttcggatttgcaaattgcaatttcacttgtgacagatttttcgcgcttttttctaatacacagtacacacgaatttagatgctcatatacatgtatgtacaccctaccactatgagccactttaaaaactgggccaatatatcttacgattaacaaagttatcacaggtatctgattgccgatggatatatctaatatcactaaaaaaactattactcgtgaatgtgtgcactcgtgtcaagtctaaaacttaaatgattttactacacatttgtcgacaaattacgttgtataacatatgtaggagtaagttataatgtagttatactacgatcatactatatctatatttggtaattttttaagaaaaaatttattgacaaatgtatagatagtccctaaaccttataccaaaagaaaaggtagcctaaaccttatactaaaagaaaaggtaagccaagacaaaatattgacaaagttagatgtttggttgtcaagattttggtacacagttcctttgtttgtttcagatgtaacgcaccagtgcttgggcaagtcctgcttcacttgagatcagatatattttggtctaaaaggtgaaaatagtatggaattcccccggctatcctgaacattttcccccttttgtactgaccatttacttggaattggaattgacggaagcataaatgtgatctggtgaggcttttttaacggccgtttggttaggaggagtttttacgaaggattgagagtttagagggatgggaatattaactgttttattttggttgggagacataagaattttggtgggatggagacggagaattaagaaactccctcattttcaatatctaggtagggagtggtaatcgggaggaaattcctcctttacttttcttaaacaaatctcaattatccgttttcattaataacctaatctccaactaaactccttatcaatttccatcagctctaccaaacaaactattaggattaaaaattaaattctcatcttaatcaatctcacatcaatttcctcatgtaaactctcaatcccctgcttcaagttgccaaacaagccgtaatagtttcgccggtgtaccgttttcataagttttttttggcaaaaactactatattgtactggcaacccagcacaaacaatcctttattaaatcaaaccctaatcaacccctgacccttatgtgttactagtgtgttgaatgctatggcatcctcagtagtatttattagttgtgctttgaatcttcacgacttcaccaagtaatttgtaaagtatttatggcttcatttgcttgacagttgacactatggtgccatgttttcgatatattctatatcgttttcttactataccattttatccgttttttcaagaaaaaagtataggttgtgtttagttccccgtcaaaattagaagtttgaagaatttggaacgatgtgacaaaaaagttggaagtttgtgtgtagaaaaatttgctgtgacggtaaaattgaaagtttaaagaaaaaagttagaatctaaacaaggccatagtcgagaaatggtttgagcaatttccaaacattttgacccctattttggccacagttctacgatttgttttctattgatacagaagggtactacagtgtggcaaaaaacacgctcacacacacacaaaaagaaaaagaaaaaggcagaatatgcttttgtggacatgtcaggaaggttcctggcagagaagttaacatcagaagagggtcatgaacaaatcttccctgggaagcaggtggcatgcaagattttacgtccacctttaggtcccttcaatttgtagaaaaaatgtagaaaatttaaaggattttaattttatagaaaaatttcctatgaaaccctttgaaacaaaggattgaatcctatactatcctttaaaattcctatggaataggtaattctatagaaattttggaggaaagttagcaagaggtccaacctcttggaaaaattcctttgagtctatttctctcatccgattcttgtgttttttctgtggtccaatcaaacgatcattcctgtgtttttcctgtatttttcaatcatctgttttacacctacattcctgtcagaatcctgcgttttttctattcctatgcttttacattcctacgattcaaaggggtccttacaatattgtgcaatctccggtgtgctacgtatattggaaagttgtcataggattattaaaggtgcagtgcagccgtatcattttcactgaggtaataatgcctactacagttgagatgatctcacacacacaaaaagaaaatgtcatatcgtttgaaaaacgagggatatcaaaagggatggccagacaccgatgatatctgggctgcaaaatcaaaatgtaagagaacgggacacatctccagctaaacatgacaacggagcaaaactgcacctttgtttagttctaaactttttttttccaaacttttaattttttcatcacatcaaaatttttctacacacaaacttccaacttttccgtcacatcgtttcaatttcaaccaaactttcaattttagcgtgacctaacacacgactagttttttttttattttttttagataagggtattttttttacccggcctctacatccaaccggatatatacagccattgaaatagggaacttagccactgaaacaatctaatctgaaattcgctacatagaagatttgaactagggaacttagccactgaaacaatctaatctgaaattcgctacatagaagatttgaactcaggaccttggtgcactactcaggtcactgtaaccact

SEQ ID NO: 69550 - DNA, 1263 bp, Oryza sativa
ttcatatcatagcacagtccataattaatgccatagtgaagggactttttaatcctggtattttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatatatctatgatctctcttattaaatcaatcaatcaagactaacgcgcgtcaaccgtagcggccatgcacctcttacccgacgacgtcctccgccacctgccgcgacgcagcctcgctgcctcacgctgcgtctgtcagtcctggcgcgtcatcatagacgaccgctccctgctcgccacggccgcgctcctcccctgcacgctccgcggcatcttcgtccagatcggcgtgccaactctgagcggcttcttcgcccgcccctcgccggcggggacgaggaggccacccatccccggcgtccttgacctagactacctcgacaccaatcaaatcgaaaaatcccttctcaccataatcgaccactgcaacggcctcatcctgctcgaccaccacgtcgtcaacccagccacgcgccaatggacgcgccttctcccttactcgccgccggagtcgtcgccgccgggcagcgaaatcatcctcgacggctatcacgccctcgtctttgaccctcatcgtgtcgccgccgcactaccagttgttcttgatgccctacgtcctcggacgacgagccacggtgttttctccatgtcttcgccaatttgaaagttttcaaatcttgaattgaaagttttaaaattttgtgttgaaagttttcaaatttaagttgaaagtttttaaattttgagttgaaagttttaaattttgacttgaaagttttcaaatttgagttgaaagctttcaaatctggattgaaaattttaaatttgagttgaaagtttttcaaatttgagatgaaatattgaaagttttcaaattttaacttcaaaaattcaaatttcgagttgaaagttttccattttgtgttaaaagttttcaaatttgagttgaaagttttcaaatctgcgttgaaagttttcaaatatagggtgaaagttaattttcaaaatttgacttgacgtatatatattttttaacctgttacttaaaagatcgtgaaaaaattcatccgtgcttgattaagagaaaacacgaaaaaa

SEQ ID NO: 69551 - DNA, 10710 bp, Oryza sativa
  unsure (1)..(10710): unsure at all n locations
aagcactactttcaggctcacaaagtcatagtgccatcacagtaccccttgggcgaaatactccgaggcaaggaggtcactggccggcttagcaagtgggcggcagagctatctccgttcgacctgcatttcattgcacgctttgctatcaagtctcaagtgctagctgacttcgtagctgaatggacaccggcacttgccaccgaccgcgagcccaccgaacagttctaggtgatgtgctctgacggctcgtggtcgcacaggagagcaggcattgcggcagccctcttttcgccgaatggtgtgccgattcggtacgcagcaagactgcagttcgacacaaccaacaacgcgacagaatacgaagccgttctcctgggcctaagaaaggcgaaagcactgggagtccagcgcttgctaattcgaaccgattccaagttggtagcgggccatgttgacaaatccttcgaggcaaaagaagaacgaatgaagaggtatctggaggctgttcggtccatggaaaaatgcttcaccggcataacggtcgaacacttacctagaggtcagaacgaggaagcagatgccttggtgaaatccgctgcttgtggtggcccatattcgcctggcgtctttttcgaagtcctacagctcggaagtcatggcaatcgaccagcagaaactgggcgaagacccatatgactagcgaaccccatttgtgaaacaccttgaaactgactggcttctggtagacgaagcagaagcaaagcgtttgcaactcagagccacgaagtataagatggtctcgggtcagctttaccgctccggggtgcttcaacccttgcttcgttgcatatcttttgccgaaggcgaagaaatggcaaaagagatacaccaggggctatgtggtgcgcaccaggctgcaagaacagtggcctccaaagtattcagacaaggagtttattggcccactgtgttgagagtctgcgttgagcaaatcaagaagtgtgaaagttgccagcgtcatggctgaagccagaccgcaccccagtatgatctgcagcccattgcgccaatatggcccttccccagatggggtctagacatcatcgggccgttcccggtggcgcgaaacgggtataaattcgcaattgtatctgtggaatatttctctggatggattgaagccgaaccccttggggcaatcacttcggcagcagtacagaagtttgtatggaaaaacattgtttgccgtttcggagtgccaaaagagttcattcctgacaacggcaagcagtttgactccgataagttcagagaaatgtgcgaagggcttaacctggaaatcaggttcgcgtcggtcgcgcacccgcaatcaaatggggcggccgaacgtacaaatggcaagatcctagaagcactaaagaaaagacttgagggggcagcgaaaggcaaatggccagaagaattgctatcggttctctgggccctctggacgacccccacaagaccaagtttagcccgtttatgcttctttatggcgatgaggcaatgaccccagcagagctaggggctaactcaccaagggtgatgttctctgggggcgaagaggggcgcgaagtatcgctcgaactcttggaaggggtaagattcgaagcgctcgagcacatgcacaagtacgccacaagcacttcggtaacttacaacaaaaaagttcgacccacagtgctgatgcctggtcatctcatcctaaggaagaaggcgaacccagtagcggttggcaagcttgaatcaaagtgggaaggaccataccttatcaaacacaagtccaggacgggatcttttcgcctagcgacactagaaggcgaggagttcgaccattcctggaacgccgcctctctcaagcgcttctatgtctagaatgggtggcacccaaatcgccaaacttgtaaaaatgtacataccgtcatgtaagcccttcggcactatgtaagcctttcgacaaaaaaaataaaaaaaataactggatgtagggctattatccaccatggaggcccgaaccagtataaaatctctgtgtcctccgccttctttctaattttcgtgtgattgacaatttgtggaaaaaccccaaggcaaacgcctgatcagcgaaaaaggcaggagggcgaaacgaatcggccgaagcatcgctcgccgaacgttgaaaccgcaacagcttgtctcggaaaataactagccgaacgacgttacgttcgatcgacataaaagcaaaagcgtttctttcagcacagaatgctacagatcgaaaacaaacgacaaaaagctgaaaagtcagtacacctatttcgctaatatacgcaaaggggccgacatgttccgacctaacaaaagcacgaaatgtgacgatgcgaaagaatagcgaaaaggaaataaaacacatctttattaacttcgaaaaaataatcgaagaatagaaggttcacaacatgatacaattcaccttacaagtaaattacatcttcgcccccataatcactatccctccctaaggaatggtcaggcgaactaggttcgtcttcactactaatatcatacacaaccttaagaggagtagggggcgaaacacagactaaactgtaacgacgctgaaagatcgtttcctgacgtttagtcttctgatggtttcgccaaaagcgagccatatcctccaaacgtcttgaatgaacaagatcgtaatcttctaaggttcgcccggggtgcgcccgcagccagtcggcaaccttgaaaaccttgtagctgcgaccgtttatctccatttcgcgataaacaggccgaaatggacatcgcaccttcggcagacccttcaatgccacaaatttctcgttttgacttcgccagctccctgaagggggccgaatgcacgactttcggtgaaccccctagtagacagtgcagaaaaggcaaaacacagtttacatagtaagaataggcgaaggaaagggaaggtgtggcataatgcgaaatggacaagataataatacgccaaagacttcgaccatccaaaagtggctaagattgtcatacattccaaagtataccaaaggccttcttcggctacaataaggagggttaccgacggcctgccaaatatacatcatttgcctctccaggcaaatgcaaaaaagaggaaggaaaactacaaaaatctaaggaaagggcggagggcctcacacctctgggtgatcctgggcattgcctccaccctcttcgcacgctgcgtcctctccttcgccccggtctgccgcctccgccttcgccagttgctccagaaggcgcgccttggcagcggaccggccgtccttctgccaaaattgtattcgccacgcacgaagagcgggtgaaatgttctgtgcactaatctcccagtcccccttcgcataggtagggaactcggcgacatgctcgcagccgaactgttgcaaaaggcataaggtgaaggccgccgatacacgcgcacaacaatcaccgtacgcggtggcgcagttcgaaaccgatccgccagcctactgggtccactcggagaagtcgaaggctgaggcatccttggaaggaaccccccgcaccttcgtgcccatgtcggtaagggcaaggcggagcgtttggcaagccgttctcgcagattcggcggtcttcgccatctcccgcaaaaaccgctgcgactcctccacggcgctcgcttcggccctgctagccttcaggcgaagagcctccatcttcggctcagtaaggttatagtaatcaaccagcactgccgaatgggctttctccttctccagttcggccttgaggcgatcaacctcggccctagcctctttccccttatccagttcggactgaaggcgttcgacttcagctttcgcctccttgagggtttggccagggcctccacctccaagttcttgcggcttatttcgtcgtccttggcccgaagacggctcttaaaaccatcaaaacgggcccgcacggttcgctccgtcgaacagtgagccgcaagaatctagaggaaagataggagcgggcgaaaagaacaaaaggttaattgtgagacgtaaaaaaaagggggatgaagaggaaagcgaagaaggaagaaaaagcgtacccgaactgccaagcttttaatggcagaacacccctcatcgaactcatttagttcggtgaacaggctcggggtgccagcgggcaagacaaggttgctcactccctccacaaagggaacaaggtccgcccgagtctcgaaatcaccaggggcgaagtggggcgccgcaagggaatattccgaggcagatgcttcggcgcccgcacacttccctttcgccttgactaatggcgaaatagctagctcacgcagagggctcccgaaaaccctcgccacagccgacacgatccgttcagcggaggctgaagccccggccgcgatgctaccgcctgccccagcaacaccgagcggaacaaggggagcagttgaaaggtccaaactgcggccagcgggcgaagtcggagtcccgtcagaagactcgtcgtcgctgaaaatgcgggcgatgtcgacgagttctttctttttagagatcttcttcaccggacctccttcgcctccttgcccgaggagaacgcaactagagccttcgctccttccaaatccgtccgtcgaagaggggagctgttcgactccaccccggtctcgttgtgacctggacttggggtaggagtgtagccgggggtgtcgatgcggtcttcgaccgcctcgttcgcggccttatcggccacaacctcctcctcttcctcctctccttcctcctcgccgtcgcgttcttcggcatcgtcctcgtcgtcggcatcggagtccgacgaagcaggagcccttcgtttcctaggggcaagcttcacttgtccgcgcattcgcttccgtgaaggccctgcatcatcaccggaattgtgggggtttgcccgaggaggcaattcgccgttataaacccagttcgcccgcccagccgcttgtcgtgttagcagctagctatactcgacgaccgacacgtcgccgatcatcctgcgggcttcggtttcagcctggtcaagggtcaacactgcaaaagtagagtgtgaagctatgtcaaaagtcagataaggtgaaataacaaagcacagcagtatatagcaaaagaacagtcttactgttcgccccctcaggaagtatcaggttcggcaaaccgtcgacctcttcgccttgatcaaccgtgacttgccatgactgggagaggggaaagatgcgaagcatacagaattcctccaccaagtcatggcagctaatgtgggagcaaaccttgcgcagcagaacgaaccgcgcctccatagcaccgtccacggcgatcttgggtttccggttcggcgcgatcgccctacgccagcaccggagggctttcgccgggtcagaaccagcctcgaaggggatggtgtgatagaaccacctagctatccaatggcggtcccacttcgacatggcagcgttcaccggccagagatcggaccgctcgggacgaacgttaaagttcacgctcctgaacactgtcttcttcgttccggccggggtaatcaccgcttcgagttcacggtggcgaaaatatggcgccgaagagctcggcgttaggctcaaacccggaagtccggcacgcccagtcgaagatagagatccgaactagcaccgacgagctcagctgcggaagttccacatggaagaggcgaaggatctccggcaacaacacgttgcacggaaaccgtagccttgcctcaaaaaagacggcgaacaccaccgtccgattgtcgacaggttttggcactacggctttccctggggcgaaagcctgcccctcaaccaacgccccagagttgacctacttcgccagctcgacgtcgtccgcgagagaaacccccaaaaaggcggtgttgtcgtcatcgactcggccgggatccggccctttcgccgaagcagggtttggtttgcgaggggccatggtgatcggtgcgtttgcagcggcgaagtaagagaatgggcgaaacgcttgaggggtcaagagatgctgtggaagaaagaaacggaggaagagagtgcacgcggtaaaatggcaagtgtggcggtgaaaaggaaagagcggtgggaatatatagctcaccgggcgaccgttcgcctacccaccagtaataaagcgccacgtgtcgcaaaggtaggcgaaacggtaaatttccatcgtccgagcggcacagtaaaaaagtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccatcacacacaaagacaaacgggaaacagcggaagactagggcgaccaccacaggcgcttgacggcaggcacgagctagacaccaaagccttcatcttccaggggctcctcttctgggtttgggaaaaaaattgagcaagactgagtacaaccaccgtactcaacaagacacatccacaagtgcaggataaatgcaagggagtacaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagtagcaggacaccggccctgtgccatgacatctcgactaccgggccgcagctcgtgtagccttcatttgtcctagagatgtccatcgacccctgcttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccaaattgtccaggtgatgagaatattcccaaagtctagagttgtaaaaccacctaatgttgcctaattaaccagcgaagcatctacctaaaatcatactagtggtaccatgagtagagtgtccactagttggggttttgtttagtctagggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcggcgtctacacgaccaacggaaaagaaaatgcttttactctaataaactccatataacaagctggaacaaagcacaaaaatgggttcttgacttcttaaggaaaaattagagacttgaacggtccaattccgagttcaaatggccaagttatggtcatttgaagtttatatgctctttaaatgaataattgtgaatttcttcatttaaattttaattttaaaagggcttattgcgtcagccgaggggagggggcgcgcggaccgggtccacgggagtggggcccacgcggcagccttacggtccacggtggaccgggtgcacccgggctcacaccgaccggcgccgtgggtcccacgcatcagtcgcacccgcgggcgcgggcagctgacggccgagccccacgcggcagccactcggcgcgcccgagggcggccaagccagcgcagccggcgggaggcggcgcccgcgcccctatggtcgccggcggcggccataggcacggcggagcggcggccgagagaggggaagggaagggggaaaagaagcggcggtccacggctcaccctaggtcgacggcgacgacgaaaaaggcagccggagcggaggaaggcggcggcgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggtccggagctcgacggcgacggcggatagagagagcgacagcgcgagctcgattccggcgaggaggaatggcggcgagaggcggaaacggacggacgaggtgcggngagggtttaaatacggttgaaaggcggagagagcggtcggcggggaaggaataggcgcgggaggtccggccgccatcaatggcgccggcgatatttgcgggggcaaatccgcccgtttgaacgcgagagagagagagggaaaaatgggggaaaagggagaggggatcacggggagtgatttccccctctttatgccacgcggagacggncgggaggctggcgggattcgcggcggcggcggcgctagggcgcgggcgaggcggcgggagcggcgggaggaaggggatgacgggtgggccccacccgtcagcgagggtggcgggcgggcctgcccgtcagcggtgcgcgcgcggggagaggccggatgggccgcggggagaggagagggagggggagggagatgggccgagccggcccaagagggagagggagggaaaggggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttggggcgtgacaaaaagcccgcgaaggtaaagcccaatactgttcctttcggcccgggaaaagaaaatatataaaaaatatataatatatatatatatatatatatgtatatatatatatatatatatatatatgaatattccaccaatcgcaggaggtgaagcgcggcaaaataataccagccgcacaaataacaaacttcattcgcaggaataaggttggtttcggcaggagcatcggtcgaaagggggcgccgcataccataccacatggtttgcatggtctcggccgaagctccaatctcacccttgcccgtgaggggcttgttggcggatgacatgaggcccttcgaccaaatctgccgaaacccgtggcgaaaactatggaacaagaacggtgtgaggcgaagagtcgtacgagtgctttgccaggccagaggcgtctcaggcgaagagtgcaaggcgaagactatctgccgaaggaagacgacttcgccatggcaagttcgcctccccccccgagggccgaagaagcctttccggcccatcaagcctaggggctatagggccggtgattgcctgacggcccatcaggggcccatgagcccctataacattatgtacccctgtaaatgtccctttcgtaagggtaatcatgtaaattcccctgtataacctaaaccctagtagtaagaacctgtaatggggctataaatagccccctagggccatgtaacggggggatcccgagtgaaattcaaaatttaatacacttcgtttttccaaccactgttgagtaaccacgtctttcgacgtatgtggttgtcgtttcgacaacagtaccattttatcaaccggcaccacggaagcagcattggtaaggaacctcatctgtaccagattgacaaccggcacgaataaaaacgcgacacatgaaaaaaaatcgggtcgatgaatcggctaccgatcacactactagaaaaagcatttttcccgacgtggggggtctttttttcgcaagcggacatgactctttgagccaaacgaccacctacaaaaatataaatctggttgaagttcgttgtccgcctgcaaaaatctatttttgcatacggactcctgcgaaaatcgtacctacccaaaaaaaatctaagtccttatcttctcttcccaccccctccccaccactccttatcctctcaactctctctctctctccctcaacacttctctccccatgccggtccg

SEQ ID NO: 69552 - DNA, 50278 bp, Oryza sativa
tttaacgagtgggctagagtccttactggggctatttagatatgtgaccacataaggaaaaagtcaacttttcatcccaactcctaaaaccagggtaagtcacctgataattttaagatgggtttgtttgacgtggtacatacggggcttggtttgactaagtctttattttacgtgggccctatgcggcaatagggagcgaaatagaatttaacccatatatggggcccccttctaatgatgctgccgctggtatttgtcaggtccgctatcctcgctggccctaaagagagaaagggtatagagaggagccacatttcatgtgggcccattatattttattattattaataatgtgtgactgacatatggatccccttgatattttttattgtagttttggatagtattttttatcaaagttttcacataaagctaggtatgtttacctcttcagcactttggatcaccttctccatctctttcttctccacctccagctccaccctctcccactggagcttgattgataaggcaccggcaagctcctcttcccccacaccagtgaactcctcctcagttcggacgagattcaccgtctagttagaatgaagcaggggcaaaagaggtggaggtggtggtgatgggagagccggaggtggagaagagagagatgaaagggtggtccatagtgcaaaataggtacacatatctagtcttatgtgaaaactttggattgggggcaattcactctatttttttttcctctaatgccaagtacacaccaaggggcaaagactaatcaatacaccacatgtatgctatgtaggatgaaaacattgtttaaaccgtctagtgattctatatgtactgattttggtaattaggggatgccatatagcccgttttataattaagagacgcaaataaaacttgatctgtaggtgagggatataaagcacaccttttcctccacagaaagttccaaagacaactagactacattcaatccgatagtagtgctttctatacatcgtcaggttgtagtgagaaacataatcctagcttgcttaagggtttatcaaaagcttgactctacataaactagcaaacaattggagaatggagaatgcgcactattgctaaagagtgccatttttccttactaggagcctgtgacgacatttttcattttacaaacttcctaagagccaactgcaggctccaaatcatctatagctaatctaatagtccattcatacaatagttaactataaaaatataatacaccattaatacctggtcccacctctcatacacacataacgctttggagtctgtgttacagttggctataaatctacagctcggtttcttctctttcttctcttttcttctcgattagtgaaattttcaccattcccaacataatgagcttgagccgcacggtctatatataggtgcttttatcgtgctatttagaggacggtcggactatcttttttttagctaagttgaaagcaaattttaaattttattagaattagttatggaattaatttaagtattttctcgttttattcgttgcttatttttcctgcatagctaagtcgtccttagaaaaaacgaaagcatgcattactcttttctttttctttttcattgtttttcagtatttacttttacatctataagaacacgtatataaaagttttattcacaaattatttttcatttgcaaatatgccgtttggcttattccgcagataagccaaatgatggggctcataatacaccctacggcctatgtacctttttaataggcgatggccgatggggcggatggggagttcccatcttgctattctacccactaccgggatctcgtcccagactacgggcatgtttggaggtgcttctagctgctgcaacttctctcataatctctagctccccaaacaattcagattgtcacccagattataagaatatatagttatagaatccagaaaataaactagaatccagaaactgaaaaacccagcttctccaaattcgcagaagctgactcataatcttaagcttcttaagctcctccaaagagggcatacgccagtgccaggccaccgaacgaaatgatcccacgaccgtgccgagacaaccgctaattttcttccctggacccaccgcgtgcggcaacccacgctccaccaccacagcggggctctacccgagaggctgtgcccatcggcacgccaaccccgtcaccccgttgacacgcgcgcagcacacacatcccccttttccgcggccagccaagctagccccagcggcgcaagccaacacgtacgcctgcggcctgcctctgcctctgcctcgctcggcagggtcgctggcaccgggcagcgcagcgcagcgcacgccgcatagcgccaaccgcccgagcggcccaccccccacacccgcccggcgcgcggcacgcgcagaccagcagtgcatgcgcatgacgaaacgtttcaccgcagcgtcgccgaccgcaccgggcaagtacgctggaccatgcatgcacgcacaggcacggagtgagaataaattcaagggatatataaaaaaggcccagcgtgacagcgcccacgtccttcggtgagacagattgcagcttgaattttgccatggtagatcgatcgatcgaaaaaagaatttgcattacttaaaatggccagttaaattacctcccctctacccgaaaactgaaactttttatctggtacgtatttctcgatcttacacaaaaatactcctatgtatacgcttcccggaccaatacggcttcattcccatttcctctcccctccagccatgccctcctctttcgcgtgcgtgcgagcaggcgtcacgatcggtggatacaccaggctgctctgaggtgatcaacgtggacacggggcctgcaaccgagaagaatgttcttgtcaattgtcaaggagatatgattgagttgtactattgatatacagggactgcaaaaagaaaaaaaggtttgcttgcttcaagttttcaacacagcattataggataacacaagcactgaaataggccacacaagtacactgaggcagctctgaagttatactattactgatgaaacaaacacatgcacacggccaagaagttcaggccaattgcatgcatgcatgctgcaaattgcaaaaccgactaatgagtagataacctgcttacctacaggactacattcacattttaccattttaccgaggactcgtgtgtttgaattacaattaaagtataaattttgtctaaacacaatttacagatgaaaatgaatgtactacatctttgatcctttgtagattgtatgggagccagggtttcacttatcgcacgataatcgcgcgacaaaaatcatggatgtagttcttgatttgtaattgccaatggtgaagaatttttttgaaatagagtaagctaaattcaaatttgagggcacaggcaaaaatagtttacaaattggaaaaaagaagagaatattgggctacatattcttccaattattctcaatttatagttttgtacacatattcaaccgtattgttgattttttttccctatttattttacatttacatgattttagctacacagcccgcgataaccgtgcgaatatcgcggtaaaccgtgcgattatcgcggtgaaaccgtgataccggtgagttttgaattcgaatttttggatgtgatttttgtgcgattttaggtgattatcgcgctatcgcggggtggcgataaccccggcccaaacgataaggtaaacctgatgggagcacggattactgcctgagcaaagaaattacggagctagaaaactgttttcatgcatcaacaacaaaagcaatcacatgttgcatttattttaacataaacaaatatcttctctagcaagtactatcaaatacaaaaaaagtaaagacgaaatttgtagatctcaaaaaataaggggcgttttggtttgataccaaaatattgtcataccaattttttggtggtttaaatagcaaatgtgatgatttgatttgaagccaaatgtttggtaatgccaatactcaatttggcacaattctaaaatattcttcaccacaatttaaaatttggttctcaattggcataaatccaaatgcactcatttacaattttaccctaccaaagtattagtagtgccaaaacttggctagagtttggcactaccaacatattggtagagtactaaaccaaacaagccctaaatgcagacaaacatggcattctttttgttaatatcttatttataaatcacctggggctcttagcaaaagccaaaaattagaaaaagaaactaagggcaaaaattgattgcttataagaaagttggtgacacctgtacaaacatggaggcccataaatagagcatgcagatcacgtacacgaaaaaaaagtaaaaagacaattggttgacatcaggaccaaaagggtccacacaaacctgcaagtttgtactgctgtcatccaattcaatgctagatactacatccgtcccaaaataagtgcagttttacactgttcacgtccaacgtttgatcgctcgtcttattgaatttttctatgattagtatttttgttgttagtagatgataaaatataaatagtattttatgtgtaactaacttttttaaattttttcataattttttcaaataatacggatggtcaaaccttcgacacggattcctacggctgcacttattttgggagggaggtagtaccaaacaaaaatgatggacataagcaatggcagattggcatgttctggacttttgcattgagacatgcaaacaatttcagaattgttaacgaagtttgtagtttgtaccactgaaattaaatttataaagaacacatttgtgatgtggagagtggtttaatgggttctaaacataaccaatagaattgcaagagtatagagtgaccctataaactgatcagtgacagtgcccacatactttactccgcagtagaagtaatgggagttgatcatcaaaccagtgggccaaaagagaaaacaattactctatgttaaagctattcaaaactgtagcacttgtcttagaattgcatcaaattatgcaggcattcaggatcaaccacccaaaagcttaccttggcatgggacaataacattcattagcagacattactaatcaactgcttaagatgacctacagaacagtattcagttttcaaggataaaccagtcatctttaaataaaaatgaagcacctcttcagggcatattactgatgaaagccattatatagttattctagaatcacgacctaactctcccaagattcggcatctaatctaagacaattgtttaacaaagtaccgaagcttttctcatcttttgagagaaagaaaagtaacatgaagcatgatatctacttaaaaaatcatagccacgagatcagggcatcaggcacttatttgggcgcacaatgaacacgcagtagttatgggatggcaggcagctcacccataaaatctatgaagtactagtgccggcccaaccaaatctacgtccaccaaaccgcaactatgggattaccattggactattgaagcctgatcaaagatgataaatactaaatagtacgtagtcatcaccttaaaatatactactagctcacgttatgaaaaattactcacaaattaactggatctaagtatctagcagcctagtagccagatatatataactcttgtctaatgtagtatttcttaaaaccattctggaaaaggcaaatttggccctctgcatggccatgtagtagcaaaaacaccattcattttgcgtgcatatatcatatatgtaccacgagtccataactagcttagtagatttgttgtagaccagtgaccgtagcttaaagccttaaaccttgaaaacaagaacaatcgaccatgattttgtattgcctcctacacaacctgaaccttgaaagaaaaactatctagcaccatgcctttgcagaactcttactacctagctcttactacctctatctctcaaagaaaacttcttgttacctcacaccatgaacaactcaacaaactttaagaacagcaaaagagcaagaaaccgagtgcaatgcggtagcatgggaatcaatcaagcagctgctcaccttcccctccgagtccacctcgcgctccttaggaggccatggaggccttggggaagcctggccgaccccatccgcggccatttactcggttggccctcgacgtcctcccgcttgcttgagctgtgtgtgtgagctgagagaagctagggagcaagcaaggaaggaaggcctatgtgtctccgaaaggaaggggaagctgagagttaaaaccaagcaaagaaaagggcagtctactcttgtgctgggctcggagagagagagagagagagagagagagagagagagagagaagggagcgtgcagtgtgcagaggcagcaggggcaaaaggaaaggagggagcaaatgagcaatggctgtcagctattttttctgcttttttctcgagtccgcacagcgctcgctgctcatagtcactgccaccgcaacgcgtgcccccacacacatccgcatactagtctacagttcatctctcatctccattttcttttttttcctcaactcccttctctcactgcaagtgggccacggcacatgttaggacttcggaccacctgccagtcaccgagggttttctgttaagcacttaggccatgttcaacgctccacgctttagcgtggtctgaccgctcccgaggggaatcttcaatcgggaccgcaccctcgcctagcgccgcgactctctgcagagcgtcgggtgatttcggcagcttttcggcgaggaatgggcgaggagccgcgttgggggagaggtgtcgccccgcgccgttgctactcccgcgctaggaagaagatggagagagggtcgactggagagaagggaagaagatgcgtcaatcccagccgctgccgcgtcgatccgcggccgcgggcgtcgatctaccgcctttgcctccatccggtgccgtggcgcctcgatccgccaccaccgcggcttcatccgcacctgtcgctgctcgatccgccgtctccgccttcatccggcgccgccgcgcctcgatccaccgccgccacctccatccgttgccgccaccgcgcgatccgccacttccgcctcgatccggtgccaccgccgctcgatccgccgcctccgcctcgatccggcggtggggagagaggcgccgccgccagagaggggaggagatgcggcggtggcgaagggagagtcggagagggaggagacgccagggagagaggactcaggaggggttgatgtatatatatctttgtgatttttagtgggtatactgcaaatattggatgtatatgcaaataataataatctaagggtttaaatgtaaaatgtaacggactgataggtgctaaaacgcaaaaatactatgggggtatggcttgcactatgtgaggtatatccctaactggatgcttggtcacttttgctcatgtggatagtggaggtgcaccctgcattgggcatgctcttaagccccgtttggaaacggaaacaagctgattcacgtaaaaagatttgtacgaaaattccgtaatagttataacatttcaaacggtactcgcagtgactttttcatcctctggtaacagtagctaacaagggagtggatggtgagaattccatttcaccctggcatgggaattcctcgagctacgtgtgacctgatactgcatcgccgttcaaggctcgcagtgatcgacattttcctccccgtgcttttcagagttttaccgcggcaccgccggccttgccgaatatatgctctgctgctggcctgaagaaaggcttcatcatgcgcatgcatcgtctatcggctagctggctggccctgtggaagcgagtgatttctctccccgtctcggcctcgggtatgggttaatatcggcggcgtcgcgcgtgcgtgcgtgccgtgcatgcgatgcgatgcgacatcgtctttttattcgcggcgcggcgcgcggcttctctcacttctgtcgcgggcagcggcagcagggtttggctggcgcctctgctctcctgctcgttcgcctgctgcttttgctcgcttttatcgtgtgtctcaggaaacgggaaagtggcgggtcgggggactgggccgcggagggggaggaattcagagaggactgtgccggagcgaggtggcggcccgaatcccaagagattggcaaagatctggaggtgctttgtttaatgtacaaaaacgactctagtagcagcagtaatggctactactagctactagctaggttaccccttggggttccagtatccttccaggacaattaagccaaggctatctttagatctaaagtttggatccaaacttcagttcttttccatccatcaacctgtcatatacacataacttttcagtcacaccatctccaatttcaaccaaaatctaaattttacgctgaactaaacacagcccaaatcaatgttgttttgcagtgtgtctaggcaatgccacggttagagtaagaactaaggataattaatactcaaactatatggagtattacttatgtgaaagtgaatggggagcgtatcttatgtactcattcccttgcatgtacacaccatatacaccaactaaaaatcataaaaaaaatatagaaaaattcatatatatatatatatttttccaatagtattgcatctacgtgcaaagtcacatattcaaattcattctacgtagagagtaaaaaaaagataaaattctaacagaattacaaccttagaactgtcagattttttttcagctaaaatataataaatttgaggttaaaatttataccaaggtgtaatactattgaaagtacatgtatgattttttctagatctttttatgacatttattagttggtgtgcacgtgcgtacacgtgtgcgtaggatatgttgctaagaggaagataaagaaaaagattagtgttagctctcatgcaagagctagttcatgcttcaaaaatatgcattaaatttatagtgagatagagagaggaaaaaatatagagctaaattattatcctataatagatttatacttctttgtgtcctaaaatataagagattttgggtggatgtgatatatattatagtattacgaatctggttaataatcttgttagtattagaattgtcacattcacctaaaatcttttagattttgggacggtaggagttgtaagtagtaagctttactaataaaagcttagtcttagggctttgcttcttccgctgttgtttacagaggactgggcaccgatagaggagttgggtttgtttttgttaggatgtgggctggctctatttcctgctgggccgtactgatatactagttgctgggacttggagaatccattcaaatcacgactcgatcttactcaagtgaagtcattttcgtttcagcaatgattcccggggtatcaaaagcctatccaaactccaaaggcttgaaaacaaaacttagatctgacaaaagctgaagactcgatcaaactgtataccccacattcagttccgtttacactaatatatattacagtatttagtttagttggaatcagtatggtaatgtacatatgggatagtttaagagcaggtacgatgagtacaacatctacttctggagataagagcaagtatagtaagacctagtcagtaggctgaaccatttcccacgtcatcaaaatcctatatggcggagtgagaagagaagagagagaacggagcgggcggtcccgctatcgctcggctgaagcgtagtatacgagagaaaaacgcccgcttccagcccgatgagagcaggtataatagcaggctataagccagctataaatatattttaaagagataaaggaagagagggaagagcagcgggctacagatctgtagtcagctgcggcacggactccaagacgtaatgtgtgtatgacaggtaggaccaggtattaatagtatagtaagcaactattatataaattggctattacattggctatagatgatttggagctagtagttggctatactattaaacttgctctgagagcgctaagccgccgcttcgttcctctccctccgatcccgtgcatctctgccgccgcccccaacctcacttcctccgcgcgccaaatccccccacctcctactaaaatcgagtcctcccgctcaaatctgcaataaaaccctcccaaatccactcccatgccaccaaattcgtccccaaatcgcctactctcaaaccctagaccctaaatttgtcctcaaacctcatcaagatgaggcagcaatacaaaaggacgcttgcgccggcgtctctggaggtccctccgccagcgactttgcctgtcacgccggtggcgactcagcccttgacaccaccgccacctcagttcgtccttgccgccgtcctttttttccacctacatacctgatggctggttccccgcagtaacaccgcaatccattgtgacctcctcctcaccatgcttgctcgctgggttacgacaaccaggcatagtgagttcgtcggctcaaggccctgcattagtgcctctgcatatcctgccccaagtgctgagaatgccgagaatcccaatgttcaagcacgatatgatctagcccttaccgtctttatttttcttagtttgttaatcctgctcgaagtgtatgtatgattttgttgtgatatgtcctattgatctgttcaaggcttcacgtccatacatgtcaaactcaattcactgaatagctcctgttgtgtcatttatttagggggtatatggatcagattagctcccaaatccatcggatcatgctgacaatgctgcttgaaaacaatggtacctgggtataaagatgaacatgttgcttgaacatatgtggtatgcatgttactcgaaattaattaattatatgtttctatgtttgttatcaatatgatatcaatatgattgttatttcaagtgtgatatcaatatgattgttatttcataaatcttgatatattttcctgttataatcaccatgaaatgaatattttgtacccgtgttgtttcattcttttggtgactgtacgtatggctgagcatacttgtattttgtttgatgaaatagccacaaagatatagccacagcatatcatgtgcacatgcaggcacatgttaactaatagccaaacatacagccagtctattatataagtgaacttttaagtggaggttttagatgacatggtataagagcaggtacaatagcagactattagctagctgtaaatatattttaatgagataaaaggtgagagagaagaacagcaggctacagcgcggactccaagacgcaatgtgtgtattaatatctggtcccacctgtcatacacactttgtgttttggagtccgtgccgtagccggctacaaatctgtagcacactactcttctctctcctattttatccgcttaaaatatgtttatagctggtttatagtctgctattgtacctgctctcatacgccttcgtacgtcggttacagcgggatgagatccatgagagagagagcagcgtgggaggagtaggttcagtacggtatcgaggaatacccatattcatagagatcgagtgtcgtgattacatcatcagcaagttccgcgaggactttcccaccacctcaccttaaccgaggtccgcaaaggcgcttgttgatgaagtcacgctccttcagagcaagtataatagtaggctataagccggctaaatgctgatatggaggagagagaggagaagcgggctgtaaatttataaccggcttggacataagaaccaagaaactctatgagagagataagtgggtcatgtattaattataaagagctaactattattatatgggtagactaagagaagactataaagaaccttatagccaacagattggctgtattattagccttgctctcaaaaattgttcgccttcctcgactcatccggcctcagcaacttcttcgctccagcggcaaacgaaggcagaggacatcatggaggtgcatccgtgcatatagggctattgatgccgtgggtgtgggaatcatacatcatgaatgagaggaaagcttatgggcctgttcactctgatgtcattttcaatcttactaaattttgataaagttgtaaaaaaagtggctacatttagtttgctgccaaattttggtaactatataagaaatcctgtcaattttggtaactatgctgataaggtttttttttcatccaagtgaataggccctatgtattgacatgtttggtcaactggtagtgataattagtactattggcttgttaccgatgagtattagctgttaccgtactggcgtggtaccaatagtatcagatatggtactcagctgatatatcatacctccaaaacgagacaccgtgcaatatagcaacccgtaagttttatgagtataaagtttctataaaaaggaaagcagtgacactgtgtgcgtacaaaatgaaacgcgaaagggcgttcggttgatcaccgtgcgcgtgcacgtatgtgtgcatgcatctcaacacgtacacagtgcacacacgttaatatctactcctcgttcaggtgtacatgccggaaggttttccaaacctcaacatatcccatactacctgtctgacctgtcagcccagttaatgcacagagcaggcggtggaatacgtcgagcagccatgggccttgctgatcacttgaccggacccaatgcggcgggctccgtccacggggcgccggtggagcagacggcctgcgcccgcctacaaccccagctgggccaccactacagggcgccggcttctgctgatgctgaggcgggtaacgcccctgcggcgacggcggcgtgcgcgccggccggcgcaacgccgcgtccggcggcgatccttgggcagcttcgtcgtcctcaccgtcactactgcttccgtttaggtccaagtagtccaccataacctgcgtggtttcctctactgtgactgtggtaagtacagggagattttcataatcttgatcacctagagaacgggaaaccaaactgtcagtcttgtgagaaagtatagtagtgctatatgtagtgtcgaaataagacggccagagaagtgtaagtaccactagcaagtggtcgagcttcgaggagtaatggaatggccagaacgaacacgagagcaagattgaaagcaaccggtaaacacttcatggcctaagaggctaagaatatactattctctgcagcggctagaacgatctagtaaggcagctcgactcaaactctctgtgcccagctcgatcagaagcacgcttatatataactggcctctgacgcctctccccgaagggcaaaagtcccgatcgccgattcccactcaagatgccatcaacaaccctgtgaaacgaagcagagaagaagcgcattttgtgcatgcgcgttatattatgaccggtccgtaaaccaggaaacacgccagccacagaatcgtttactctctcaagtccaagttacgagtcaattctcaattcatcaggcaaaatttggccttttaatagtttttcttaaggcgttctgctcaggcgacaacagaagtgggcgactacctgccggggagtacgaagtagtacagtgtagtagagcctggccttatggccatgtgtccacatgcatgcttgctttgtaggagtattaatcaaaccaccgcgtggttgtggttgtcttcatgcactgtgtacgtcagacaaaaggaataatcgaaacacccccattgtctcgcttgggaaccttcttttcccttttctgactattgactccacacaaaaaaaaaaccatttctgcatgcatatcacgcacgattgagatgcgcgtagctaaacggcgattgctgggtagttactacattttttctaagacaatggaattgaatattccggttttttttcagcgagctacagtcaattattacaatgtaacaaacaagtgaaactcataaaaataaaaaaagacaccaatcatgaaaaaaaagcaaactaaagactaccaatccaagataaggagtatacaattattgaattttatttgtgaatctccatccaaaattggtaaacagttgtataaccgttgtctcgagattacgacatgcaacttttaaaaactcgccctcttcatcacccttttgtagctgtgcggttctaagccaatatgttgtctaaaaaatacctgcatatataaaatagatggtgatttgtcaaacatcatgtcattcatactcaaccaatagaacctaacataaacagatatttctataagaataagttttctatttttcttttccggtagttcctacatgccccctccgttccatattattaaatgttttgggtgtgtcatgtgtatttttcttaattaagcttagacaatcgtcgtagcaatatctatagcaccaacttagcttatttgaatcaaccgacgaatttatttttatagtacatttgttttatgttaaaaaccatattacatttttctataatgtaatcaaacttcttaacatacacggagatagctgtatgttgcttacgctttactttattgaagaaaaaaaagagtcatgctgtgcgttatatagattgtacaacccacgtacaatcataccgtatccaccaatcatcggttaggcttatctgcaggtgggctcgggcaagcagcaactgtgtttgtgcatgtagtactgatcggatgtaagtactccagtacatatggatcggatgtatagctatttctaaaaataaaatctacgcagttatgaatcacttagcagatgattactggaggggtcaatctttttttttcttaccaaagcactgtgggaagcccccgcagtaaaagaactttattaatgaaaggaaaaaaaatacaataagattatccaagtttataatacatcattttctacattatttcatctatgaagaagaaagagtatatccttttttaaaaagagttctcaaagaacggaggggccagtcttaaacaccccccccccccacccaaaaacaacatatgtttcaagctttgaattatttatttgtttgtttgacttaaaaatatgtgttttataaaagtatagaagtatactcctcctgcctttaagaggatggtttttaaaaattaccctactaaaggaaagggaagggctcatatttaatttttaatttggatttagttcctcaccgccggttttcattgctagaaaaacttgtaatgcttacttgaggttttcattggaggtcatttgaaatatagatatgtatgagattctattttaaaaaattgatttgagattttctaacgaatatttagcccctagataatcttaaatgaaaaggttgtcaactttaaggtacagaactcgtcgagatctacaagttttatataagtttgatttcaaatgaagtctacaaattgtaaaagtacggagatgataaacaatacgggaaaaattgcttttactaccttcccatcctcagaggaggatgggaaataagcttaaagggaaatatcacatagtaaagtgggaagacatggcatttcctaaagattttagtggcctgggtttcacagaaacaaggaaaatgaacattgctctcctggccaaatggatcataaagattgaatcagatgataagagcttgtgtattgagttgttaaggaggaaatatctagtccatggaggtttctttcaacacaagggtggaaatgtgtcccaattttggagaggtcttcttaatatcaagaggtggatgagttttggctctgaatgggttttgggtaatggtgagagtatcagcttctggcaggatgtctggtggggcacctgtcctttaaaaactcttttccctgctatctttaggatctgtaatcagcaagagctgttactcagccatctcaatcaggagggtcctgactgccttacattcaggagatcctttggcccggaagaaatcctagagtggggagacctgaaagaaattatcgaacaaattgaggtttctgattcacatgataagttggtgtgggacgaggaaggtgaggcaggagagcaacgggccgggaaagttcaagttggtcctcggcgtcgacacggatgccgacggccgccacccctaccgctgccagtcggatgcctcaaggtgcgcacgacacctgggctcgctgtcggtgccgctgctgagttggttgctgatatgtggggcccgtgtggttccaacgttgacttagcatagctgaccgagtacacgtcaaacaaaactaggaaacatattgtcttgggataaaagttgacacggttttgtgagttaagagatgagctatacctggtatcgtggtttaggaacaaatttcagactaagcaacaacttaatggacctaaagtgaacttagaaaacagcgtggaatacaatgaggccacatgcggcctattgggccactggctacaaggcaggcttaagcatactgtctgttcaggcttggaaaaagtacacccaaggtccctcaacttgtaatcgagttacaaaattgtcccccaaccacaaaaccaaatttctggcgtcccttaactaatcaattggttctttagtggttttcaccccggttttatccccacatgtcagcctgccacgtcatctctctttcccttccctcctctctctctcactcttctcttcctcctcggttcctcctcctcctctctctctctctgcctgtaggcccggtcggcggggcgatgcgggagaggaggagggcggcgccgcggcaatggggaagcacggcggcagcccggcggagctccgcggcggccgtgcgaggcccgcgacgccggtgggggaagtgacagggggcggcgcggcggacgtggcggaagtcgttgttgcaaccgcgagcctctcctggtgcgcgcgccaccaccgcaagtcgttgttgcaaccgcgagcctcgctcggatcctcctcctcctcctcgacatggtcagcgagcaaacgccggtggcgaccgccgaggcggagctggtgagcagcgccgcggtgcccgtcaaacccgaggaggccgcggcgaaggcgcagccggaggacgatgctcccatcgtcgaggacgccaaggatgatgacgacggcgatgaagacgacgatgacgatggggatgaggatgaacacggtaacactcttcctccttcgcggtttcgtcttcgttaatattgcgatctgtccatgtgaaaggcagcgtgcagtagttttactgattagaaacgtgtcagtgcatcgtggtgtttggatttcgttaacggttttaccttcggttcttgtagcaattactaatagctagatttatagcctgatttgccgtttttgatgaccttgaattgaaggtgagcacggtgcagttgtaaacaagggctccaagcagagcaggagcgagaagaagagccgcaaggccatgatgaagctcggaatgaaacccgtcacgggagtcagcaggattaccatcgagagagccaagaatgtaagaaactgtacagctgctgcaaacaatttattcattcgaatggaagacagagttaatgtttctctgaatcccgtgtgtttcagatactgttcgtggtgtccaaacctcatgacgtcttcaagagcccgacgtcggagtcgtacgtcatattcggggaggccaagatcgaggacctgagctcccagctgcaggcgcaggcagcgcagcagttcaggatgcaagatctgagcaaggtgatgtccaagccggacgcggcggcagcagcgccggccgacgaggagcaagaggtggacgagacagggatagagccccgcgacatcgacgtcgtcatgacgcaggcctcgtcgtcgtcgccgccgccgtatcgtcgccatcgccgtcaccgtgtcatccgccgtcgtgtcgttgtcgcgtgtccttccgtgtcgtcgtcgccgccgccgcgtcgtcgccgtcgtgtcgcccgccgcctcctcctctcccgtctcaccttggtggtctcctccgccgctggccggcttgcccatagaacaaaagagaagagtgtgtgagagagagagagaggagggaagtgagagaaatatgacgtggcaggctgacatatggggcccacgtgggtcccacatttgaatcagccgtcacgtaggacaaaaccggggtgaaaaccaccgaagtacctactgtgaccggttttgattagttaagggacgccggatatctggttttgtggttgggggacaatttcggagttgctagaaatatagcgctatatgctacagtcgattttttttagccacttacacagtagttacacctcatttacaccccacttacatatgtatagtatgtaattttcgaatttatatatgtaattttagtacttacatatgtaattttgagacttacattgtaaatacactaaaattacatatgtaatttaggaacttacaatgtaaatacatgccgattattttttgatgaaaaatatggcaccgtaaatatagctacacccacaattttgtaactccataacaagttgagggaccttcggtgtactttttcctccaggcttcagatgcacatagactagttgggctactagacgattacaagtctctcaagcccaagttttaatcatcccaaaaaagggtccaagctttcacagtggcgctggatccacatatccatcaggctaagggactagctatccatcacacgacagatttttgggtccaaatcacacagattttagattagttggattaggctcatttgatcacttgattagaagagtctatacatgtatcaacatatattaattatatatattgcatatattttatttgttagatctttacattgaaaaaaatatatcaccaacccatctactaaaagttacagtgtaattacactatagttacagtgtaatttcactatagttacagtgtaactatagtgtaattacagtgcacttacatgtcatatcaactaaacttacaaatataattttagttatataggattgtaattttatattttaaaggaaataacaagtacatatttacttacacaacatttttaccaaaattatagtgcacttacatgtcatatcaactgaatttacgaatgtaattttagttatataggactgtaactttatattttatttcttcaatctcttcacctagctgcaacgacgtgcaatgtatgtactcatcaattatgtgccaagctagatgttgctggcctcatgcgtgcgtgggaaggaaacgcatcacagccgctaattaaatcatgcacagactaatccacaagggaagtaaatccgagtgatttcgtgccaaaaatttgtcgccagatttttagcaaaatcgtcaggctaatagcccgtaatatgataggcttttccgctagcgtttgttttctctgagtgtccagtgtagtttgctttggactctgaccatctcttttcagggcattgggattctttgagttgcataattggaagcttgcttttacttaagcaccacccagttccccaatctttcaacagaacaagtagcattttggaggttatcagtgtcatcaagtaaactgaagtcccttttctaccacaagtttcagaaaagctataatgcctgctggaaaggaaggaacataagattacatgttgactctacacatttggtgattatctatgtgagaggcttcaactactactaatccctagctgataactccaaatctttcctcgcctcacagggaataagaacaccgtatcaggatcaggccggcactagctgcactgcttttgattttgaacgctcgaaaggagaacagtgagccactggcagaacggcgtagcctcaccgtctgtaggcagcaactagttgccgcggtctagttgtagccttgtaggccacaagcgagctcgttgcggccgacaccggacagtgacttgactcaggaggcaataactccttcagctcaaccaaaggtggctggctgatgaactgcccgattttgaagggttcagttcaagttcctcctacttcccagccaagctgccttatccaattagccggcaggtgatgactgtcaagccagttgcattaagttatagcagacgtcctggagtgtgatggagttaggtcgaggcgatatttctattgcaagtagctcacaaggacgaatgaacgaacgaaaactaatgaaccataactgatagctccaagtctccaagttgtcaattcttgttttcaagacataaaattaagtagcttgacatcggccaccgccggtcgatacatgtcaatatccattagtatttatattcaggcattgactaagttaatgttatcttttcctttgtctctttttcttctttattattacacgttgacttccgctttacattaagtaatttacagccattggcggtgtcaacgcctcgctgatgatttagggaagctcaaggccatctttgcgtcttgcaggatacgaaaatatattttttgcaaagaggagacgctgtgcgtttccttttctttcgacctgactcgaaagcaaagtgttcgagttgcctttagcaaggttcagtataagaaagcaaaagaataattcgtaatcgatcctgcggtcaaaacgaaactggggctttcccccttttttatattacttgcaaaccttgaatgtaacctggcttatgttgattatgaaaaggagaaaccctatggggatttctcaaactgattaaaacgcttgctcgcagtacaaaccgaagtcttgtatcattttgtatttaacaattagtttcttgtgagataaacattgacacagtgcatttgtcttgtatgtaagctttgttttgtctctttacagctgctgggaacgattgctagatggtgggtgcaacgtcattccacacaggccggattctttattgtgatactttgatagcgtgggaatacttgggagttatgcctctggagtcgactccagctccctcttatctcacaggttcagagcacctgtggcatctgtgtactacatcacttccgtttattttccaatttgatcagatctaagacatacaactgacctcgtgcattgtttgtcaacctcctaacattcatgttgatggatattgatagccaaaaagcaaaaactcataaattcttccttgtaaatatagataagaccaagtaagagatagtataacaatggttgacctacttcatatttgggagctggttcaaccagaaggagctgttcttacttttttggcagactccagtagaatactgtagctagctagaatcggagctctggaagaacgggttattgtaatcatgcccagttaatgtaatcatagggtggtgaggctactcaattactagtagtacctcaagtgtagtccgtaccaaacatttgacttgctcgcattgctggtatgtgttgacttgggccgtggaccattgaatcgaacgtcgagttcggcgtcgcagcaaagcgatcgagcccctctgtctctctctctctctctctcgcagatctccagacgttcggtagttcggttcatgtgcacattgcacaagccgccttgaaaaacgcagctccctgcctcccttcaacgcgtttgcaacgtgcaggcaggcaggatctacgacgttgtgccgcaccgacgggtgtggtttggggccaacccgagatcggctcatgcagtcgcgcgctcgccgaatcaaacccggcgtccggctcgaccgggttcgcgttcgtcggcgagcttttagcttctgttgttgtctctcgtctggctcctgtgcgttcgcgaccgcgcatcaatcataccgagcaggcgcgcgtgccgcccgccggtttggcggcgaggcgggatgcgtgacgagtttttgccagttcgagcggcgctgggacgcacgcgcgcgcgggcgcggcgtgctgcgctctccgacgacgaggaggcccaccaggccaccaccaccttgtatgttgggggggcacgagaccgcaagagggaatgaaccgtgaacgtacgatgcaaaagcgagcggacaaggcggcattgcggccaggcatctcgtgctcgctgtgcggaatggaagcggaatggaaggggatgatgcatccgatctgacgcataccccaactgctagtgcactgcagtgcagggcagtgcagcgcagcgcagcgcgttgctgcatgccaggtcggtctggccctctggcccatttggccgccgacctctcccaaaaaatatgcaggcatccacctgcacgaaactgcgaggtccgattcctttattggtcggagacaagagagtgttgccagttccccccaccgattaatcccaagagcaatccggatgaacaagcaagccacagcaggtaactaggtaagctgtggcgtctaagttctaactgtaacactcagatagctggctgcttgctagtaggtgaatgcaccaactcctgaacggaattggtcacattcggaggaagagggacctgaatggccgaatacctgatctataatctgaacttgacccaaatttgatcccaccaaagtcgttacaggatttttctcaggatgttgttgggccaaagtacaaccgtagaagtcatgtactaccttacctgctcgtccgggtgggtttggtggagcaaactgccgcttaccccgaactaccataattctgttgcagactcacaaagccacaatgtcaaaccatcaggcagcagccatttatgtcccttcccccacaaaaaagacccctttaggcgcatgcgttgacccccccccccccccccgggacctggcatgtttatattgcgttgagctatagtgccttccaatgtcagccgaatcaccaaacacttggcccgctagactttgctttcgctgcgctctctctctctctcaccgtgtacgaccgacgacgggggaagaggttgttcggcaaagccgttgtacgtccaatcttgactggtgccgcggcaccgctgattaattgggcacaaccgatgaactaaaaacgggatcgcacaatcttggcccgtgctgcaaaggcgattagattagcgagcaccgcacacccgaacgccaaattttgatagctaagctcgtgtttcataccgtgatacggcacggagtactgctattttggctcttaactaatgctagctctacgcacgacctatacgactctgcagaaattaacatcttgaccgttttctaatttctaatcgtcaatttggataacacactagcacagtagcaacatctcgtgtttctcgttcacaggcacctgagaaacgcataaatgcagcgttttcccactgcaaaggcaaggaggccgtccgttgatgagccggtcgttaattagccgcgcgttcccacccacacacacacgcgaacacgcgcagtccagtagccgcgcgtgcccacgacgcaccacccacacacactttctgcccccgcccatcgccaagttgagcatccacgcacaccaaacaccttgcacatttcctaatcttaacacccccacccaattaacgccaagtcgtcttctccttcgccttcccctctccaccctttgtatataaacgcacacaagcgctcggaaagccaactcagaccgaacaaaaggatcaccagctcagagctcaccaccaccaccaccaacaacaacaacaacgcattgcaaagcaaggagaaatccgaagtccaacaacacccacaagaaaagagaagaagcggggaatggcgatcgccgtgagcgggcgctggacgcggctgcggacgctgggccgtggcgcgtcgggcgccgtggtgtcgctggcggaggacggcgcgtcgggggagctgttcgcggtcaagaccgcggccgcggcggaggcggcgatgctgaggagggagcgggggatgatgtctgggctgtcctcgccacacgtcgtgccctgcatcggcggcggcgatggccccgacgggtcatacaatctcttccttgagttcgcccccgggggatcgctcgccaacgaggttgccagggatgggggacgcctcgaggagcgcgcgatcagggtgtacgcggcggatgtcctgcgcgggctgacgtacctccacgggatgtcgctcgtacacggggatgtcaaggcggacaacatagtgatcggtgtcgacgggctcgccaagctcgccgacttcgggtgtgcgaaaaccatggattcggagcggccggtcagcggcacacctgcgttcatggcgccggaggttgcccgcggggaggagcaggggccagcggcagacgtttgggctcttggctgcacggtcatcgagatggccaccgggcgcgcgccgtggagcgacatggacgacgtcctcgccgccgtccaccggattgggtacacggacgccgtgccggaggtgccggtttggctgtccgcagaggcgaaggacttcttggccatgtgttttgcgagaaacgccggcgaccggagcaccgcggcacagctcttggagcatccgttcgtggcattcgcctgccacgaagtcaaggccgcgcagccgaagcccaggtgggtctctccgaagagcacactggacgccgcattctgggagtcggagaccgacgacgaggaggaggtcgacgagataacagagagcctctgcgataggatcaagtcattggcgtgccctgtttcggccttgccggattgggactccgacgaaggctggatcgatctgctcggcgagcagtgcgaggcttgcgattcggaagcggccagggaatcgattgatgtggcgcgtagcgcgccaagcaaagtgtccagcgcggcgacggtgccagctgctgaagtggtgcttgtcggcggcggctgctgtccaagcaatgaagcggacgctttcgatcagtcaattggtggcgatatccaagccgctgatcgttcaatcgagcgtcggaataaagtctgcgctggttcagacaatgatgtacttccatttcgattagtatgtaacggaatttgtgcaatggaattctttcagtttttcacaaatcttgctgtgctgttatgtttgattccctccgttcccactatgttttcgtcaaattgtgagctacgcccatgcctagagcaaaagctcagtccatacgcaccacgaaatatttctattcaactttattacgtaagtaaccacgcaataataaacaactaaaaaaacaactcaagaagcatagcataacctgcctgtgacaccacggcattagatcatccgttcccttccacggcatagtaaagaatcgataacacctggggtttattccgttctggaatcccaaatcccaaccaacggcttctccttctcgaccacgaaacaggcggagccgcggaggattccggtccccgaatcgacacgggggacggggagcgtcagccttcacgtacccacgtacgtcgcgtagcagtacagacgcactagtccacttgattaatctcgtggccaaaccaaaacctccgcactggggaaaaaaaccagcgaccacgagcggcgacggcgcggccgtcggctcaggctaaaaagaaaagccgtacctgcccctttcgcgcgcgaccctcccgatagcgattggccctcctgggccctagccggcccagcaccgcccatatccgcaaaccgccccccaacccccgcggccgctcagcgctgacggcttcagcttctatctcctcgccgcgacggtgcgtgcagtgcgtgcgttgacgtcaagcgtggggtctgcgtggcgccgcggccgcaccggctgacgtaacccctcgatcatcctcgccatcagcccgcattaccgcgcccccgtctagccaagcgcccgcaggcatacgtgcgcccggtcaaagcgtgggcgccataatttggcccgcgcgccggcgggtgcggctggctggctggctgccggccttgccgccccggcgattatccggccgtcacgtaccgtttgctcgcgacgcgtgtcgaggcgggagggtgggcgcgcgcgggcgcggaggcgtgcgtgactgcatggccggtgagcacgcatctatcgtgccgtgtaccaggtgtagcgtgtaaaaattttgcgcgtggtgggggcacgaaggccgcgtatcggattgggccacaggggatgaggaggaagacgcgagagctctggatggagtccacgggggaaagggcatttggggcgtacggtacggttgccaactcgtgccgcggaagagtccacggctttcggttcgcctctcccgggtggccgacttcttgccactttgtgccttctgttgctttcgagtcagctcggtttgggagagcgtacacttgagagatactggttctagatacgtccagaagatttagtttggtcaccttatggattataatggcttcttgattctagagagattcagaacattgaggctattcgactcattgattgcgaaatggagagtttggtgaagtcagcgcgcggtttgggttgtgcgagggcacaactagatactgtttgatcggtcattaggtggccctgttatcacgtggacatgtaatctctgcatctagaggatgtctggaagtgtgcaagaactccaagtctcttatggtcagctcaatgtcaaagcctgcattgctggcaccaaaatgagctataccgggtagcacgaccggtgatttggacgaactggctccagacgtaagtgtgcatgcagtgctgtccaccgaattaccacttggcttggtgatcaagcccaggctgcacactactactttgtaccaatccgtatcgatcagaggtgttctcgtagggatccagatcctctgcattggagaagctaatgcagagggtggaattagctccaatcctatccgtccatcatcatccaacagctgcagcttctttttcccttcgatactggtaccagaaacaaacaagtcctcctcaccggtgaccatagcaacgcaagcgcaatggcaatgagtccgctttggcgatctaaaccgctgcgcctcttcccttgacctatattatcaccaccatgagaagctgagagtagcaccgagctcatgattatcgaaagaaaatgaagcaacagcgcatgcaatgttcggtctctcggtgcttatccgtagtgcggttcgtgccgcaggccaaccctttaatatccagcacaacgccatgattttcgttcatccatagcttctgcagcgccggcgatgcaacatacttcacgagccagcgattcgaggaaatcgatactccctccatccataaatatttgatgccgtttactttttaaaatatatttgatcattcgtcttatttaaaaaaatttatgaaatatgcaaaactatatgtatatataaaagtatatatgtatatataaaagtacatttaacaatgaatcaaacgatagaaaaaaataataattacttaattttttttaataagacgaacggtcaaacatattagaaaaagtcaacagcgtcaaatatttagggacggagggagtaaaatggaatcaataagaaaaagcaatcgcagccattccctctcagatggatggccaggatttgacagaggatttgtggtcaccggtgaggacttttgtttctggtaccagtatcgaagagaaaaagaagctgccgccgttggatgatgatggacggataggattggagctaatgccaccatctgcattagcttctccaatgcagaggatctggatccgttctcgtagcaatctctcttgtgccagccaaatggatgaactaggaggtgcaggtcgtgtgtttattcggtactcctacagatgacaaaaccactatacgggaattcgggaaataaacaagactccgtataagcacatcaaagctgccagctctctagttcaggctcggttcaggttcccatcctctgcctttgggggagaatggcagagacacacagtgaggggagctacagtgccgtaccgttgctacagtgaaaatactgtaactaaggtaaaaaaattcaattattttttgttgttactgtagcatttaatattgtgcatccaacggcatggcgatgtagctctctgccgttccagttggaactgcagaggatgcagagccgttcaggctacacagcggcagcggttcttcagcggcgcccggaaaatcctttttctttatctcgagtagtacaactgcatgcatgtctctctacgcctacagttccgtacacttgtattttttttgttttgttcattcattatgggccgtagctctctgtccactgctttcttaaaaagaaaaaaaaaacaaggacaacaaaattctaaaagttggagatatagacagtataacgccgtccactaggataaagcaacgtgttgcacgcctccaccagggacaaaacgccaggtattctcccgttctagagctagacgcgcgaaaagaaaacggaagcagaggctatcagagcagcgctgtggccctgacacttgtcgatgcaacaactgcgacaggtaatcggcgccgagcacgtaccaaaggcagccgccaacgaatagcacaggtggcagaaggcgagctaacggatactaccactactagtcggtagtaatccctctgttactaaatatttagcgtagttaagttttttaaatatatttagttattcgtcttatttaaaaaaattaaataattattaatttttttcctattatttgatttattgttaaatatatttttatgtatacatatagttttacatattttataaaatttttaaaaaggacaaatggtcaaacatgtttagaaaagtcaacgatgttaaatatttagagacgaagggagtagcagttactactattgcggatgagtttggatatgtactactcactccgtcttaaaatgtaagtatttttagctatgaatctggatacatatagctaaaaatatttatattttaggacggagagagtattctgtatttgtatcagccggaattttaagggctgggaatgattgtattgatgcgatcgagggcacaatcacttcgctggcacgatgaggccagggaggatatgcttatcatcaggactgggttcactgattggaatgacgacttttgcttttgattgctacgcggtgctgttttttggactgatttctgtcatcagaacatgcgaatcgatcacatcggccgccttaaatcaaggcccctccagcgatgtgaatcatgtggttcttaattacagttgcttgattgcttcagataatcctgaacatctaaaaagatgcacgaccatagcacgggatactgtgccacgcggagcagcagcaaattaaaacatatcgatccttcctggccaggtcaacctaatccaatcgcatcaaaccgagcaacactaatgcttgccgccgcctgccaatctgccatagaaatgtgcaacgagccggcgcacgaactaactacttcctcagtttcaaaatgaagctattttttaagattggcacggatattaagaaagtaggtgagaataattagagtaagtgtgtgattggttgaaaagagaaagtagatgaagaagaatggttgtggttggttgagatgagaaggtaggtgaagaaatagctttattttaagacaagacactgtgctaaaaatagttatattttaatacgaagggagtacaagctgacatatgttcttcatcgcaccgaacgaccgaaccgcgcactgggcgtatcctctggctccccgcgtcctcgatgagtcgctaggcaggagcagggcttctgccgatccgatcaatctcgcgacggatacgtgtacttctctgttctgctctaccgcgccacgcgcatggtttgcatggatcgcgtccgcagcgtttggcctgcatgcatattactacctccgtcccataataaatatagccgtagatatccgtgtctaacatttaactatccgtcttatttaaaaaatttataaaaaaatttaaaaaatttagtcatacataaatcactattcatgttttatcatctaatatcaataaaaatactaattataaaaaaattcaaataagacaaatggtcaaacgttgaacgtaaatagtaaatagtgtaaaactatgagccggagagagtactactacatgcatgggccaggcggtagcaagcagtggcatcggcggcgcagcttggagaggccctctctgcttgacttcacatctgttcccttcctttgggcgcgcgcccggccaggtgcctacgaatcctcgtctcccgtacttctggagtacgactcgtggcacggtttcccgcgctactaacagtgccctcttgggattttatggcaggcgtacgtggaccaataagaaggttacagtgccttgggactttcagaatagggcgtggctaatggttttcacccgcccatcccctatacgcccctttcctccttcctcctccccttcttctctcctactacaccataaatttaaaaaaaataaaaaaaacaagttagaaaaatttatgtatagaaaaactatatataaaaaatatttgaattcaaatttaaatttaaaacgggtatgtaaacttttgacttataaactttgggtttataaattaatatttgaattcaaattcaaatttgaatcgagtatgtaaacttttgccttataaattttgggtctataaactttaggtgtataaattttagatgtatagaaatactatatataaaaatatttgaattcaaatttaaatttgaatcgggtatataaacttttgacttgtaaactttgggtctctaaactttaggtgtataaactttagatgtatagaaatactatataaaaaatatttgaattcaaattcaaatttgaatcagatatataaacttttgacttataaactttgggtctctaaactttaggtgtataaaatttagatgtgtaaactttaggtacaaaaatttactaaaatcggaaagtaatacagtgacaaaaaaggaaaccatgtggaggaggggggtgattgctaggggcgatcgatcgcccgttagcctattcgttcagaatatattaagggagatgctgtttatatgaggaaaaaattagaaaaagaaacggaatcgctataaaactttgcaacatatctttcttttaaaaaatatcgattatttagtcgctggattcattccatgattcatacacgagatggaagaaatcgcactagctagtggccgcacaagaaaatgtcgtcatcgcgtgcggtctcttaagtggaccgcatacgatgtgtttgcactattgtgtgcggtctattaataggaccacacgcgataatacgtctacgcatgtgacatggttacggaaagggcataacttctattctacgacttatggaatactccctctgtcccataaaaaccaacctagtatcggatgtgacacatcctagtactacgaatttggacatatatatgtccgaattcatcgtactagaatatgtcacatccggtcctagattcgtttttttatgggacggagggagtatatagatacatcatacctttgtatgtgtgatagacttccatatacgataaggaaattgacaagagattgtggaaataatcctcacgagcaagtacgtaacagagttctactcggagaggttatgattatactatatcgtgcagggtccggggtctccgagttctactaggagactaagggattcattgtataaatatatatccccctgaggggtttagggtatcgaatcacagcactagccaacccgccaccacagaagcgatccggaggacttgaagcctactcgccggtagatctcgttgagactctctcgacaaggatctcgtcggtaattttggaatcagttgttctctattgtactatgtggatttccatatcaatctcatataaactagattagggctattacctcgcgaggggcctgaaccaatataatcctttttgtttgcttgatgtcgaatcgtatagatccttgtaccaacgtaccccaatacccatactgtgcggtatacggtatcccccgtcgatagcatgcggtccgtcaaacaacccctggggaccggtttttccatgtgcagctacttatgccctgcctaaaacctatgccccccgtgtacaggaaaatcgtctttttagtagtgtgagaggcattgataccacaccctctactttgctagtcactaagccaacgctgactttggtgtaaaatataaatttacatgctactgtcgcccatgtaaaaaaaatcactcctgggtattatgcatctaagtatggagtatatttgtactctattgtaagattactgacaacgaccgtcggtgctggatgtaaggttcaacaataagaagtcttggactctcaaaactgtcgaatgtaatataaccctatagatattcccaaataaaattatgcagctttcttcagctttatgcacctatttgatttgaaaccctactaaaatattgaaaccctactaaaatattgatagtgttaattcttgagcaagttttaacactgccaaattttttggagtgcagagttatactccttccggtatcaaaatagttgatgttttatatgtggaagcaaaatatgctaattcttgatgttttatcttgcctgtacatcttggacctgcttgccctcctgattaaggcctgtttctttcagcttgagattattataatctagattattgagtcagattactataagctagattgttataatttgtagtagaataagcggttagttgtttctttcctagattattggagcctagattattaggtttgcaagtctaaagagggagtggggtggtatggtgggtaatttttcacccaataatctggaaaaagctcacctaaatgagcttatcagattataataagctgggctccagattataataagctacttcaataagttatctgtttctttcagcttactcccaatgatctagattataataatcccaagctaaaaaaaacagggcctaactgctcgttggcttctttggttctttctacgcgttgcttgttggtcgtcagccttttacatgctctttgctcgctgccaagtactgctttcatccatggataacatactagtgatgagatggccgagcatagaggaggccgtgcttttagcaacttcttcctcgccgactgtagggttggacaaaaagctcgaaactcgtaagcttgtctcggatcgattcgaactcgtagtattaatgagtcgagtcgagctagccttttagctcgcgagctgctcgttagtataaaatatcaccatatcttcatgaacttagtatttcttgattggtgcttagtcttttaattacagcaaaactattcatatttagtgactactatattagttagtgtttattattatgttaatacataataaaatcttaaatttaaaattattaatatgatattattgagatatagctcgttaacgagcctaacgagctagctcgcgagccaagccgagctggctcgttaagacaacgagctcaaacgagccaatctggctcgttatccacctctagccgacaggtgtgatagcagcgatgatgtagcagccgttgtgtgctagagcacgcgtgagcgagccaaaaatgaccaatacaacgcaatgtaattttttttaatgctttcagcgactgcttcctcgctgacaacgagtgtgatagcggcgatgatgtagcagccgttgtatgctagagcacgcgcgagcgagccaaaaatgactaatacaacgccatgtaattttttcaccgacaacgagtgtgatagcagcgatgatgtagcagttgttgtgtgcgttgtaaattttttttatgctttcagcgactgcttcctcgccgacaacgagtgtgatagcggcgatgatgtagcagccgttgtatgctagagcacgcacgagcgagccaaaaatgactaatacaacgccatgtaatttttttaccgacagcgagtgtgatagcagcgttgatgtagcagttgttgtgtgctagagcacgcgcgagcgagccaaaaatgaccaatacaatgccatgtaatttttttttaaaaaaaatgttgccttagtaggacgccatgtaattttttttaaaaaaaatgtttccttagtaggactcgaagccggcacgtacagacgctaccaataggcccaaaccacctggaatagtgcaagtttctgattcctatttgcacaagaccgtacttaatatgagtaaaacaggaattagataccctaataaattactcttggtatgtgagattatgtctaaaacgtcaagaattttgaaactagagagagtatcaactctattgattttggaaaaattgactacaatacaaatggcttgtagtatgcaatattatcaaagtttctaaataattaaatggacgaaatttaataatagctttttcgtttccttttttcttgtatctcttggtggcttatagttgttttgctctaactgataatctctcagcactaaatattccctaagtattcactaccatatatggaatttcatgattgtctagtgtcctataaattctatcttttagattctaaactatattaaacattaattagttcaaacatattcgcttatggatttgaatatttgaaagattaatcatttagtatatttaacatgatctatataatataaaaacacaattattattattatttgttgaggagggtattactgatccaattgcgtggtataggaaaatgatgttatttttttctttctttgttttggattttttttcttaataattttgggtttaccatgtattcagttctagagtactacagcgtagacatagacgtagtatatttaaagaagataaatggatgagagtttatataatttgtaaggggaaaatagttttggaagcctctagaatctatatgtgatattctgctctagatttttttcccactaatgattcttaagcatttattttatgtggtatgaattaatgatttttcttccaaggaaggggcgctacgtggaccaatcaaaagccagcaaaagagccagctttagattagtaaattaaccatgtcctcaaatcccctgtcttatgggttgagcgagcctcttgcatttgcctatctagaaattgaccagcgttgctaggtgagaatggtttacaaggaggacctttctgccatgatattagggataatacgatatttagctcgtggttagtggtcattggtcatcctttctcttctcagatctcaacaactcgtttttgatccaatagctcaaaacaacggctgagcctgcgagatcgatcccttgtctgtagctgaccgtaagctattaatagcacttaaccaagcaacctgaacgacggattcagatcacgatcgcagaactatattgcccctcgtactatcgcatgcatgctgcattgctgcctacggataatacagttttctcacaggataaaatgtccccgagatgcggggcttcaccagaacaccgcccggagtacactcgtacgacgtacagcacgtacggcagagaagctgcgacgatgctagtgagccttcttgccccggtagaggcgggagacgcgactgctcccggcctcatcctcaatttcacctcgtgttccaattccactccgctcactcgatcgcctgctccgctacgaatagccatgttgcgaccccctctggccccccaaaccgttggtcccacatgccagagtcccgttctccccctcgcatcgcagcgtcgcacgcttttcacgccatgccgtcacggtgccttctcctcgctcctctgcttataaatagtggaagcgctccacttggagcacggccgacgagagcgcagcggcaaatatcactaaatatcacacgaaaaccaaaccaaatcgaagaaagagagatactgctgtacttggagccaagcgagagagaagactgagacgcgacacgcgagcaatggaggctgcggtcgacggcaggtggacacgcgtccgcacgctcggccgcggcgcgtccggcgccgtggtgtccctcgccgcagacgaccgctcgggcgcgctcttcgcggtcaagtcggcggcggcggcggcggcggccgagcagctcgtgcgcgaggggcgcatcctttccgggctgcgctcgccgcacgtcctcccctgccttggcttccgcgccgaagccggcggcgagtgccagctattcctcgagttcgcgcccggcggctcgctcgccgacgtggtggcgaggagtggcgggcggctcgacgagtgcgccatccgcgcgtacgcggcggacgtggcgaggggcctggcgtacctccacgggatgtcgctcgtgcacggcgacgtcaaggggaggaacgtggtggtcggcgccgacggccgggccaagatcgcggatttcgggtgcgccaggacggtgggctccgacaggccaatcggcggcacgccggcgttcatggcgccagaggtggcgcgcggggaagagcaggagccggccgccgatgtctgggccctgggctgcaccgtcatcgagatggccaccggccgcgctccgtggagcgacatggaagacatcctctcggcggtgcgccggattggctacacggacgccgtgccggaggtgcccgagtggctgtccgcagaggcgaaggacttcttggcccgctgcttcgcgagaaacccacgcgagcggtggacatcgtcgcagctcctggagcacccgttcctggcatcggcaggctgcagcgtgaaaacaggggaggcggcgccccaatgggtgtcccccaagagcacgctggatgtggcgttctgggagtcggacacggacgacgaggaggacgacatgccagcgagccccgccgagaggatcaaagcattggcttgcccctgctcggccttgccggattgggactccgacgagggctggatccaagtgctcaacgagtccagcgaagcttgcgacacggcagtggccaaggtggaggccgaagggaaggggcgcgttctgatcgaagcgttggaaacgatcaacgaatcttccggtggcgatgcagagtgtgttgatcccgagggcactgtacgattgattactgttgcttccattgggcagcaggaagtgttctgcttgggtctcattaatgacccacttgtattttctgttaataaaagtgaattaacaaagtctttgtttccccaaattgtctcattttaattcttgcttctactcattttcttccactagtatatgcaatttgcaccatctgaccaagttcgcaactgctgaaccgatgtgccatgatgattccagaaacatggttctagactcaagaacagcaaatgcaagaatctgtgatcaggaatgaccggcagtatatcctccatggggccattgtaaaggcagcgactagatcataccagcaaaggctagagaaaacaccacatctgagaaatctgggtccttttttgccttggtctgaagtctgaactgctcacattcatcgcatattcctcactactatctactctactactgttgttgagataaggatgcacatgtagaataacatctcccaatccaaattgcctctgaagagtcgggagtgaaacagcgatcgggtcaactgggggtctcgtgacactggatagttagcaaagctactgcaattaggagcggcgcgattggtccggagtcggacgtgttgcgatgcgaactgatcgtctcagagtgaattccaagtggcaatgtttgatcttctctcaagcagagtagaccaagttgacgtacacgtttgatatttggcacacgtggtaggggagatggggagaggtgtccaggagcttgtctaaatccacaatattagctcaccgcgacacgtgtcctggtaggctcttccgtgaaacttcagtgcgcgtttctagatgtttactgtacacttgctgccctgccagtcatccggagttctgaaattcgctagaagtagtcgagaacatattctcagaagtagtaacttatgttccagaaaaaagaaagaagtttggaaaggtgacttacggggatacagtagtttcttaatctcttctactctgcattaagtgccggataataccgtgctgcatttctgaattatgaattccttgccgtttacggaatgaaaatagctgttaattgtgcagttagctgctgttagagtggattgaagtcatcatatacagcagtgaaagaatttggtcgccaacacgacatctgaaaaccgccagcaaccttgccgtgcgtcaaccaccttcacatttcaattccctcgcgaccgcttcatcgccgctggttcttgaggagcaagaggggaaaagtgtgggggggcgtagactagttctgttaattatcttaggagggtttgttccaaaaagaaaagaaaaataaaatcttaggagggcaggggcaccaaactgtgtaggtaggtggcgtccaggtcaacttttcaatgcagagaagccatctttgtgcttaacgaagattttgggcaataattagctagtcatcaagaaggaagttgggcaacaagaatctcgtgcatatgtaacccgtggtgatggccacatcacgttgcttgcgtcatctctggatttcagttgggggctctggatcaatagtgttttaggatatcctgtactggctgtaacaactaacaagtgtgcatactgaattgagagtgggatataccccgcaaaaaaaagagaaagaattgagagtgtatatactagtatggctgtgattatacagtggtgtctgcaagtgccaatgtgccatgctgggttggtacatgttggttttttttttttcatgaacctgggtctctttaacaatctgagacaagttggtgtgagttaataatattctcatgttgtgagttaataatattctctgtgtgcgatgagatgatatagggctgtccttgagacaagttggtgtgattctgactgctattgtagttgtgttcagtgggcatatccagcaagggggtgaatggttcaaaaaaaaaagagcaagggggtgaaaaaaaatggtgtgtttctgagtagtacaactgtagttgagttcagtgccataccctgcagcaagaggggagggaaggggaaaaaaaatctaggcacgagatcattggacgatggcgacgcgcaacagtgaaacgtgccagtagggcatatggtgcgtgcgcggcgtgaaccgtgatgcgtcggcccgtcggtgacgcgcgcacctggtccagcgccggcgccaagataagtctcgagatcaagaattccgagagaacctttccttcctgatcagcagccagccgcccggccacttccgggcgaattcatgcacagcccggagataattacagatgcgcggcgttgcacgcaatactactactccactaccaatcatgcgtgcgaaacagtataggtgcatgcaccgtgcgtgcgcgatactattcagaaggtaggggataaacttggcagccgggggtgggtgaacagagtggtagaaatctattgtcagccaggcaaaaacaaacgccggggccactgtcgctttggcgtgccgaattgctgcatactccggtcaccctctgcaagcagcacaccacgttagtgcttacgcctctcctctgcaagctgcgaagcaaaagaaagacaaacaaagtgaaagtaatggaaaagaagccggtgcggttaatctttctctgaaacggatcatgacgacgattcagagtttagattattccccatgggacgtttgccttgtcccggtggtgcaccaaccacaagtccgcaagcaagatagatagatagaccatagatatgccgttcgcccgttcctgtaccggataagtcttcttgtgttgtgtaatgtgtctgtgttaggtcagtactaatttctactcaggtatgaaacgtgaccacggtttggtgcaggtaaattcggtcacgaggccagtatatatttggatttttcagtgaagccatccgagaatgactttcgctgcatggagttcaacaattcaaccaacatgtgttagttgacagtattttttttacaccattggaagatttcacggtcagtgccaatgatacccattacccaagaggcttataatagtcaagcagagcatatgctactctattctgagctcgctggaccaaacggtaggtgagggccaggcacgtttgatttgttcagaaagtcaaaacatgtgccggaatcgcatttgcatcgttgcatggccgaactgttcgggctggagagagagagagagagaggagcagttcagcctaactacacatgccgcgcaaaacatggtgcgaaccgagccacacctacagggagatctagcgaagggtacccaatcgaaccaaagagatccgagcgaaacaaactcattttctaatcgtggtggcctaacaagtcgggcagatttgctgttggtgctactcagatatgtgcagtatcgatctcacatagtcacatcccgtgaacagcctggctgtctcttgttggtgtttgtacgtctgatcagtcgatcgaatcacatgccgctgataagcacatgcgactggatcatcagggagaggagggataggttgatctcatggctcgtgatgagctggtagctagcgcctaactgtgaagcgggcacgcgtgatgtaatgcattgtgagacaattgcatctccacacgacgcgagatcgcgtgctcttccctctcttttgtggctgtggctagatcacgcgagcaaattccacgtttatttcccgtgtttgcgcgatgtgctacggactgctcgttgggtttcaagagaacttttaggcgagatccatcagtagtcgtacgagtagcacgtacataacctaatcgcaatgcactgcctaacttgcaggaccgcacctacatgttgatatatgttgaaggacatcttgatagcgatcaatcagcatgtggttgccaattgaacaccaatatctagatcacttccaaaggttcgatcaatccagctcgaatgtggcaatcttgagctcagattccactggtgtttttgcaatgctgtgagccggtgggcatcaagcccctaaaagaacagaggaagatgaacagggcctgttcacagtgcctcgctatccatccaaaaaggtaaacagcagagttagctttgacctctcctctcctaaagtggatcatcgatatctttttattaaaaaagaaattccacacaaaaaggagagaggaagtacgatatgacgtcctcgtgggcctaaagtgacgtcatagtgacgcgcagtaaaacggcatgcttttctccgtacggctcaacaacgggtttagtgaaatcgccgggtgtaatcacacgtgattaagtcgcaatccagtattccgtacgcaaaactgcttgcagaacagacctgccaactttactagaaggggatggattgccgttcgctaacgactccgatcctgatcgctggaaacatgagctaattttgacatattcataattcatgtctcgctcgaactaattttggtctcgaactgtcacgtgattgatttgcaaagtagtaaaggagacgtaatgaaaagttaaatgcaccaactggttggtcacaacgagaggaaatttgagcggaatttaattttattactctgttcctgttacaaacacaatcgaatctcactgattcagtcccgtcagtatcgaacgggtgaaaaatttcatttttaccactgccaagatgtacgtgcaggtaactgccctgcctaatggaggattcgatcgcttctgcttcattgcgcgggacatggttgacgccatccgcggcgacggcgaactgctccatctctgggtcagacagttctgcccagacgaagtagtccgcgtcgctggccggcggcgtgacggcggcgaaggagacctcgtcgtgcacctcgatccatccttcgtcggagtcccagtccggcaaggccgaggcggcgcacgccaatgcaccgatcctctccgccgcgccggttggcatctcgtcgtcctcgtcgtcggtgtctgagtcccagaacgcgtcatgcagcgtgctcttgggggatgcacgttcttgcttcgccggctccggccagcggtcgagggccgcggcggaggcaacgaatgggtgttccaggagctgcgccgccgttgacctgtcggacgcgttcctctcgaagcagccatccaggaagtccttggcctccgctgacagccacccgggaacctccggcacggcgttcgtgtacccgatccggtggactgcggcaaggatgtcgtccatgtcgctccacggcgcgcggccggtggccatctcgatgatggtgcagccgagggcccagacatcggccgccggcccctgctcctccccgcgcgccacctccggcgccatgaacgccggcgtgccgccgatcggccccgccgagtccatgaccctcgcgcacccgaagtccgtgagcctcgcccggccgtcgctcccgatcacgacgttcctcgccttgacgtcgccgtgcaccagcgaattcccgtggaggtacgccagccccctcgccacgtcagcggcgtacgcccggatggccggctccgggaggcagcccccgttcctggcggcctcgtcggcgagcgacccgccgggcgcgaactcgaggaacagctggtactcgccgcccgcggcggcgcgcgatccgaggcaggggacgatgtgcggcgagcagagcccggacaggacacgcccctctcgccgcagctgcgccgcggcgccgccggcggaggccgacttgacggccatgagctcccctgagtcgtcgtcggacgcgagccacaccacggcgccggacgccccgcggcccagcgtgcgcacccgcctgagctgcttagccattgcctcgatttcttggtccttggaattcttctctctttgtttcttctttttttcttgccttgtgcgtatggagtcagtgtgtggcgtgcggtgaggagggggagaggtgtatttgtatggcccagcggagcgtgtgcaacacgtgcggaaacggctttgtgctgcgagaggagagagaaaaatagcttaggcagcgtgcgtttttggtagcctcccgcaccgcaccaccatatgccccacgcacccacactctccctcccctgcatctgcatgtctgcaaaggaaggtggaacgaagttgtagctccggttgtggtcgtgcgttttttggccttttttcgccggcgttttgtcctgcgattctccgtttgacggatcggcgtcactgccgccggccaggtgcatcggcacctgtggcccgggggcctgtgtgggtatccagccgatacgcgcagccgcacatgccctttatcgcgtgacacttgtccccgcacgtggtctgcgatctgctcgggcaaccggtaagagcaaatttaagccatcaaccagctacaattcatttataaccaatttaataactaatttataaatagttacatataaatatatagcaatggttagagacgggatgccgtccccaacaggatgctcctcctccacaacgcgattctcacccacgcgacgcggccgaaaccctaaacacgcaccaagcctcctttgcagcgccgcgtccaccccccgccgctgccgtcgcgcctgcgctgcccatccttcaccctcaacgtgcaccaggcctcctctgcggcgccgtcggctcgggcttggcctaccgtgagggcagaggtcccggcatttgtggagttactcgcaggtggagctccgagccgccacaggcaggttcgctgcggcgaacatcatgtcagagtgcggcgagaaggcgcccaaccttgtctacaggggacggtgcaggaggccagccgcgccgtcgggatgctcctcccctaataggatatctagtagaaatcacctgatacctggtaggtatcattcgatacctcgcaaatatcatgcgattcatggtagaaatcgtttgatacctgataggtatcacatgatacctcgcgagtatcaagcgatacgtggtagaaattgtctgatacctaacaggtatcacatgatacctcgcgagtatcacacgatacgtggtagaaatcgcatgatacctgataagtatcacctgaaacatgtgtagaatcgtctgatacctgataggtatcacacctgatacctactcggtatcatcccaatcgaaaacaagatctcgttatatagcagctaaatagttacacatagatatatactacactattaatatgtggtctcatatcttatactcacacaacgttttacaatccgtgttactgctgactataaatctgtagtctgttttacttctctcttctcttatcatctccatatatacttataattgatttgcagcctgctattggacttgctctaatctcgacgtctccttttgcctcgccaacggataaggcctgcaaaaaatgattgaatcatcgtgttaccatctctctctttgctactgtttgttcgttctttcctctcatcgctcctgctagcctttatgggtgatgtccagtctaaggtactcccttcggtctgataatattagttgttttggacaatgataaagtcaaattttaaaatctttgactacaaataatttctaaaatatttatcttaaaaatatgaaaaccatatgtttagattagtcttaaaaagtactccaataaaatcatatatttattaatatttttatatatattataatagaaaatagttgttaaagttattttttgaagactgtgtctttgttcaaaatgacaagtattatcaacccggagagagtagtacatttcaacacctgaaaccgaacatataaaataaaatgaccgttttggggggataagtctggctgatctctcaacgtccttgtgcttggggtttggccggatgatcagtttagacctcttgcatctggcgtaacacttttggctggcacatgtgctgtatgatagctgtctgtcatctttgatgtgtgctctggtcgatttaagcctgaaagctcttccatcgaacccctaaacttggttttgcgaattttgtgtccctttcgccctaatgagagtacgagcaacaaggagcaatgctattccatatttccagggcgtcatccacattagatgattcaggtgatcgacacgtgtgatactctatctgtacagtttgtgctgtaccaagagccagtgtatttactgttgggttacccagactcccagagctgtaccgctgcccactttttcatgctggttattgtcttctttttcgcatgcaccccctctgtattaaaaaaaatatcttagttatctaaaaatattattttggcttaaaattttgtcaaaaaaaactgtctttttaaagttgagggtctactgacgtctttaatatgctcctctgtagtacttgatttctttttcttatcttacctatttttttagaacattatcttacatattgaaccaatagtaccacttcttcctctgtcatatccatgttataagttatatgccaaatccgttatattttagaaccgttggattatttgtttattaccctctctttgcaggctacactaaattaattacacatgcatatgcgtattttacagttgagaaagatagtggcacatgtcaccttcaattcactagtgctctcagcctctcctcaccttgccaatcattcatgcttttggggaaggcttccatctcgattttaatatcagtaaccgactgtttgcgcttgcggttattagctcaaacaaaaacttgactactccaggtttccaataccaaccatttcttgcaacgaagattcctttggatcttctttctcaacttgagatctttttatgcgtgtgcttataaactttgcctctgctcaacaactacaatagccgacggcgcccaaagacttcctccggaagatgaacctcgccctgtatacggtcgacttgaacgtggaaattctatgttgtggtattactagatttatgcatattcgacatctatgtgcaattttaaaatctgactcgatcacatctttaattttaaaactacaaactactatgtttgaacaatgtttttccattcacttgttgaaactactaacttttgttccttaaaaaaaactaaaacatgtctttcagtatgtgcttgacatttttgtgcgtataataaaattctttttttctttttatttttttggttgcaaaacaatctatttggttgttttttgtcattacaaggtaaattgtagattgggggggggggggggggttattaaaccattttcattattaagaaaatctagatgtgattattaggagattatttacggagttgggagttgagacaatttagaacatgaccaacataatccctaaatgaaacccaattcgaggtttaaaacatgctccaacaattaccctagatatatatccaaaaattggaatcccattatcctccagtcctcctttctcgctctccacaagtcaggagatactctcactcccaattttcccacggcaaaaggagagggcgacacgtggagagatcgcgcgcgtgggaggggatgggcagagcaattttttgtttatgtatatgttggtagttaggggtgggtggtggatctagtttttattattgggagttaatttaagatatctgttggaaataaaaatatatttacaccttaaaatcaaattaggaattccaaaaatagaattttagagagagtttttttgggtgtctgttaaatgatccccaaatgtaataactagctagatttcatagcacaacataaaacaccagctgcaaatggccggttctaagcttggccatcaatagcccgaaacgaaccccaatcctattttttttacttctgtagaaagaaaattcatccaacatatattatatactaaaagtccattaaacaccttagagacgcccttacatcgtcatgtggcactggtacaaatacttctaagacgtcacgggtgctctaataaattggagaagattttagaaattctatactaacaaataataagtacactcatatttaaagaaaaaaatgtacctatactaacaaaatttgatagtttgagtggtactatttacgtagtacaaatttgtgtctctactaaatcacatatagactcaaaacttccacgtagtgataccactgcatattctcaattcttgatcttccatatcttccctatgtctctcagactcttctctttgtccgtccccaatggtccccattgacgcatgtacaacacaacttggatagcttacgtaggtatcgcaggtgtgtgaatagtcgggctgaggtgagcccaatgggaggcctgcggtagcggcaaagccaattggacattttacaatgcagtcctctagggtgggactacaagaaactatgcgctagatgtgaagaattatgtcaaaatctcacttaggcaagccaatacaacgaatcagattgatgtgtctttttggagattgaattggtgtataaataaaaatctcgggaagtctgttgatagcgaagctagcatgtgtaggtttcaagggcaactgccatatcgatggtggatcagcttggacttcatatcatcggagaagattgaagcgagccaatgtgaagggcctgatgggtgtgtttacgaggaacttgagtgagcacatgagtatatctcaaggagtgtgtcaatgctcaaactagggcttcaccgcacgagagaagaaagatttggcaattgcagtctacttcactgggtgcaggatcatgtcggcattatccggttaagtggtagaaccatagaagtggtatttttacaatacatttacaataatattcaactataatgttaaagaccgtgaaaaaaagttaatatgtgctatattttgaggagggagcagtactggcagtgatttatgtttgaatccatgtgcatttttgttgtttggaagattgaaatccttcctcttttttctatgcttgtagaaaggcaatttctaaactttgtcattcagaagattcaactcctttctctttttttcccgatgcttatagcaaggtaatttgtaataaaagttcatgagctattttagttttacagtgttgttcttatagaaaaataaataagtgtcgtgtgcatttgcacgggtttgcttactagttgcccttatactggacttcttgttatctattttttgtgggaatgtgcttgctaccaattcttaatagcacggaaggaggggtgcgagatcacgagagaggagtcgcgaaaacacaggaggaggggagagatttgaggtggccctattttttagggtgttaagtttaggatatcttttgcaaagaagtagtatatattttatagtccataaattctgattaaagattccaaaagaaatttagtggatattattttaggccgaatgaccatgctctaaacttctaaagttttggtggaaagatgtcaactcggttaaaaattgctcattctagtcaaaacagtgagaatcagccttaaaccaattctttgaacggtttttgccggggcctttttttttaaaacggaagtttttaccgggagctcaacgctatgcaatctatgagcccttgattgcaagatgaatggtaacaacaggcaaatttgtgcagactcgaaatttattactctgttcccgttacaatgacaaccgaattttacagtgtcgctccggtggcaatcaaccgggcacaacggcatatcaccgcgaactctcacactcagttgtctgtcgtactcaatgaaaccacgcgcgcgtacagttcgcgtaacatagccatcgccgtccacgtcaacgaaatggagatcaatctccgcgtccaatgcttcctcccaccaaagaccgaaatctgcagtagtcaccaccatgggcgccggtgtttccgaaacttcagatgggtcgctttgcaagtcgatccagccatcctcggagtcccagtccggcaacgccgagcaggtgatcgccaatgcgctgatcctcttggttgcgctctgtgacatgccttcttctacttcgtcgtcttcatcagattcccagcattcggcgttcagcgtgctcttgggggacacccagccgtgcttcggcgccgtttcgtcgatgtcgctggaggcggatgcgagaaatgggtgctccagtagctgcgcggcagtggggcggtcgcttgggttccttgtgaagcatctggataggaaattcttcgcctccggggagagccattcgggaatctctggcacagcgtccgtgtacccgatccggtggacggcggagaagacgtcgtccatgtcgctccacgggacgcggcctgtggccatctcgatgatcgtgcaaccgagagcccacacgtcggcggccggtccctgctcctcgcctcgcgccacctccggcgccatgaacgccggcgtgccaccaatcggccgctcggagtcagtcctcctcgcgcacccgaagtccgcgagcttggcccgcccgtcggcgccgaccatgatgttcctggccttgacgtccccgtgcaccagcgagttcccgtggaggtaggccagcgccctcgccacgtccgccgcgtacgcgctgatggcgcgctccgcgaggcggcccccgctccttgcggcctcgccggcgagcgacccgccaggcgcgaactcgaggaacagctggtactccccgcccgccgcggcgcgtggggctgcagg
